US010113176B2

(12) United States Patent
Panik et al.

(10) Patent No.: US 10,113,176 B2
(45) Date of Patent: Oct. 30, 2018

(54) ISOLATED POLYNUCLEOTIDES AND POLYPEPTIDES, AND METHODS OF USING SAME FOR INCREASING NITROGEN USE EFFICIENCY, YIELD, GROWTH RATE, VIGOR, BIOMASS, OIL CONTENT, AND/OR ABIOTIC STRESS TOLERANCE

(71) Applicant: Evogene Ltd., Rechovot (IL)

(72) Inventors: David Panik, Rehovot (IL); Basia Judith Vinocur, Rechovot (IL); Hagai Karchi, Moshav Sitriya (IL)

(73) Assignee: Evogene Ltd., Rehovot (IL)

( * ) Notice: Subject to any disclaimer, the term of this patent is extended or adjusted under 35 U.S.C. 154(b) by 1011 days.

(21) Appl. No.: 14/360,960

(22) PCT Filed: Nov. 27, 2012

(86) PCT No.: PCT/IL2012/050481
§ 371 (c)(1),
(2) Date: May 28, 2014

(87) PCT Pub. No.: WO2013/080203
PCT Pub. Date: Jun. 6, 2013

(65) Prior Publication Data
US 2015/0152431 A1  Jun. 4, 2015

Related U.S. Application Data

(60) Provisional application No. 61/563,856, filed on Nov. 28, 2011, provisional application No. 61/624,431, filed on Apr. 16, 2012.

(51) Int. Cl.
*C12N 15/29* (2006.01)
*C12N 15/82* (2006.01)

(52) U.S. Cl.
CPC ..... *C12N 15/8261* (2013.01); *C12N 15/8243* (2013.01); *C12N 15/8247* (2013.01); *C12N 15/8271* (2013.01); *C12N 15/8273* (2013.01); *Y02A 40/146* (2018.01)

(58) Field of Classification Search
None
See application file for complete search history.

(56) References Cited

U.S. PATENT DOCUMENTS

| 6,084,153 A | 7/2000 | Good et al. |
| 2002/0046419 A1 | 4/2002 | Choo et al. |
| 2004/0172684 A1 | 9/2004 | Kovalic et al. |
| 2005/0108791 A1 | 5/2005 | Edgerton |
| 2006/0179511 A1 | 8/2006 | Chomet et al. |
| 2007/0061916 A1 | 3/2007 | Kovalic et al. |
| 2011/0167514 A1 | 7/2011 | Brover et al. |

FOREIGN PATENT DOCUMENTS

| WO | WO 2004/081173 | 9/2004 |
| WO | WO 2004/104162 | 12/2004 |
| WO | WO 2004/111183 | 12/2004 |
| WO | WO 2005/121364 | 12/2005 |
| WO | WO 2007/020638 | 2/2007 |
| WO | WO 2007/049275 | 5/2007 |
| WO | WO 2008/075364 | 6/2008 |
| WO | WO 2008/122980 | 10/2008 |
| WO | WO 2009/013750 | 1/2009 |
| WO | WO 2009/083958 | 7/2009 |
| WO | WO 2009/141824 | 11/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/078153 | 5/2013 |
| WO | WO 2013/080203 | 6/2013 |

(Continued)

OTHER PUBLICATIONS

Genbank Accession No. NM_127064, entered Jul. 20, 2002.*
UniProt Accession A0A1S3X4M2, integrated Apr. 12, 2017.*
Hopfner et al. Cell 101.7 (2000): 789-800.*
Guo et al. (2004, Proc. Natl. Acad. Sci. USA 101: 9205-9210).*
Patent Examination Report dated Feb. 25, 2015 From the Australian Government, IP Australia Re. Application No. 2014202590.
Restriction Official Action dated Mar. 19, 2015 From the US Patent and Trademark Office Re. U.S. Appl. No. 14/580,020.
Examination Report dated Dec. 7, 2016 From the Instituto Mexican de la Propiedad Industrial, IMPI Re. Application No. MX/a/2014/006333 and Its Translation Into English. (11 Pages).

(Continued)

*Primary Examiner* — Mykola V. Kovalenko
*Assistant Examiner* — Charles Logsdon

(57) ABSTRACT

Provided are methods of increasing nitrogen use efficiency, yield, biomass, growth rate, vigor, oil content, fiber yield, fiber quality and/or abiotic stress tolerance of a plant by expressing within the plant an exogenous polynucleotide comprising a nucleic acid sequence at least 80% identical to SEQ ID NO: 387, 1-386, 388-469, 763-3704 and 3705; or an exogenous polynucleotide encoding a polypeptide at least 80% identical to SEQ ID NO: 602, 470-601, 603-762, 3706-5858, 5860-5910, 5912, 5914-5923, 5925-6046 or 6047. Also provided is an isolated polynucleotide comprising a nucleic acid sequence selected from the group consisting of SEQ ID NOs: 387, 1-386, 388-469, 763-3704 and 3705, which can be used to increase the nitrogen use efficiency, yield, biomass, growth rate, vigor, oil content, fiber yield, fiber quality and/or abiotic stress tolerance of a plant.

5 Claims, 8 Drawing Sheets
Specification includes a Sequence Listing.

(56) References Cited

FOREIGN PATENT DOCUMENTS

| WO | WO 2013/098819 | 7/2013 |
|----|----------------|--------|
| WO | WO 2013/128448 | 9/2013 |
| WO | WO 2013/179211 | 12/2013 |
| WO | WO 2014/033714 | 3/2014 |
| WO | WO 2014/102773 | 7/2014 |
| WO | WO 2014/102774 | 7/2014 |
| WO | WO 2014/188428 | 11/2014 |
| WO | WO 2015/029031 | 3/2015 |
| WO | WO 2015/181823 | 12/2015 |
| WO | WO 2016/030885 | 3/2016 |

OTHER PUBLICATIONS

Completion Requirement Letter dated Mar. 27, 2015 From the Canadian Intellectual Property Office Re. Application No. 2,855,611.
Good et al. "Can Less Yield More? Is Reducing Nutrient Input Into the Environment Compatible With Maintaining Crop Production?", Trends in Plant Science, 9(12): 597-605, Dec. 2004.
Good et al. "Engineering Nitrogen Use Efficiency With Alanine Aminotransferase", Canadian Journal of Botany, 85: 252-262, 2007.
Completion Requirement Letter dated Dec. 9, 2014 From the Canadian Intellectual Property Office Re. Application No. 2,865,483.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.
Examination Report dated Jun. 10, 2017 From the Australian Government, IP Australia Re. Application No. 2012345456. (4 Pages).
Examination Report dated May 4, 2016 From the Instituto Mexicano de la Propiedad Industrial, IMPI Re. Application No. MX/a/2014/006333 and Its Translation Into English.
International Preliminary Report on Patentability dated Jun. 12, 2014 From the International Bureau of WIPO Re. Application No. PCT/IL2012/050481.
Invitation to Pay Additional Fees dated Jan. 15, 2013 From the International Searching Authority Re. Application No. PCT/IL2012/050481.
Search Report and the Written Opinion dated Feb. 19, 2013 From the International Searching Authority Re. Application No. PCT/IL2012/050481.
Requisition by the Examiner Sequence Listing dated Dec. 13, 2017 From the Innovation, Science and Economic Development Canada, Canadian Intellectual Property Office Re. Application No. 2,855,611. (1 Page).
Examiner's Report dated Nov. 22, 2017 From the Australian Government, IP Australia Re. Application No. 2012345456. (9 Pages).
Aoki et al. "Large-Scale Analysis of Full-Length cDNAs from the Tomato (*Solanum lycopersicum*) Cultivar Micro-Tom, a Reference System for the Solanaceae Genomics", GenBank Accession No. AK323912, BMC Genomics ,11(210), p. 1-16, 2010.
Aoki et al. "Solanum Lycopersicum cDNA, Clone: LEFL 1067CA04, HTC in Leaf", GenBank Database Accession No. AK099270,BMC Genomics, 11(210):1-16, May 1, 2010.
Examination Report dated Aug. 7, 2017 From the Instituto Mexicano de la Propiedad Industrial, IMPI, Direccion Divisional de Patentes Re. Application No. MX/a/2014/006333 and Its Translation Into English. (8 Pages).

* cited by examiner pQYN_6669 pQFN, pQFNc

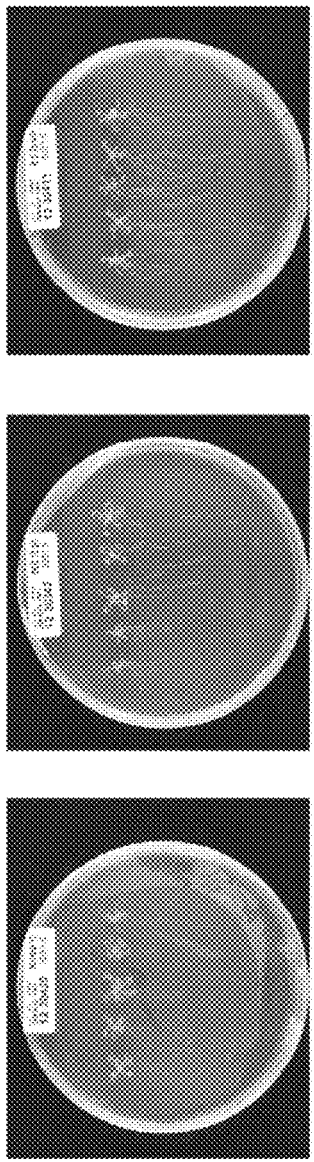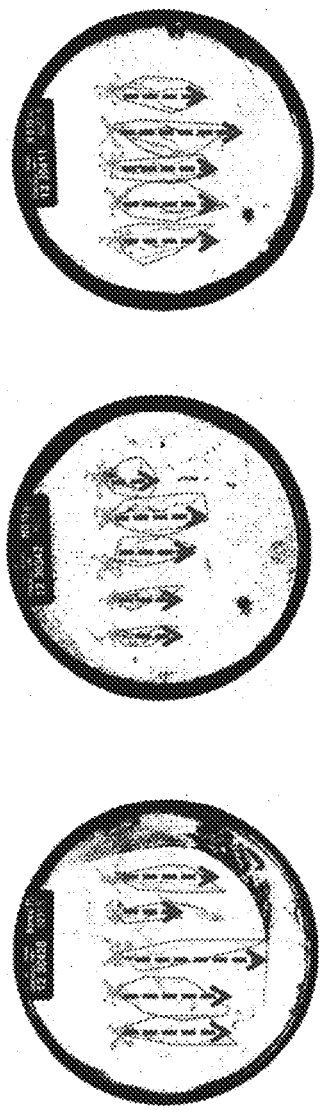

ISOLATED POLYNUCLEOTIDES AND POLYPEPTIDES, AND METHODS OF USING SAME FOR INCREASING NITROGEN USE EFFICIENCY, YIELD, GROWTH RATE, VIGOR, BIOMASS, OIL CONTENT, AND/OR ABIOTIC STRESS TOLERANCE

RELATED APPLICATIONS

This application is a National Phase of PCT Patent Application No. PCT/IL2012/050481 having International filing date of Nov. 27, 2012, which claims the benefit of priority under 35 USC § 119(e) of U.S. Provisional Patent Application Nos. 61/624,431 filed on Apr. 16, 2012 and 61/563,856 filed on Nov. 28, 2011. The contents of the above applications are all incorporated by reference as if fully set forth herein in their entirety.

SEQUENCE LISTING STATEMENT

The ASCII file, entitled 59332SequenceListing.txt, created on May 27, 2014, comprising 13,508,253 bytes, submitted concurrently with the filing of this application is incorporated herein by reference.

FIELD AND BACKGROUND OF THE INVENTION

The present invention, in some embodiments thereof, relates to novel polynucleotides and polypeptides which can increase nitrogen use efficiency, fertilizer use efficiency, yield (e.g., seed/grain yield, oil yield), growth rate, vigor, biomass, oil content, fiber yield, fiber quality and/or length, abiotic stress tolerance and/or water use efficiency of a plant.

A common approach to promote plant growth has been, and continues to be, the use of natural as well as synthetic nutrients (fertilizers). Thus, fertilizers are the fuel behind the "green revolution", directly responsible for the exceptional increase in crop yields during the last 40 years, and are considered the number one overhead expense in agriculture. Of the three macronutrients provided as main fertilizers [Nitrogen (N), Phosphate (P) and Potassium (K)], nitrogen is often the rate-limiting element in plant growth and all field crops have a fundamental dependence on inorganic nitrogenous fertilizer. Nitrogen usually needs to be replenished every year, particularly for cereals, which comprise more than half of the cultivated areas worldwide. For example, inorganic nitrogenous fertilizers such as ammonium nitrate, potassium nitrate, or urea, typically accounts for 40% of the costs associated with crops such as corn and wheat.

Nitrogen is an essential macronutrient for the plant, responsible for biosynthesis of amino and nucleic acids, prosthetic groups, plant hormones, plant chemical defenses, etc. In addition, nitrogen is often the rate-limiting element in plant growth and all field crops have a fundamental dependence on inorganic nitrogen. Thus, nitrogen is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant nitrogen. The stored nitrogen can be then redistributed from the leaves and stalk that served as storage compartments until grain formation.

Since fertilizer is rapidly depleted from most soil types, it must be supplied to growing crops two or three times during the growing season. In addition, the low nitrogen use efficiency (NUE) of the main crops (e.g., in the range of only 30-70%) negatively affects the input expenses for the farmer, due to the excess fertilizer applied. Moreover, the over and inefficient use of fertilizers are major factors responsible for environmental problems such as eutrophication of groundwater, lakes, rivers and seas, nitrate pollution in drinking water which can cause methemoglobinemia, phosphate pollution, atmospheric pollution and the like. However, in spite of the negative impact of fertilizers on the environment, and the limits on fertilizer use, which have been legislated in several countries, the use of fertilizers is expected to increase in order support food and fiber production for rapid population growth on limited land resources. For example, it has been estimated that by 2050, more than 150 million tons of nitrogenous fertilizer will be used worldwide annually.

Increased use efficiency of nitrogen by plants should enable crops to be cultivated with lower fertilizer input, or alternatively to be cultivated on soils of poorer quality and would therefore have significant economic impact in both developed and developing agricultural systems.

Genetic improvement of fertilizer use efficiency (FUE) in plants can be generated either via traditional breeding or via genetic engineering.

Attempts to generate plants with increased FUE have been described in U.S. Pat. Appl. No. 20020046419 to Choo, et al.; U.S. Pat. Appl. No. 2005010879 to Edgerton et al.; U.S. Pat. Appl. No. 20060179511 to Chomet et al.; Good, A, et al. 2007 (Engineering nitrogen use efficiency with alanine aminotransferase. Canadian Journal of Botany 85: 252-262); and Good A G et al. 2004 (Trends Plant Sci. 9:597-605).

Yanagisawa et al. (Proc. Natl. Acad. Sci. U.S.A. 2004 101:7833-8) describe Dof1 transgenic plants which exhibit improved growth under low-nitrogen conditions.

U.S. Pat. No. 6,084,153 to Good et al. discloses the use of a stress responsive promoter to control the expression of Alanine Amine Transferase (AlaAT) and transgenic canola plants with improved drought and nitrogen deficiency tolerance when compared to control plants.

The ever-increasing world population and the decreasing availability in arable land for agriculture affect the yield of plants and plant-related products. The global shortage of water supply, desertification, abiotic stress (ABS) conditions (e.g., salinity, drought, flood, suboptimal temperature and toxic chemical pollution), and/or limited nitrogen and fertilizer sources cause substantial damage to agricultural plants such as major alterations in the plant metabolism, cell death, and decreases in plant growth and crop productivity.

Drought is a gradual phenomenon, which involves periods of abnormally dry weather that persists long enough to produce serious hydrologic imbalances such as crop damage, water supply shortage and increased susceptibility to various diseases.

Salinity, high salt levels, affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Thus, salination of soils that are used for agricultural production is a significant and increasing problem in regions that rely heavily on agriculture, and is worsen by over-utilization, over-fertilization and water shortage, typically caused by climatic change and the demands of increasing population.

Suboptimal temperatures affect plant growth and development through the whole plant life cycle. Thus, low temperatures reduce germination rate and high temperatures result in leaf necrosis. In addition, mature plants that are exposed to excess of heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. Excessive light conditions, which occur under clear atmospheric conditions subsequent to cold late summer/autumn nights, can lead to photoinhibition of photosynthesis (disruption of photosynthesis). In addition, chilling may lead to yield losses and lower product quality through the delayed ripening of maize.

Nutrient deficiencies cause adaptations of the root architecture, particularly notably for example is the root proliferation within nutrient rich patches to increase nutrient uptake. Nutrient deficiencies cause also the activation of plant metabolic pathways which maximize the absorption, assimilation and distribution processes such as by activating architectural changes. Engineering the expression of the triggered genes may cause the plant to exhibit the architectural changes and enhanced metabolism also under other conditions.

In addition, it is widely known that the plants usually respond to water deficiency by creating a deeper root system that allows access to moisture located in deeper soil layers. Triggering this effect will allow the plants to access nutrients and water located in deeper soil horizons particularly those readily dissolved in water like nitrates.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, proteins and oils and metabolites used in industrial processes. The ability to increase plant yield, whether through increase dry matter accumulation rate, modifying cellulose or lignin composition, increase stalk strength, enlarge meristem size, change of plant branching pattern, erectness of leaves, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

WO publication No. 2004/104162 discloses methods of increasing abiotic stress tolerance and/or biomass in plants and plants generated thereby.

WO publication No. 2004/111183 discloses nucleotide sequences for regulating gene expression in plant trichomes and constructs and methods utilizing same.

WO publication No. 2004/081173 discloses novel plant derived regulatory sequences and constructs and methods of using such sequences for directing expression of exogenous polynucleotide sequences in plants.

WO publication No. 2005/121364 discloses polynucleotides and polypeptides involved in plant fiber development and methods of using same for improving fiber quality, yield and/or biomass of a fiber producing plant.

WO publication No. 2007/049275 discloses isolated polypeptides, polynucleotides encoding same, transgenic plants expressing same and methods of using same for increasing fertilizer use efficiency, plant abiotic stress tolerance and biomass.

WO publication No. 2007/020638 discloses methods of increasing abiotic stress tolerance and/or biomass in plants and plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2009/083958 discloses methods of increasing water use efficiency, fertilizer use efficiency, biotic/abiotic stress tolerance, yield and biomass in plant and plants generated thereby.

WO publication No. 2009/141824 discloses isolated polynucleotides and methods using same for increasing plant utility.

WO publication No. 2009/013750 discloses genes, constructs and methods of increasing abiotic stress tolerance, biomass and/or yield in plants generated thereby.

WO publication No. 2010/020941 discloses methods of increasing nitrogen use efficiency, abiotic stress tolerance, yield and biomass in plants and plants generated thereby.

WO publication No. 2010/076756 discloses isolated polynucleotides for increasing abiotic stress tolerance, yield, biomass, growth rate, vigor, oil content, fiber yield, fiber quality, and/or nitrogen use efficiency of a plant.

WO2010/100595 publication discloses isolated polynucleotides and polypeptides, and methods of using same for increasing plant yield and/or agricultural characteristics.

WO publication No. 2010/049897 discloses isolated polynucleotides and polypeptides and methods of using same for increasing plant yield, biomass, growth rate, vigor, oil content, abiotic stress tolerance of plants and nitrogen use efficiency.

WO2010/143138 publication discloses isolated polynucleotides and polypeptides, and methods of using same for increasing nitrogen use efficiency, fertilizer use efficiency, yield, growth rate, vigor, biomass, oil content, abiotic stress tolerance and/or water use efficiency WO publication No. 2011/080674 discloses isolated polynucleotides and polypeptides and methods of using same for increasing plant yield, biomass, growth rate, vigor, oil content, abiotic stress tolerance of plants and nitrogen use efficiency.

WO2011/015985 publication discloses polynucleotides and polypeptides for increasing desirable plant qualities.

WO2011/135527 publication discloses isolated polynucleotides and polypeptides, and methods of using same for increasing plant yield and/or agricultural characteristics.

SUMMARY OF THE INVENTION

According to an aspect of some embodiments of the present invention there is provided a method of increasing nitrogen use efficiency, yield, biomass, growth rate, vigor, oil content, fiber yield, fiber quality, and/or abiotic stress tolerance of a plant, comprising expressing within the plant an exogenous polynucleotide comprising a nucleic acid sequence encoding a polypeptide at least 80% identical to SEQ ID NO: 470-762, 3706-5858, 5860-5910, 5912, 5914-5923, 5925-6046 or 6047, thereby increasing the nitrogen use efficiency, yield, biomass, growth rate, vigor, oil content, fiber yield, fiber quality, and/or abiotic stress tolerance of the plant.

According to an aspect of some embodiments of the present invention there is provided a method of increasing nitrogen use efficiency, yield, biomass, growth rate, vigor, oil content, fiber yield, fiber quality, and/or abiotic stress tolerance of a plant, comprising expressing within the plant an exogenous polynucleotide comprising a nucleic acid sequence encoding a polypeptide selected from the group consisting of SEQ ID NOs: 470-762, 3706-6046 and 6047, thereby increasing the nitrogen use efficiency, yield, biomass, growth rate, vigor, oil content, fiber yield, fiber quality, and/or abiotic stress tolerance of the plant.

According to an aspect of some embodiments of the present invention there is provided a method of increasing nitrogen use efficiency, yield, biomass, growth rate, vigor, oil content, fiber yield, fiber quality, and/or abiotic stress tolerance of a plant, comprising expressing within the plant an exogenous polynucleotide comprising a nucleic acid sequence at least 80% identical to SEQ ID NO: 1-469, 763-3704 or 3705, thereby increasing the nitrogen use efficiency, yield, biomass, growth rate, vigor, oil content, fiber yield, fiber quality, and/or abiotic stress tolerance of the plant.

According to an aspect of some embodiments of the present invention there is provided a method of increasing nitrogen use efficiency, yield, biomass, growth rate, vigor, oil content, fiber yield, fiber quality, and/or abiotic stress tolerance of a plant, comprising expressing within the plant an exogenous polynucleotide comprising the nucleic acid sequence selected from the group consisting of SEQ ID NOs: 1-469, 763-3704 and 3705, thereby increasing the nitrogen use efficiency, yield, biomass, growth rate, vigor, oil content, fiber yield, fiber quality, and/or abiotic stress tolerance of the plant.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO: 470-762, 3706-5858, 5860-5910, 5912, 5914-5923, 5925-6046 or 6047, wherein the amino acid sequence is capable of increasing nitrogen use efficiency, yield, biomass, growth rate, vigor, oil content, fiber yield, fiber quality, and/or abiotic stress tolerance of a plant.

According to an aspect of some embodiments of the present invention there is provided an isolated polynucleotide comprising a nucleic acid sequence encoding a polypeptide which comprises the amino acid sequence selected from the group consisting of SEQ ID NOs: 470-762, 3706-6046 and 6047.

According to an aspect of some embodiments of the present invention there is provided an isolated polynucleotide comprising a nucleic acid sequence at least 80% identical to SEQ ID NO: 1-469, 763-3704 or 3705, wherein the nucleic acid sequence is capable of increasing nitrogen use efficiency, yield, biomass, growth rate, vigor, oil content, fiber yield, fiber quality, and/or abiotic stress tolerance of a plant.

According to an aspect of some embodiments of the present invention there is provided an isolated polynucleotide comprising the nucleic acid sequence selected from the group consisting of SEQ ID NOs: 1-469, 763-3704 and 3705.

According to an aspect of some embodiments of the present invention there is provided a nucleic acid construct comprising the isolated polynucleotide of some embodiments of the invention, and a promoter for directing transcription of the nucleic acid sequence in a host cell.

According to an aspect of some embodiments of the present invention there is provided an isolated polypeptide comprising an amino acid sequence at least 80% homologous to SEQ ID NO: 470-762, 3706-5858, 5860-5910, 5912, 5914-5923, 5925-6046 or 6047, wherein the amino acid sequence is capable of increasing nitrogen use efficiency, yield, biomass, growth rate, vigor, oil content, fiber yield, fiber quality, and/or abiotic stress tolerance of a plant.

According to an aspect of some embodiments of the present invention there is provided an isolated polypeptide comprising the amino acid sequence selected from the group consisting of SEQ ID NOs: 470-762, 3706-6046 and 6047.

According to an aspect of some embodiments of the present invention there is provided a plant cell exogenously expressing the polynucleotide of some embodiments of the invention, or the nucleic acid construct of some embodiments of the invention.

According to an aspect of some embodiments of the present invention there is provided a plant cell exogenously expressing the polypeptide of some embodiments of the invention.

According to some embodiments of the invention, the nucleic acid sequence encodes an amino acid sequence selected from the group consisting of SEQ ID NOs: 470-762, 3706-6046 and 6047.

According to some embodiments of the invention, the nucleic acid sequence is selected from the group consisting of SEQ ID NOs: 1-469, 763-3704 and 3705.

According to some embodiments of the invention, the polynucleotide consists of the nucleic acid sequence selected from the group consisting of SEQ ID NOs: 1-469, 763-3704 and 3705.

According to some embodiments of the invention, the nucleic acid sequence encodes the amino acid sequence selected from the group consisting of SEQ ID NOs: 470-762, 3706-6046 and 6047.

According to some embodiments of the invention, the plant cell forms part of a plant.

According to some embodiments of the invention, the method further comprising growing the plant expressing the exogenous polynucleotide under the abiotic stress.

According to some embodiments of the invention, the abiotic stress is selected from the group consisting of: salinity, osmotic stress, drought, water deprivation, flood, etiolation, low temperature, high temperature, heavy metal toxicity, anaerobiosis, nutrient deficiency, nutrient excess, atmospheric pollution and UV irradiation.

According to some embodiments of the invention, the yield comprises seed yield or oil yield.

According to an aspect of some embodiments of the present invention there is provided a transgenic plant comprising the nucleic acid construct of some embodiments of the invention.

According to some embodiments of the invention, the method further comprising growing the plant expressing the exogenous polynucleotide under nitrogen-limiting conditions.

According to some embodiments of the invention, the promoter is heterologous to the isolated polynucleotide.

According to some embodiments of the invention, the promoter is heterologous to the host cell.

According to an aspect of some embodiments of the present invention there is provided a method of growing a crop, the method comprising seeding seeds and/or planting plantlets of a plant transformed with the isolated polynucleotide of some embodiments of the invention, or the nucleic acid construct of some embodiments of the invention, wherein the plant is derived from plants selected for at least one trait selected from the group consisting of: increased nitrogen use efficiency, increased abiotic stress tolerance, increased biomass, increased growth rate, increased vigor, increased yield and increased fiber yield or quality, and increased oil content as compared to a non-transformed plant, thereby growing the crop.

According to some embodiments of the invention, the non-transformed plant is a wild type plant of identical genetic background.

According to some embodiments of the invention, the non-transformed plant is a wild type plant of the same species.

According to some embodiments of the invention, the non-transformed plant is grown under identical growth conditions.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG; FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

DESCRIPTION OF SPECIFIC EMBODIMENTS OF THE INVENTION

Figure 1:
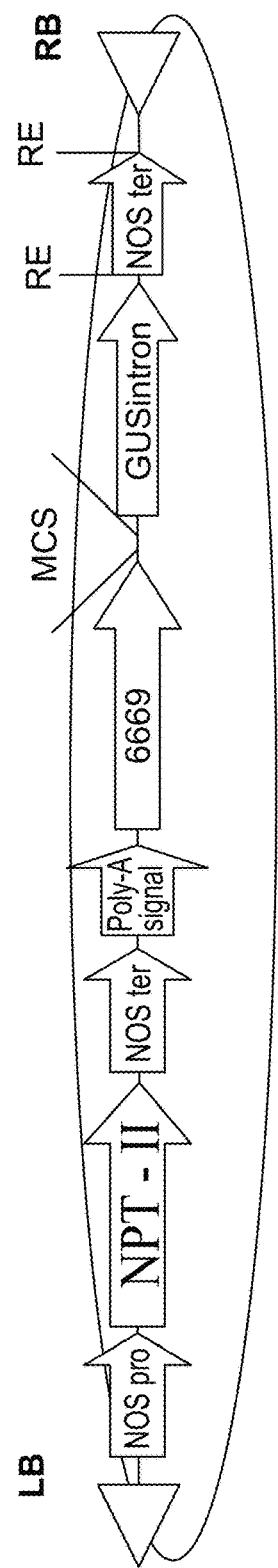
FIG. 1 is a schematic illustration of the modified pGI binary plasmid containing the new At6669 promoter (SEQ ID NO: 6052) and the GUSintron (pQYN_6669) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the vector while replacing the GUS-intron reporter gene.
Figure 2:
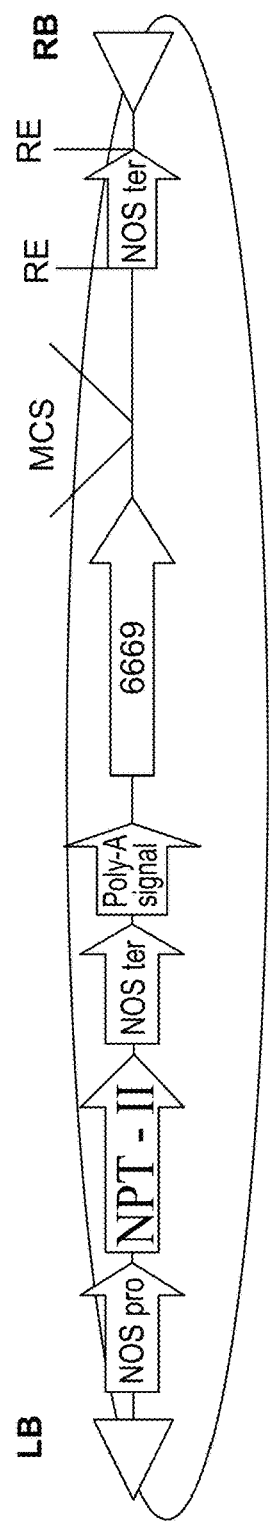
FIG. 2 is a schematic illustration of the modified pGI binary plasmid containing the new At6669 promoter (SEQ ID NO:6052) (pQFN or pQFNc) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); The isolated polynucleotide sequences of the invention were cloned into the MCS of the vector.
Figure 4:
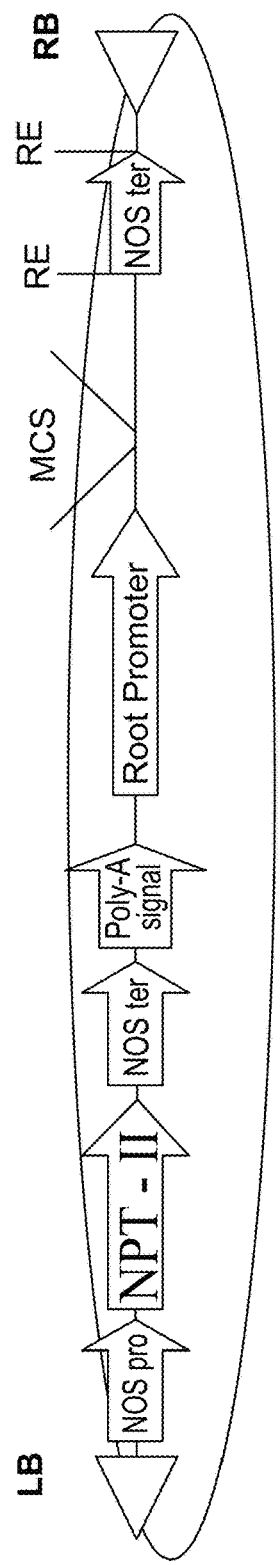
FIG. 4 is a schematic illustration of the modified pGI binary plasmid containing the Root Promoter (pQNa_RP; SEQ ID NO: 6064) used for expressing the isolated polynucleotide sequences of the invention. RB—T-DNA right border; LB—T-DNA left border; NOS pro=nopaline synthase promoter; NPT-II=neomycin phosphotransferase gene; NOS ter=nopaline synthase terminator; Poly-A signal (polyadenylation signal); MCS (Multiple cloning site) of the vector used for cloning the isolated polynucleotide sequences according to some embodiments of the invention.
Figure 5:
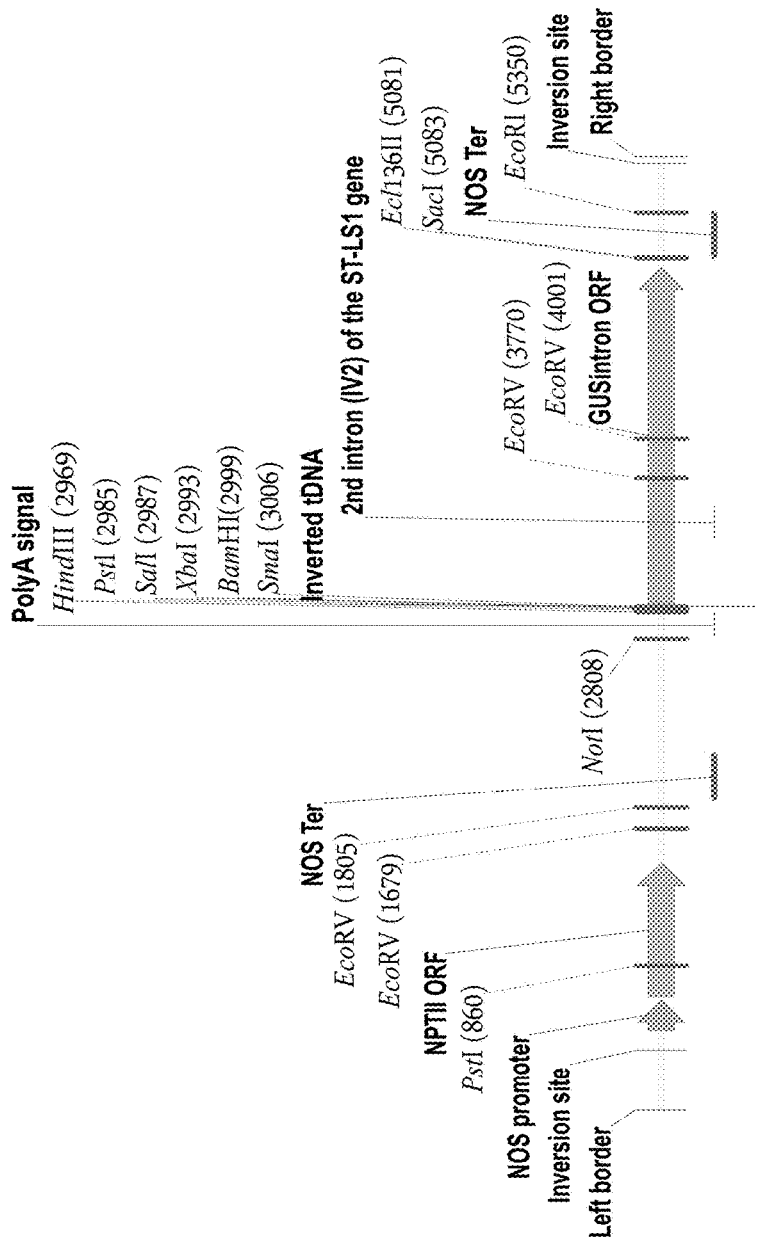
FIG. 5 is a schematic illustration of the pQYN plasmid.
Figure 6:
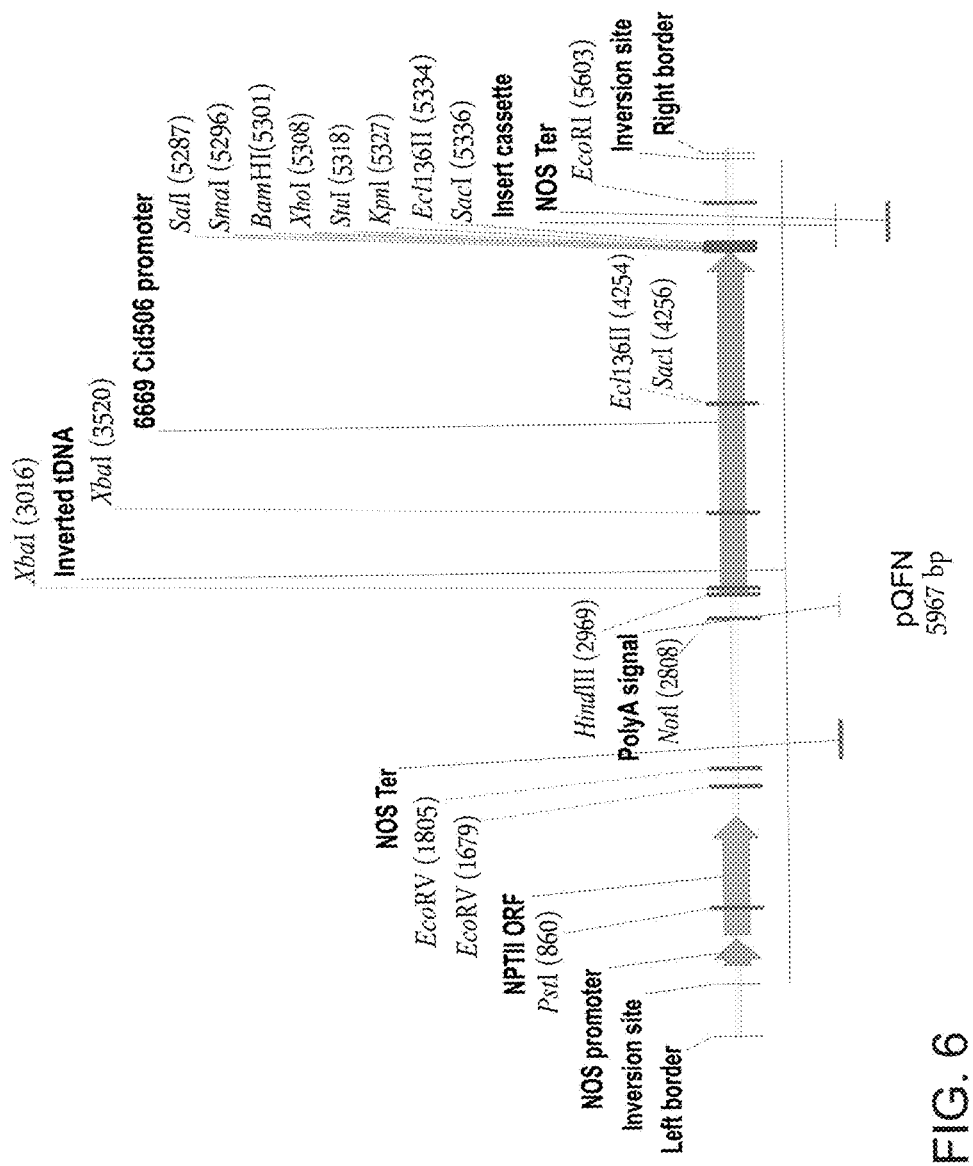
FIG. 6 is a schematic illustration of the pQFN plasmid.
Figure 7:
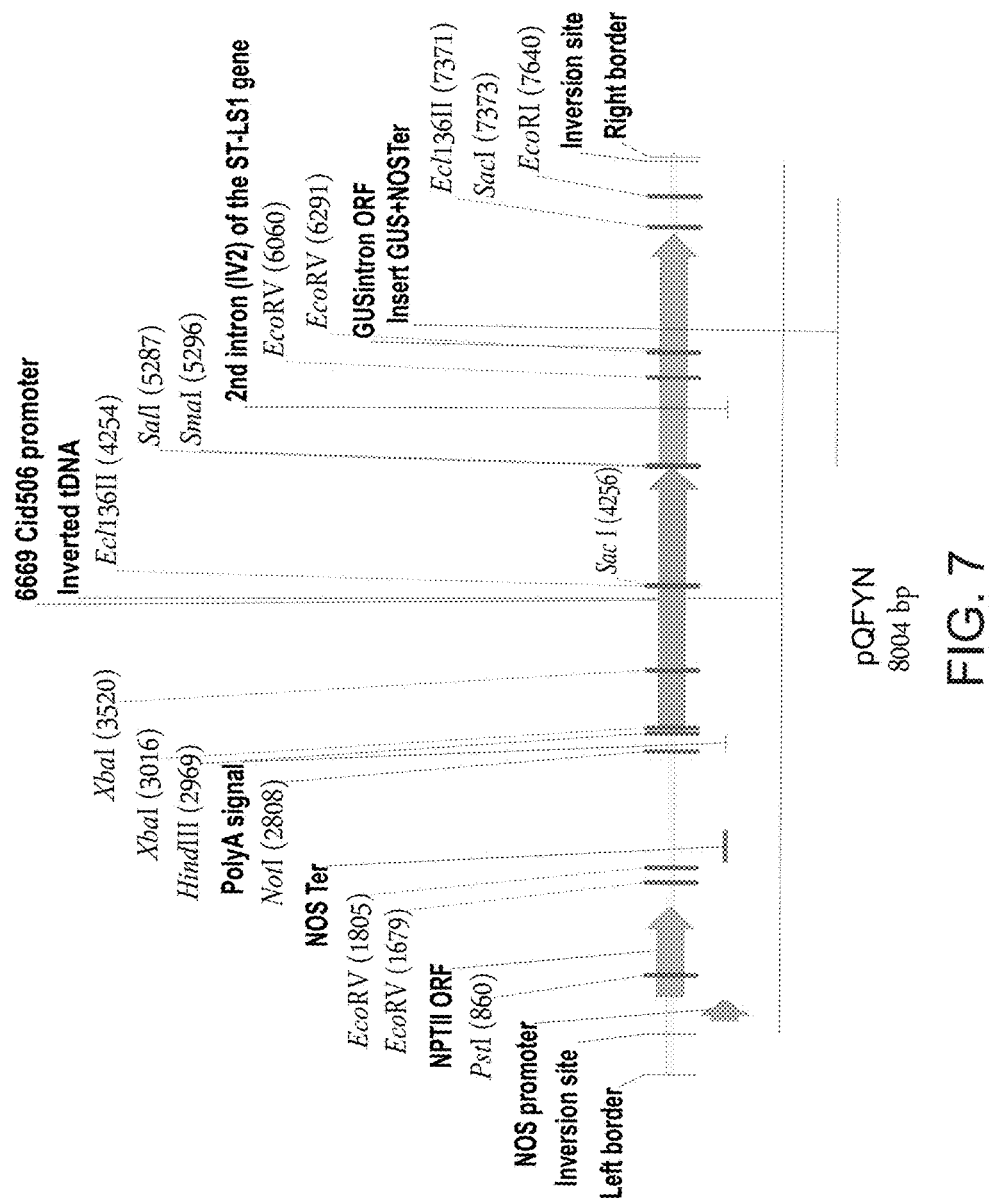
FIG. 7 is a schematic illustration of the pQFYN plasmid.
Figure 8:
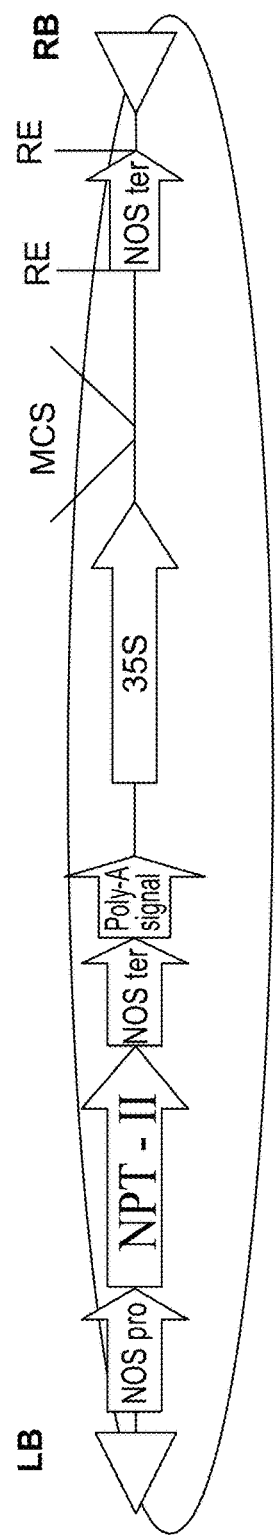
FIG. 8 is a schematic illustration of pQXNc plasmid, which is a modified pGI binary plasmid used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; RE=any restriction enzyme; Poly-A signal (polyadenylation signal); 35S—the 35S promoter (pqfnc; SEQ ID NO:6048). The isolated polynucleotide sequences of some embodiments of the invention were cloned into the MCS (Multiple cloning site) of the vector.

The present invention, in some embodiments thereof, relates to novel polynucleotides and polypeptides, nucleic acid constructs comprising same, host cells expressing same, transgenic plants exogenously expressing same and, more particularly, but not exclusively, to methods of using same for increasing nitrogen use efficiency, fertilizer use efficiency, yield, growth rate, vigor, biomass, oil content, fiber yield, fiber quality, fiber length, abiotic stress tolerance and/or water use efficiency of a plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have identified novel polypeptides and polynucleotides which can be used to generate nucleic acid constructs, transgenic plants and to increase nitrogen use efficiency, fertilizer use efficiency, yield, growth rate, vigor, biomass, oil content, fiber yield, fiber quality, fiber length, abiotic stress tolerance and/or water use efficiency of a plant.

Thus, as shown in the Examples section which follows, the present inventors have utilized bioinformatics tools to identify polynucleotides and polypeptides which enhance nitrogen use efficiency, fertilizer use efficiency, yield (e.g., seed yield, oil yield), growth rate, vigor, biomass, oil content, fiber development (e.g., fiber yield, quality and/or length), abiotic stress tolerance and/or water use efficiency of a plant. Genes which affect the trait-of-interest were identified (Table 1, Example 1) based on expression profiles of genes of several *Arabidopsis*, cotton, Rice, *Sorghum*, Barley, Maize and Tomato ecotypes and tissues (Tables 3-64; Examples 3-14) and homology with genes known to affect the trait-of-interest and using digital expression profiles in specific tissues and conditions. Homologous (e.g., orthologous) polypeptides and polynucleotides having the same function were also identified (Table 2, Example 2). Transgenic plants over-expressing the identified polynucleotides were found to exhibit increased biomass (e.g., increased dry and fresh weight, increased leaf blade area, increased leaf number, increased rosette area and diameter, increased root coverage and root length), increased yield (e.g., increased seed yield, harvest index, and 1000 seed weight), increased vigor, e.g., increased growth rate (e.g., growth rate of leaf area, root coverage, root length, leaf number, rosette area and diameter), early flowering and inflorescence immergence under both optimal (normal) growth conditions, and under nitrogen limiting growth conditions (e.g., abiotic stress condition such as nutrient deficiency stress) (Tables 66-93; Examples 18-20). Altogether, these results suggest the use of the novel polynucleotides and polypeptides of the invention for increasing nitrogen use efficiency, fertilizer use efficiency, yield (e.g., seed yield, oil yield), growth rate, vigor, biomass, oil content, fiber yield, fiber quality, fiber length, abiotic stress tolerance and/or water use efficiency of a plant.

Thus, according to an aspect of some embodiments of the invention, there is provided method of increasing fertilizer use efficiency (e.g., nitrogen use efficiency), oil content, yield, growth rate, biomass, vigor, fiber yield, fiber quality, and/or abiotic stress tolerance of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 470-762, 3706-5858, 5860-5910, 5912, 5914-5923, 5925-6046 and 6047, thereby increasing the fertilizer use efficiency (e.g., nitrogen use efficiency), oil content, yield, growth rate, biomass, vigor, fiber yield, fiber quality, and/or abiotic stress tolerance of the plant.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ/tissue size per time (can be measured in $cm^2$ per day).

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand.

Improving early vigor is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigor. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (*Zea mays* L.) hybrids based on Corn Belt germplasm in the European Atlantic.

It should be noted that a plant yield can be determined under stress (e.g., abiotic stress, nitrogen-limiting conditions) and/or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency, atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. Zhu (2002) Ann. Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The *Arabidopsis* rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In Mesembryanthemum crystallinum (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

It should be noted that improved ABST will confer plants with improved vigor also under non-stress conditions, resulting in crops having improved biomass and/or yield e.g., elongated fibers for the cotton industry, higher oil content.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (Kapok, *Ceiba pentandra*), desert willow, creosote bush, winterfat, balsa, kenaf, roselle, jute, sisal abaca, flax, corn, sugar cane, hemp, ramie, kapok, coir, bamboo, spanish moss and *Agave* spp. (e.g. sisal).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow.

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in fertilizer use efficiency (e.g., nitrogen use efficiency), oil content, yield, growth rate, biomass, vigor, fiber yield, fiber quality, and/or abiotic stress tolerance of a plant as compared to a native plant or a wild type plant [i.e., a plant not modified with the biomolecules (polynucleotide or polypeptides) of the invention, e.g., a non-transformed plant of the same species which is grown under the same (e.g., identical) growth conditions].

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant (e.g., a nucleic acid sequence from a different species) or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention, the exogenous polynucleotide of the invention comprises a nucleic acid sequence encoding a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 470-762, 3706-5858, 5860-5910, 5912, 5914-5923, 5925-6046 and 6047.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal blast search. This may be done by a first blast involving blasting the sequence-of-interest against any sequence database, such as the publicly available NCBI database which may be found at: Hypertext Transfer Protocol://World Wide Web (dot) ncbi (dot) nlm (dot) nih (dot) gov. If orthologues in rice were sought, the sequence-of-interest would be blasted against, for example, the 28,469 full-length cDNA clones from *Oryza sativa* Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web (dot) ebi (dot) ac (dot) uk/Tools/clustalw2/index (dot) html], followed by a neighbor-joining tree (Hypertext Transfer Protocol://en (dot) wikipedia (dot) org/wiki/Neighbor-joining) which helps visualizing the clustering.

Homology (e.g., percent homology, identity+similarity) can be determined using any homology comparison software computing a pairwise sequence alignment.

Identity (e.g., percent homology) can be determined using any homology comparison software, including for example, the BlastN or the BlastP software of the National Center of Biotechnology Information (NCBI) such as by using default parameters.

According to some embodiments of the invention, the identity is a global identity, i.e., an identity over the entire amino acid or nucleic acid sequences of the invention and not over portions thereof.

According to some embodiments of the invention, the term "homology" or "homologous" refers to identity of two or more nucleic acid sequences; or identity of two or more amino acid sequences; or the identity of an amino acid sequence to one or more nucleic acid sequence encoding same.

According to some embodiments of the invention, the homology is a global homology, i.e., a homology over the entire amino acid or nucleic acid sequences of the invention and not over portions thereof.

The degree of homology or identity between two or more sequences can be determined using various known sequence comparison tools. Following is a non-limiting description of such tools which can be used along with some embodiments of the invention.

Pairwise global alignment was defined by S. B. Needleman and C. D. Wunsch, "A general method applicable to the search of similarities in the amino acid sequence of two proteins" Journal of Molecular Biology, 1970, pages 443-53, volume 48).

For example, when starting from a polypeptide sequence and comparing to other polypeptide sequences, the EMBOSS-6.0.1 Needleman-Wunsch algorithm (available from http://emboss(dot)sourceforge(dot)net/apps/cvs/emboss/apps/needle(dot)html) can be used to find the optimum alignment (including gaps) of two sequences along their entire length—a "Global alignment". Default parameters for Needleman-Wunsch algorithm (EMBOSS-6.0.1) include: gapopen=10; gapextend=0.5; datafile=EBLOSUM62; brief=YES.

According to some embodiments of the invention, the parameters used with the EMBOSS-6.0.1 tool (for protein-protein comparison) include: gapopen=8; gapextend=2; datafile=EBLOSUM62; brief=YES.

According to some embodiments of the invention, the threshold used to determine homology using the EMBOSS-6.0.1 Needleman-Wunsch algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting from a polypeptide sequence and comparing to polynucleotide sequences, the OneModel FramePlus algorithm (Halperin, E., Faigler, S. and Gill-More, R. (1999)—FramePlus: aligning DNA to protein sequences. Bioinformatics, 15, 867-873) (available from http://www(dot)biocceleration(dot)com/Products(dot)html) can be used with following default parameters: model=frame+_p2n.model mode=local.

According to some embodiments of the invention, the parameters used with the OneModel FramePlus algorithm are model=frame+_p2n.model, mode=qglobal.

According to some embodiments of the invention, the threshold used to determine homology using the OneModel FramePlus algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting with a polynucleotide sequence and comparing to other polynucleotide sequences the EMBOSS-6.0.1 Needleman-Wunsch algorithm (available from http://emboss(dot)sourceforge(dot)net/apps/cvs/emboss/apps/needle(dot)html) can be used with the following default parameters: (EMBOSS-6.0.1) gapopen=10; gapextend=0.5; datafile=EDNAFULL; brief=YES.

According to some embodiments of the invention, the parameters used with the EMBOSS-6.0.1 Needleman-Wunsch algorithm are gapopen=10; gapextend=0.2; datafile=EDNAFULL; brief=YES.

According to some embodiments of the invention, the threshold used to determine homology using the EMBOSS-6.0.1 Needleman-Wunsch algorithm for comparison of polynucleotides with polynucleotides is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiment, determination of the degree of homology further requires employing the Smith-Waterman algorithm (for protein-protein comparison or nucleotide-nucleotide comparison).

Default parameters for GenCore 6.0 Smith-Waterman algorithm include: model=sw.model.

According to some embodiments of the invention, the threshold used to determine homology using the Smith-Waterman algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiments of the invention, the global homology is performed on sequences which are pre-selected by local homology to the polypeptide or polynucleotide of interest (e.g., 60% identity over 60% of the sequence length), prior to performing the global homology to the polypeptide or polynucleotide of interest (e.g., 80% global homology on the entire sequence). For example, homologous sequences are selected using the BLAST software with the Blastp and tBlastn algorithms as filters for the first stage, and the needle (EMBOSS package) or Frame+ algorithm alignment for the second stage. Local identity (Blast alignments) is defined with a very permissive cut-off—60% Identity on a span of 60% of the sequences lengths because it use as only a filter for the global alignment stage. The default filtering of the Blast package was not utilized (by setting the parameter "-F F").

In the second stage, homologs are defined based on a global identity of at least 80% to the core gene polypeptide sequence.

According to some embodiments of the invention, two distinct forms for finding the optimal global alignment for protein or nucleotide sequences are used:

1. Between Two Proteins (Following the Blastp Filter): EMBOSS-6.0.1 Needleman-Wunsch algorithm with the following modified parameters: gapopen=8 gapextend=2. The rest of the parameters are unchanged from the default options listed here:

| Standard (Mandatory) qualifiers: | | |
|---|---|---|
| [-asequence] | sequence | Sequence filename and optional format, or reference (input USA) |
| [-bsequence] | seqall | Sequence(s) filename and optional format, or reference (input USA) |
| -gapopen | float | [10.0 for any sequence] The gap open penalty is the score taken away when a gap is created. The best value depends on the choice of comparison matrix. The default value assumes you are using the EBLOSUM62 matrix for protein sequences, and the EDNAFULL matrix for nucleotide sequences. (Floating point number from 1.0 to 100.0) |
| -gapextend | float | [0.5 for any sequence] The gap extension, penalty is added to the standard gap penalty for each base or residue in the gap. This is how long gaps are penalized. Usually you will expect a few long gaps rather than many short gaps, so the gap extension penalty should be lower than the gap penalty. An exception is where one or both sequences are single reads with possible sequencing errors in which case you would expect many single base gaps. You can get this result by setting the gap open penalty to zero (or very low) and using the gap extension penalty to control gap scoring. (Floating point number from 0.0 to 10.0) |
| [-outfile] | align | [*.needle] Output alignment file name |
| Additional (Optional) qualifiers: | | |
| -datafile | matrixf | [EBLOSUM62 for protein, EDNAFULL for DNA] This is the scoring matrix file used when comparing sequences. By default it is the file 'EBLOSUM62' (for proteins) or the file 'EDNAFULL' (for nucleic sequences). These files are found in the 'data' directory of the EMBOSS installation. |
| Advanced (Unprompted) qualifiers: | | |
| -[no]brief | boolean | [Y] Brief identity and similarity |

Associated Qualifiers:

| "-asequence" associated qualifiers | | |
|---|---|---|
| -sbegin1 | integer | Start of the sequence to be used |
| -send1 | integer | End of the sequence to be used |
| -sreverse1 | boolean | Reverse (if DNA) |
| -sask1 | boolean | Ask for begin/end/reverse |
| -snucleotide1 | boolean | Sequence is nucleotide |
| -sprotein1 | boolean | Sequence is protein |
| -slower1 | boolean | Make lower case |
| -supper1 | boolean | Make upper case |

| | | -continued |
|---|---|---|
| -sformat1 | string | Input sequence format |
| -sdbname1 | string | Database name |
| -sid1 | string | Entryname |
| -ufo1 | string | UFO features |
| -fformat1 | string | Features format |
| -fopenfile1 | string | Features file name |
| "-bsequence" associated qualifiers | | |
| -sbegin2 | integer | Start of each sequence to be used |
| -send2 | integer | End of each sequence to be used |
| -sreverse2 | boolean | Reverse (if DNA) |
| -sask2 | boolean | Ask for begin/end/reverse |
| -snucleotide2 | boolean | Sequence is nucleotide |
| -sprotein2 | boolean | Sequence is protein |
| -slower2 | boolean | Make lower case |
| -supper2 | boolean | Make upper case |
| -sformat2 | string | Input sequence format |
| -sdbname2 | string | Database name |
| -sid2 | string | Entryname |
| -ufo2 | string | UFO features |
| -fformat2 | string | Features format |
| -fopenfile2 | string | Features file name |
| "-outfile" associated qualifiers | | |
| -aformat3 | string | Alignment format |
| -aextension3 | string | File name extension |
| -adirectory3 | string | Output directory |
| -aname3 | string | Base file name |
| -awidth3 | integer | Alignment width |
| -aaccshow3 | boolean | Show accession number in the header |
| -adesshow3 | boolean | Show description in the header |
| -ausashow3 | boolean | Show the full USA in the alignment |
| -aglobal3 | boolean | Show the full sequence in alignment |
| General qualifiers: | | |
| -auto | boolean | Turn off prompts |
| -stdout | boolean | Write first file to standard output |
| -filter | boolean | Read first file from standard input, write first file to standard output |
| -options | boolean | Prompt for standard and additional values |
| -debug | boolean | Write debug output to program.dbg |
| -verbose | boolean | Report some/full command line options |
| -help | boolean | Report command line options. More information on associated and general qualifiers can be found with -help -verbose |
| -warning | boolean | Report warnings |
| -error | boolean | Report errors |
| -fatal | boolean | Report fatal errors |
| -die | boolean | Report dying program messages |

2. Between a Protein Sequence and a Nucleotide Sequence (Following the Tblastn Filter):

GenCore 6.0 OneModel application utilizing the Frame+ algorithm with the following parameters: model=frame+_p2n.model mode=qglobal -q=protein.sequence -db=nucleotide.sequence. The rest of the parameters are unchanged from the default options:

Usage:

om -model=<model_fname>[-q=]query [-db=]database [options]

-model=<model_fname> Specifies the model that you want to run. All models supplied by Compugen are located in the directory $CGNROOT/models/.

Valid command line parameters:

-dev=<dev_name> Selects the device to be used by the application.

Valid devices are:

bic—Bioccelerator (valid for SW, XSW, FRAME_N2P, and FRAME_P2N models).

xlg—BioXL/G (valid for all models except XSW).

xlp—BioXL/P (valid for SW, FRAME+_N2P, and FRAME_P2N models).

xlh—BioXL/H (valid for SW, FRAME+_N2P, and FRAME_P2N models).

soft—Software device (for all models).

-q=<query> Defines the query set. The query can be a sequence file or a database reference. You can specify a query by its name or by accession number. The format is detected automatically. However, you may specify a format using the -qfmt parameter. If you do not specify a query, the program prompts for one. If the query set is a database reference, an output file is produced for each sequence in the query.

-db=<database name> Chooses the database set. The database set can be a sequence file or a database reference. The database format is detected automatically. However, you may specify a format using -dfmt parameter.

-qacc Add this parameter to the command line if you specify a query using accession numbers.

-dacc Add this parameter to the command line if you specify a database using accession numbers.

-dfmt/-qfmt=<format_type> Chooses the database/query format type. Possible formats are:
fasta—fasta with seq type auto-detected.
fastap—fasta protein seq.
fastan—fasta nucleic seq.
gcg—gcg format, type is auto-detected.
gcg9seq—gcg9 format, type is auto-detected.
gcg9seqp—gcg9 format protein seq.
gcg9seqn—gcg9 format nucleic seq.
nbrf—nbrf seq, type is auto-detected.
nbrfp—nbrf protein seq.
nbrfn—nbrf nucleic seq.
embl—embl and swissprot format.
genbank—genbank format (nucleic).
blast—blast format.
nbrf gcg—nbrf-gcg seq, type is auto-detected.
nbrf gcgp—nbrf-gcg protein seq.
nbrf gcgn—nbrf-gcg nucleic seq.
raw—raw ascii sequence, type is auto-detected.
rawp—raw ascii protein sequence.
rawn—raw ascii nucleic sequence.
pir—pir codata format, type is auto-detected.
profile—gcg profile (valid only for -qfmt in SW, XSW, FRAME_P2N, and FRAME+_P2N).

-out=<out_fname> The name of the output file.

-suffix=<name> The output file name suffix.

-gapop=<n> Gap open penalty. This parameter is not valid for FRAME+. For FrameSearch the default is 12.0. For other searches the default is 10.0.

-gapext=<n> Gap extend penalty. This parameter is not valid for FRAME+. For FrameSearch the default is 4.0. For other models: the default for protein searches is 0.05, and the default for nucleic searches is 1.0.

-qgapop=<n> The penalty for opening a gap in the query sequence. The default is 10.0. Valid for XSW.

-qgapext=<n> The penalty for extending a gap in the query sequence. The default is 0.05. Valid for XSW.

-start=<n> The position in the query sequence to begin the search.

-end=<n> The position in the query sequence to stop the search.

-qtrans Performs a translated search, relevant for a nucleic query against a protein database. The nucleic query is translated to six reading frames and a result is given for each frame. Valid for SW and XSW.

-dtrans Performs a translated search, relevant for a protein query against a DNA database. Each database entry is translated to six reading frames and a result is given for each frame. Valid for SW and XSW.

Note: "-qtrans" and "-dtrans" options are mutually exclusive.

-matrix=<matrix_file> Specifies the comparison matrix to be used in the search. The matrix must be in the BLAST format. If the matrix file is not located in $CGNROOT/tables/matrix, specify the full path as the value of the -matrix parameter.

-trans=<transtab_name> Translation table. The default location for the table is $CGNROOT/tables/trans.

-onestrand Restricts the search to just the top strand of the query/database nucleic sequence.

-list=<n> The maximum size of the output hit list. The default is 50.

-docalign=<n> The number of documentation lines preceding each alignment. The default is 10.

-thr_score=<score_name> The score that places limits on the display of results. Scores that are smaller than -thr_min value or larger than -thr_max value are not shown. Valid options are:
quality.
zscore.
escore.

-thr_max=<n> The score upper threshold. Results that are larger than -thr_max value are not shown.

-thr_min=<n> The score lower threshold. Results that are lower than -thr_min value are not shown.

-align=<n> The number of alignments reported in the output file.

-noalign Do not display alignment.

Note: "-align" and "-noalign" parameters are mutually exclusive.

-outfmt=<format_name> Specifies the output format type. The default format is PFS. Possible values are:
PFS—PFS text format
FASTA—FASTA text format
BLAST—BLAST text format -nonorm Do not perform score normalization.

-norm=<norm_name> Specifies the normalization method. Valid options are:
log—logarithm normalization.
std—standard normalization.
stat—Pearson statistical method.

Note: "-nonorm" and "-norm" parameters cannot be used together.

Note: Parameters -xgapop, -xgapext, -fgapop, -fgapext, -ygapop, -ygapext, -delop, and -delext apply only to FRAME+.

-xgapop=<n> The penalty for opening a gap when inserting a codon (triplet). The default is 12.0.

-xgapext=<n> The penalty for extending a gap when inserting a codon (triplet). The default is 4.0.

-ygapop=<n> The penalty for opening a gap when deleting an amino acid. The default is 12.0.

-ygapext=<n> The penalty for extending a gap when deleting an amino acid. The default is 4.0.

-fgapop=<n> The penalty for opening a gap when inserting a DNA base. The default is 6.0.

-fgapext=<n> The penalty for extending a gap when inserting a DNA base. The default is 7.0.

-delop=<n> The penalty for opening a gap when deleting a DNA base. The default is 6.0.

-delext=<n> The penalty for extending a gap when deleting a DNA base. The default is 7.0.

-silent No screen output is produced.

-host=<host_name> The name of the host on which the server runs. By default, the application uses the host specified in the file $CGNROOT/cgnhosts.

-wait Do not go to the background when the device is busy. This option is not relevant for the Parseq or Soft pseudo device.
-batch Run the job in the background. When this option is specified, the file "$CGNROOT/defaults/batch.defaults" is used for choosing the batch command. If this file does not exist, the command "at now" is used to run the job.
Note: "-batch" and "-wait" parameters are mutually exclusive.
-version Prints the software version number.
-help Displays this help message. To get more specific help type: "om -model=<model_fname>-help".

According to some embodiments the homology is a local homology or local identity.

Local alignments tools include, but are not limited to the BlastP, BlastN, BlastX or TBLASTN software of the National Center of Biotechnology Information (NCBI), FASTA, and the Smith-Waterman algorithm.

A tblastn search allows the comparison between a protein sequence and the six-frame translations of a nucleotide database. It can be a very productive way of finding homologous protein coding regions in unannotated nucleotide sequences such as expressed sequence tags (ESTs) and draft genome records (HTG), located in the BLAST databases est and htgs, respectively.

Default parameters for blastp include: Max target sequences: 100; Expected threshold: $e^{-5}$; Word size: 3; Max matches in a query range: 0; Scoring parameters: Matrix—BLOSUM62; filters and masking: Filter—low complexity regions.

Local alignments tools, which can be used include, but are not limited to, the tBLASTX algorithm, which compares the six-frame conceptual translation products of a nucleotide query sequence (both strands) against a protein sequence database. Default parameters include: Max target sequences: 100; Expected threshold: 10; Word size: 3; Max matches in a query range: 0; Scoring parameters: Matrix—BLOSUM62; filters and masking: Filter—low complexity regions.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:470-762, 3706-5858, 5860-5910, 5912, 5914-5923, 5925-6046 and 6047.

According to some embodiments of the invention, the method of increasing fertilizer use efficiency (e.g., nitrogen use efficiency), oil content, yield, growth rate, biomass, vigor, fiber yield, fiber quality, and/or abiotic stress tolerance of a plant, is effected by expressing within the plant an exogenous polynucleotide comprising a nucleic acid sequence encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:470-762, 3706-5858, 5860-5910, 5912, 5914-5923, 5925-6046 and 6047, thereby increasing the fertilizer use efficiency (e.g., nitrogen use efficiency), oil content, yield, growth rate, biomass, vigor, fiber yield, fiber quality, and/or abiotic stress tolerance of the plant.

According to some embodiments of the invention, the exogenous polynucleotide encodes a polypeptide consisting of the amino acid sequence set forth by SEQ ID NO:470-762, 3706-6046 or 6047.

According to an aspect of some embodiments of the invention, the method of increasing fertilizer use efficiency (e.g., nitrogen use efficiency), oil content, yield, growth rate, biomass, vigor, fiber yield, fiber quality, and/or abiotic stress tolerance of a plant is effected by expressing within the plant an exogenous polynucleotide comprising a nucleic acid sequence encoding a polypeptide comprising an amino acid sequence selected from the group consisting of SEQ ID NOs:470-762, 3706-6046 and 6047, thereby increasing the fertilizer use efficiency (e.g., nitrogen use efficiency), oil content, yield, growth rate, biomass, vigor, fiber yield, fiber quality, and/or abiotic stress tolerance of the plant.

According to an aspect of some embodiments of the invention, there is provided a method of increasing fertilizer use efficiency (e.g., nitrogen use efficiency), oil content, yield, growth rate, biomass, vigor, fiber yield, fiber quality, and/or abiotic stress tolerance of a plant, comprising expressing within the plant an exogenous polynucleotide comprising a nucleic acid sequence encoding a polypeptide selected from the group consisting of SEQ ID NOs: 470-762, 3706-6046 and 6047, thereby increasing the fertilizer use efficiency (e.g., nitrogen use efficiency), oil content, yield, growth rate, biomass, vigor, fiber yield, fiber quality, and/or abiotic stress tolerance of the plant.

According to some embodiments of the invention, the exogenous polynucleotide encodes a polypeptide consisting of the amino acid sequence set forth by SEQ ID NO: 470-762, 3706-6046 and 6047.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-469, 763-3704 and 3705.

According to an aspect of some embodiments of the invention, there is provided a method of increasing fertilizer use efficiency (e.g., nitrogen use efficiency), oil content, yield, growth rate, biomass, vigor, fiber yield, fiber quality, and/or abiotic stress tolerance of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-469, 763-3704 and 3705, thereby increasing the fertilizer use efficiency (e.g., nitrogen use efficiency), oil content, yield, growth rate, biomass, vigor, fiber yield, fiber quality, and/or abiotic stress tolerance of the plant.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1-469, 763-3704 and 3705.

According to some embodiments of the invention the exogenous polynucleotide is set forth by SEQ ID NO:1-469, 763-3704 or 3705.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N[(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (Hypertext Transfer Protocol://World Wide Web (dot) kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively affect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in SEQ ID NOs:215, 257, 258, and 469.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1-469, 763-3704 and 3705.

According to some embodiments of the invention the nucleic acid sequence is capable of increasing fertilizer use efficiency (e.g., nitrogen use efficiency), oil content, yield, growth rate, biomass, vigor, fiber yield, fiber quality, and/or abiotic stress tolerance of a plant.

According to some embodiments of the invention the isolated polynucleotide comprising the nucleic acid sequence selected from the group consisting of SEQ ID NOs:1-469, 763-3704 and 3705.

According to some embodiments of the invention the isolated polynucleotide is set forth by SEQ ID NO:1-469, 763-3704 or 3705.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NOs: 470-762, 3706-5858, 5860-5910, 5912, 5914-5923, 5925-6046 and 6047.

According to some embodiments of the invention the amino acid sequence is capable of increasing fertilizer use efficiency (e.g., nitrogen use efficiency), oil content, yield, growth rate, biomass, vigor, fiber yield, fiber quality, and/or abiotic stress tolerance of a plant.

The invention provides an isolated polynucleotide comprising a nucleic acid sequence encoding a polypeptide which comprises the amino acid sequence selected from the group consisting of SEQ ID NOs:470-762, 3706-5858, 5860-5910, 5912, 5914-5923, 5925-6046 and 6047.

According to an aspect of some embodiments of the invention, there is provided a nucleic acid construct comprising the isolated polynucleotide of the invention, and a promoter for directing transcription of the nucleic acid sequence in a host cell.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NOs: 470-762, 3706-5858, 5860-5910, 5912, 5914-5923, 5925-6046 and 6047.

According to some embodiments of the invention, the polypeptide comprising an amino acid sequence selected from the group consisting of SEQ ID NOs:470-762, 3706-5858, 5860-5910, 5912, 5914-5923, 5925-6046, 6047, 5859, 5911, 5913 and 5924.

According to some embodiments of the invention, the polypeptide is set forth by SEQ ID NO: 470-762, 3706-5858, 5860-5910, 5912, 5914-5923, 5925-6046, 6047, 5859, 5911, 5913 and 5924.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis*, *Albizia amara*, *Alsophila* tricolor, *Andropogon* spp., *Arachis* spp, *Areca catechu*, *Astelia fragrans*, *Astragalus cicer*, *Baikiaea plurijuga*, *Betula* spp., *Brassica* spp., *Bruguiera gymnorrhiza*, *Burkea africana*, *Butea frondosa*, *Cadaba farinosa*, *Calliandra* spp, *Camellia sinensis*, *Canna indica*, *Capsicum* spp., *Cassia* spp., *Centroema pubescens*, *Chacoomeles* spp., *Cinnamomum cassia*, *Coffea arabica*, *Colophospermum mopane*, *Coronillia varia*, *Cotoneaster serotina*, *Crataegus* spp., *Cucumis* spp., *Cupressus* spp., *Cyathea dealbata*, *Cydonia oblonga*, *Cryptomeria japonica*, *Cymbopogon* spp., *Cynthea dealbata*, *Cydonia oblonga*, *Dalbergia monetaria*, *Davallia divaricata*, *Desmodium* spp., *Dicksonia squarosa*, *Dibeteropogon amplectens*, *Dioclea* spp, *Dolichos* spp., *Dorycnium rectum*, *Echinochloa pyramidalis*, *Ehraffia* spp., *Eleusine coracana*, *Eragrestis* spp., *Erythrina* spp., *Eucalypfus* spp., *Euclea schimperi*, *Eulalia vi/losa*, *Pagopyrum* spp., *Feijoa sellowlana*, *Fragaria* spp., *Flemingia* spp, *Freycinetia banksli*, *Geranium thunbergii*, *GinAgo biloba*, *Glycine javanica*, *Gliricidia* spp, *Gossypium hirsutum*, *Grevillea* spp., *Guibourtia coleosperma*, *Hedysarum* spp., *Hemaffhia altissima*, *Heteropogon contoffus*, *Hordeum vulgare*, *Hyparrhenia rufa*, *Hypericum erectum*, *Hypeffhelia dissolute*, *Indigo incamata*, *Iris* spp., *Leptarrhena pyrolifolia*, *Lespediza* spp., *Lettuca* spp., *Leucaena leucocephala*, *Loudetia simplex*, *Lotonus bainesli*, *Lotus* spp., *Macrotyloma axillare*, *Malus* spp., *Manihot esculenta*, *Medicago saliva*, *Metasequoia glyptostroboides*, *Musa sapientum*, *Nicotianum* spp., *Onobrychis* spp., *Ornithopus* spp., *Oryza* spp., *Peltophorum africanum*, *Pennisetum* spp., *Persea gratissima*, *Petunia* spp., *Phaseolus* spp., *Phoenix canariensis*, *Phormium cookianum*, *Photinia* spp., *Picea glauca*, *Pinus* spp., *Pisum sativam*, *Podocarpus totara*, *Pogonarthria fleckii*, *Pogonaffhria squarrosa*, *Populus* spp., *Prosopis cineraria*, *Pseudotsuga menziesii*, *Pterolobium stellatum*, *Pyrus communis*, *Quercus* spp., *Rhaphiolepsis umbellata*, *Rhopalostylis sapida*, *Rhus natalensis*, *Ribes grossularia*, *Ribes* spp., *Robinia pseudoacacia*, *Rosa* spp., *Rubus* spp., *Salix* spp., *Schyzachyrium sanguineum*, *Sciadopitys vefficillata*, *Sequoia sempervirens*, *Sequoiadendron giganteum*, *Sorghum* bicolor, *Spinacia* spp., *Sporobolus fimbriatus*,

*Stiburus alopecuroides, Stylosanthos humilis, Tadehagi* spp, *Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

According to some embodiments of the invention the plant is a dicotyledonous plant.

According to some embodiments of the invention the plant is a monocotyledonous plant.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

As used herein the phrase "heterologous promoter" refers to a promoter from a different species or from the same species but from a different gene locus as of the isolated polynucleotide sequence.

Any suitable promoter sequence can be used by the nucleic acid construct of the present invention. Preferably the promoter is a constitutive promoter, a tissue-specific, or an abiotic stress-inducible promoter.

According to some embodiments of the invention, the promoter is a plant promoter, which is suitable for expression of the exogenous polynucleotide in a plant cell.

Suitable constitutive promoters include, for example, CaMV 35S promoter [SEQ ID NO:6048 (pQFNC); SEQ ID NO:6049 (PJJ 35S from Brachypodium); SEQ ID NO:6050 (Odell et al., Nature 313:810-812, 1985)], *Arabidopsis* At6669 promoter (SEQ ID NO:6051; see PCT Publication No. WO04081173A2 or the new At6669 promoter (SEQ ID NO:6052); maize Ubi 1 (maize polyubiquitin-1, SEQ ID NO:6053; Christensen et al., Plant Sol. Biol. 18:675-689, 1992; Taylor et al., Plant Cell Rep 12:491-495, 1993); rice actin 1 (SEQ ID NO:6054, McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); GOS2 (SEQ ID NO:6055, de Pater et al, Plant J November; 2(6):837-44, 1992); Ubi 1 promoter (SEQ ID NO:6056); RBCS promoter (SEQ ID NO:6057); Rice cyclophilin (Bucholz et al, Plant Mol Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608,149; 5,608,144; 5,604,121; 5,569,597; 5,466,785; 5,399,680; 5,268,463; and 5,608,142.

Suitable tissue-specific promoters include, but not limited to, leaf-specific promoters [e.g., AT5G06690 (Thioredoxin) (high expression, SEQ ID NO:6058), AT5G61520 (AtSTP3) (low expression, SEQ ID NO:6059) described in Buttner et al 2000 Plant, Cell and Environment 23, 175-184, or the promoters described in Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993; as well as *Arabidopsis* STP3 (AT5G61520) promoter (Buttner et al., Plant, Cell and Environment 23:175-184, 2000)], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO:6060 from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), rice PG5a (U.S. Pat. No. 7,700, 835), early seed development *Arabidopsis* BAN (SEQ ID NO:6061, US 2009/0031450 A1), late seed development *Arabidopsis* ABI3 (SEQ ID NO:6062) (Ng et al., Plant Molecular Biology 54: 25-38, 2004), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143:323-32 1990), napA (Stalberg, et al, Planta 199: 515-519, 1996), Wheat SPA (Albanietal, Plant Cell, 9: 171-184, 1997), sunflower oleosin (Cummins, et al., Plant Mol. Biol. 19: 873-876, 1992)], endosperm specific promoters [e.g., wheat LMW and HMW, glutenin-1 (Thomas and Flavell, The Plant Cell 2:1171-1180, 1990; Mol Gen Genet 216:81-90, 1989; NAR 17:461-2), wheat a, b and g gliadins (EMBO3:1409-15, 1984), Barley ltrl promoter, barley B1, C, D hordein (Theor Appl Gen 98:1253-62, 1999; Plant J 4:343-55, 1993; Mol Gen Genet 250:750-60, 1996), Barley DOF (Mena et al, The Plant Journal, 116(1): 53-62, 1998), Biz2 (EP99106056.7), Barley SS2 (Guerin and Carbonero Plant Physiology 114: 1 55-62, 1997), wheat Tarp60 (Kovalchuk et al., Plant Mol Biol 71:81-98, 2009), barley D-hordein (D-Hor) and B-hordein (B-Hor) (Agnelo Furtado, Robert J. Henry and Alessandro Pellegrineschi (2009)], Synthetic promoter (Vicente-Carbajosa et al., Plant J. 13: 629-640, 1998), rice prolamin NRP33, rice-globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma et al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen Genet. 217:240-245; 1989), *Arabidopsis apetala*-3 (Tilly et al., Development. 125:1647-57, 1998), *Arabidopsis APETALA* 1 (AT1G69120, AP1) (SEQ ID NO:6063) (Hempel et al., Development 124:3845-3853, 1997)], and root promoters [e.g., the ROOTP promoter [SEQ ID NO: 6064]; rice ExpB5 and barley ExpB1 promoters (Won et al. Mol. Cells 30: 369-376, 2010); *arabidopsis* monoterpene synthase (AT3G25820) promoter (Chen et al., Plant Phys 135:1956-66, 2004); *arabidopsis* Pho1 promoter (SEQ ID NO:6065, Hamburger et al., Plant Cell. 14: 889-902, 2002), which is also slightly induced Pi stress].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926;0 Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since processes which increase nitrogen use efficiency, fertilizer use efficiency, oil content, yield, seed yield, fiber yield, fiber quality, fiber length, growth rate, biomass, vigor and/or abiotic stress tolerance of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on oil content, yield, growth rate, biomass, vigor and/or abiotic stress tolerance.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, osmotic stress, drought, water deprivation, excess of water (e.g., flood, waterlogging), etiolation, low temperature (e.g., cold stress), high temperature, heavy metal toxicity, anaerobiosis, nutrient deficiency, nutrient excess, atmospheric pollution and UV irradiation.

According to some embodiments of the invention, the method further comprising growing the plant expressing the exogenous polynucleotide under fertilizer limiting conditions (e.g., nitrogen-limiting conditions). Non-limiting examples include growing the plant on soils with low nitrogen content (40-50% Nitrogen of the content present under normal or optimal conditions), or even under sever nitrogen deficiency (0-10% Nitrogen of the content present under normal or optimal conditions).

Thus, the invention encompasses plants exogenously expressing the polynucleotide(s), the nucleic acid constructs and/or polypeptide(s) of the invention.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immunoassays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

Thus, according to an additional embodiment of the present invention, there is provided a method of evaluating a trait of a plant, the method comprising: (a) expressing in a plant or a portion thereof the nucleic acid construct of some embodiments of the invention (described hereinabove); and (b) evaluating a trait of a plant as compared to a wild type plant of the same type (e.g., the same species, e.g., having the same genotype except that it is not transformed with the claimed biomolecules); thereby evaluating the trait of the plant.

According to an aspect of some embodiments of the invention there is provided a method of growing a crop comprising seeding seeds and/or planting plantlets of a plant transformed with the exogenous polynucleotide of the invention, e.g., the polynucleotide which encodes the polypeptide of some embodiments of the invention, wherein the plant is derived from plants selected for at least one trait selected from the group consisting of increased nitrogen use efficiency, increased abiotic stress tolerance, increased biomass, increased growth rate, increased vigor, increased yield and increased fiber yield or quality as compared to a non-transformed plant.

According to some embodiments of the invention the method of growing a crop comprising seeding seeds and/or planting plantlets of a plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polypeptide set forth in SEQ ID NO: 470-762, 3706-5858, 5860-5910, 5912, 5914-5923, 5925-6046 or 6047, wherein the plant is derived from plants selected for at least one trait selected from the group consisting of increased nitrogen use efficiency, increased abiotic stress tolerance, increased biomass, increased growth rate, increased vigor, increased yield and increased fiber yield or quality, increased oil content as compared to a non-transformed plant, thereby growing the crop.

According to some embodiments of the invention the method of growing a crop comprising seeding seeds and/or planting plantlets of a plant transformed with an exogenous polynucleotide comprising the nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide set forth in SEQ ID NO: 1-469, 763-3704 or 3705, wherein the plant is derived from plants selected for at least one trait selected from the group consisting of increased nitrogen use efficiency, increased abiotic stress tolerance, increased biomass, increased growth rate, increased vigor, increased yield and increased fiber yield or quality, increased oil content as compared to a non-transformed plant, thereby growing the crop.

The effect of the transgene (the exogenous polynucleotide encoding the polypeptide) on abiotic stress tolerance can be determined using known methods such as detailed below and in the Examples section which follows.

Abiotic Stress Tolerance—

Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity Tolerance Assay—

Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic Tolerance Test—

Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought Tolerance Assay/Osmoticum Assay—

Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold Stress Tolerance—

To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat Stress Tolerance—

Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water Use Efficiency— can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$RWC=[(FW-DW)/(TW-DW)]\times 100 \qquad \text{Formula I}$$

Fertilizer Use Efficiency—

To analyze whether the transgenic plants are more responsive to fertilizers, plants are grown in agar plates or pots with a limited amount of fertilizer, as described, for example, in Examples 18-20, hereinbelow and in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen Use Efficiency—

To analyze whether the transgenic plants (e.g., *Arabidopsis* plants) are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use Efficiency Assay Using Plantlets—

The assay is done according to Yanagisawa-S. et al. with minor modifications ("Metabolic engineering with Dof1 transcription factor in plants: Improved nitrogen assimilation and growth under low-nitrogen conditions" Proc. Natl. Acad. Sci. USA 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control.

Nitrogen Determination—

The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination Tests—

Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant Vigor—

The plant vigor can be calculated by the increase in growth parameters such as leaf area, fiber length, rosette diameter, plant fresh weight and the like per time.

Growth Rate—

The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be done by measuring plant biomass produced, rosette area, leaf size or root length per time (can be measured in $cm^2$ per day of leaf area).

Relative growth area can be calculated using Formula II.

Relative growth rate area=Regression coefficient of area along time course     Formula II Thus, the relative growth area rate is in units of 1/day and length growth rate is in units of 1/day.

Seed Yield—

Evaluation of the seed yield per plant can be done by measuring the amount (weight or size) or quantity (i.e., number) of dry seeds produced and harvested from 8-16 plants and divided by the number of plants.

For example, the total seeds from 8-16 plants can be collected, weighted using e.g., an analytical balance and the total weight can be divided by the number of plants. Seed yield per growing area can be calculated in the same manner while taking into account the growing area given to a single plant. Increase seed yield per growing area could be achieved by increasing seed yield per plant, and/or by increasing number of plants capable of growing in a given area.

In addition, seed yield can be determined via the weight of 1000 seeds. The weight of 1000 seeds can be determined as follows: seeds are scattered on a glass tray and a picture is taken. Each sample is weighted and then using the digital analysis, the number of seeds in each sample is calculated.

The 1000 seeds weight can be calculated using formula III:

1000 Seed Weight=number of seed in sample/sample weight×1000     Formula III

The Harvest Index can be calculated using Formula IV

Harvest Index=Average seed yield per plant/Average dry weight     Formula IV

Grain Protein Concentration—

Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Fiber Length—

Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (Hypertext Transfer Protocol://World Wide Web (dot) cottoninc (dot) com/ClassificationofCotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil Content—

The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods.

According to some embodiments of the invention, the oil comprises a seed oil.

According to some embodiments of the invention, the oil comprises a vegetative portion oil (oil of the vegetative portion of the plant).

According to some embodiments of the invention, the plant cell forms a part of a plant.

According to another embodiment of the present invention, there is provided a food or feed comprising the plants or a portion thereof of the present invention.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Experimental and Bioinformatics Methods

RNA Extraction—

Tissues growing at various growth conditions (as described below) were sampled and RNA was extracted using TRIzol Reagent from Invitrogen [Hypertext Transfer Protocol://World Wide Web (dot) invitrogen (dot) com/content (dot)cfm?pageid=469]. Approximately 30-50 mg of tissue was taken from samples. The weighed tissues were ground using pestle and mortar in liquid nitrogen and resuspended in 500 µl of TRIzol Reagent. To the homogenized lysate, 100 µl of chloroform was added followed by precipitation using isopropanol and two washes with 75% ethanol. The RNA was eluted in 30 µl of RNase-free water. RNA samples were cleaned up using Qiagen's RNeasy minikit clean-up protocol as per the manufacturer's protocol (QIAGEN Inc, CA USA). For convenience, each microarray expression information tissue type has received an expression Set ID.

Correlation Analysis— was performed for selected genes according to some embodiments of the invention, in which the characterized parameters (measured parameters according to the correlation IDs) were used as "x axis" for correlation with the tissue transcriptome which was used as the "Y axis". For each gene and measured parameter a correlation coefficient "R" was calculated (using Pearson correlation) along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) the phenotypic characteristic (e.g., improved nitrogen use efficiency, abiotic stress tolerance, yield, growth rate and the like).

Example 1

Identifying Genes which Increase Nitrogen Use Efficiency (NUE), Fertilizer Use Efficiency (FUE), Yield, Growth Rate, Vigor, Biomass, Oil Content, Abiotic Stress Tolerance (ABST) and/or Water Use Efficiency (WUE) in Plants The present inventors have identified polynucleotides which upregulation of expression thereof in plants increases nitrogen use efficiency (NUE), fertilizer use efficiency (FUE), yield (e.g., seed yield, oil yield, grain quantity and/or quality), growth rate, vigor, biomass, oil content, fiber yield, fiber quality, fiber length, abiotic stress tolerance (ABST) and/or water use efficiency (WUE) of a plant.

All nucleotide sequence datasets used here were originated from publicly available databases or from performing sequencing using the Solexa technology (e.g. Barley and Sorghum). Sequence data from 100 different plant species was introduced into a single, comprehensive database. Other information on gene expression, protein annotation, enzymes and pathways were also incorporated. Major databases used include:

Genomes

Arabidopsis genome [TAIR genome version 6 (Hypertext Transfer Protocol://World Wide Web (dot) arabidopsis (dot) org/)]

Rice genome [IRGSP build 4.0 (Hypertext Transfer Protocol://rgp (dot) dna (dot) affrc (dot) go (dot) jp/IRGSP/)].

Poplar [*Populus trichocarpa* release 1.1 from JGI (assembly release v1.0) (Hypertext Transfer Protocol://World Wide Web (dot) genome (dot) jgi-psf (dot) org/)]

Brachypodium [JGI 4× assembly, Hypertext Transfer Protocol://World Wide Web (dot) brachpodium (dot) org)]

Soybean [DOE-JGI SCP, version GlymaO (Hypertext Transfer Protocol://World Wide Web (dot) phytozome (dot) net/)]

Grape [French-Italian Public Consortium for Grapevine Genome

Characterization grapevine genome (Hypertext Transfer Protocol://World Wide Web (dot) genoscope (dot) cns (dot) fr/)]

Castobean [TIGR/J Craig Venter Institute 4× assembly [(Hypertext Transfer Protocol://msc (dot) jcvi (dot) org/r_communis]

Sorghum [DOE-JGI SCP, version Sbil [Hypertext Transfer Protocol://World Wide Web (dot) phytozome (dot) net/)].

Maize [Hypertext Transfer Protocol://maizesequence (dot) org/]

Cucumber [Hypertext Transfer Protocol://cucumber (dot) genomics (dot) org (dot) cn/page/cucumber/index (dot) jsp]

Tomato [Hypertext Transfer Protocol://solgenomics (dot) net/tomato/]

Cassava [Hypertext Transfer Protocol://www (dot) phytozome (dot) net/cassava (dot) php]

Expressed EST and mRNA sequences were extracted from the following databases:

GenBank (Hypertext Transfer Protocol://World Wide Web (dot) ncbi (dot) nlm (dot) nih (dot) gov/Genbank/).

RefSeq (Hypertext Transfer Protocol://World Wide Web (dot) ncbi (dot) nlm (dot) nih (dot) gov/RefSeq/).

TAIR (Hypertext Transfer Protocol://World Wide Web (dot) arabidopsis (dot) org/).

Protein and pathway databases

Uniprot [Hypertext Transfer Protocol://World Wide Web (dot) uniprot (dot) org/].

AraCyc [Hypertext Transfer Protocol://World Wide Web (dot) arabidopsis (dot) org/biocyc/index (dot) jsp].

ENZYME [Hypertext Transfer Protocol://expasy (dot) org/enzyme/].

Microarray datasets were downloaded from:

GEO (Hypertext Transfer Protocol://World Wide Web.ncbi.nlm.nih.gov/geo/)

TAIR (Hypertext Transfer Protocol://World Wide Web.arabidopsis.org/).

Proprietary micro-array data (See WO2008/122980 and Examples 3-10 below).

QTL and SNPs information

Gramene [Hypertext Transfer Protocol://World Wide Web (dot) gramene (dot) org/qtl/].

Panzea [Hypertext Transfer Protocol://World Wide Web (dot) panzea (dot) org/index (dot) html].

Soybean QTL: [Hypertext Transfer Protocol://World Wide Web (dot) soybeanbreederstoolbox(dot) com/].

Database Assembly— was performed to build a wide, rich, reliable annotated and easy to analyze database comprised of publicly available genomic mRNA, ESTs DNA sequences, data from various crops as well as gene expression, protein annotation and pathway, QTLs data, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST Clustering and Gene Assembly—

For gene clustering and assembly of organisms with available genome sequence data (*arabidopsis*, rice, castorbean, grape, brachypodium, poplar, soybean, *sorghum*) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene Annotation—

Predicted genes and proteins were annotated as follows: Sequences blast search [Hypertext Transfer Protocol://blast (dot) ncbi (dot) nlm (dot) nih (dot) gov/Blast (dot) cgi] against all plant UniProt [Hypertext Transfer Protocol://World Wide Web (dot) uniprot (dot) org/] was performed. Open reading frames of each putative transcript were analyzed and longest ORF with higher number of homologues was selected as predicted protein of the transcript. The predicted proteins were analyzed by InterPro [Hypertext Transfer Protocol://World Wide Web (dot) ebi (dot) ac (dot) uk/interpro/].

Blast against proteins from AraCyc and ENZYME databases was used to map the predicted transcripts to AraCyc pathways.

Predicted proteins from different species were compared using blast algorithm [Hypertext Transfer Protocol://World Wide Web (dot) ncbi (dot) nlm (dot) nih (dot) gov/Blast (dot) cgi] to validate the accuracy of the predicted protein sequence, and for efficient detection of orthologs.

Gene Expression Profiling—

Several data sources were exploited for gene expression profiling, namely microarray data and digital expression profile (see below). According to gene expression profile, a correlation analysis was performed to identify genes which are co-regulated under different development stages and environmental conditions and associated with different phenotypes.

Publicly available microarray datasets were downloaded from TAIR and NCBI GEO sites, renormalized, and integrated into the database. Expression profiling is one of the most important resource data for identifying genes important for yield.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags (ESTs) that assembled into 67,477 unigenes (32,357 singletons and 35,120 contigs). Analysis of the data obtained against the Cucurbit Genomics Database [Hypertext Transfer Protocol://World Wide Web (dot) icugi (dot) org/] confirmed the accuracy of the sequencing and assembly. Expression patterns of selected genes fitted well their qRT-PCR data.

Overall, 215 genes were identified to have a major impact on nitrogen use efficiency, fertilizer use efficiency, yield (e.g., seed yield, oil yield, grain quantity and/or quality), growth rate, vigor, biomass, oil content, fiber yield, fiber quality, fiber length, abiotic stress tolerance and/or water use efficiency when expression thereof is increased in plants. The identified genes, their curated polynucleotide and polypeptide sequences, as well as their updated sequences according to GenBank database are summarized in Table 1, hereinbelow.

TABLE 1

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster Name | Organism | Polyn. SEQ ID NO: | Polyp. SEQ ID NO: |
|---|---|---|---|---|
| LNU521 | arabidopsis\|10v1\|AT2G15020 | arabidopsis | 1 | 470 |
| LNU522 | arabidopsis\|10v1\|AT2G27830 | arabidopsis | 2 | 471 |
| LNU523 | arabidopsis\|10v1\|AT3G03470 | arabidopsis | 3 | 472 |
| LNU524 | arabidopsis\|10v1\|AT3G14595 | arabidopsis | 4 | 473 |
| LNU526 | arabidopsis\|10v1\|AT5G59400 | arabidopsis | 5 | 474 |
| LNU527 | arabidopsis\|gb165\|AT5G48850 | arabidopsis | 6 | 475 |
| LNU528 | barley\|10v1\|AW982709 | barley | 7 | 476 |
| LNU529 | barley\|10v1\|BE193380 | barley | 8 | 477 |
| LNU530 | barley\|10v1\|BE413013 | barley | 9 | 478 |
| LNU531 | barley\|10v1\|BE421007 | barley | 10 | 479 |
| LNU532 | barley\|10v1\|BI952071 | barley | 11 | 480 |
| LNU533 | barley\|10v2\|AJ472995 | barley | 12 | 481 |
| LNU534 | barley\|10v2\|AV833720 | barley | 13 | 482 |
| LNU536 | barley\|10v2\|AV914259 | barley | 14 | 483 |
| LNU537 | barley\|10v2\|AV916104 | barley | 15 | 484 |
| LNU539 | barley\|10v2\|BE060525 | barley | 16 | 485 |
| LNU540 | barley\|10v2\|BE060661 | barley | 17 | 486 |
| LNU542 | barley\|10v2\|BE195860 | barley | 18 | 487 |
| LNU543 | barley\|10v2\|BE231191 | barley | 19 | 488 |
| LNU544 | barley\|10v2\|BE412660 | barley | 20 | 489 |
| LNU545 | barley\|10v2\|BE412860 | barley | 21 | 490 |
| LNU546 | barley\|10v2\|BE413017 | barley | 22 | 491 |
| LNU547 | barley\|10v2\|BE413119 | barley | 23 | 492 |
| LNU548 | barley\|10v2\|BE413156 | barley | 24 | 493 |
| LNU549 | barley\|10v2\|BE413426 | barley | 25 | 494 |
| LNU550 | barley\|10v2\|BE421949 | barley | 26 | 495 |
| LNU552 | barley\|10v2\|BE454915 | barley | 27 | 496 |
| LNU553 | barley\|10v2\|BE455696 | barley | 28 | 497 |
| LNU554 | barley\|10v2\|BE456091 | barley | 29 | 498 |
| LNU555 | barley\|10v2\|BF254854 | barley | 30 | 499 |
| LNU556 | barley\|10v2\|BF259755 | barley | 31 | 500 |
| LNU557 | barley\|10v2\|BF264561 | barley | 32 | 501 |
| LNU558 | barley\|10v2\|BF266013 | barley | 33 | 502 |
| LNU559 | barley\|10v2\|BF621977 | barley | 34 | 503 |
| LNU560 | barley\|10v2\|BF625119 | barley | 35 | 504 |
| LNU561 | barley\|10v2\|BF628501 | barley | 36 | 505 |
| LNU562 | barley\|10v2\|BG299277 | barley | 37 | 506 |
| LNU563 | barley\|10v2\|BG299593 | barley | 38 | 507 |
| LNU564 | barley\|10v2\|BG299649 | barley | 39 | 508 |
| LNU565 | barley\|10v2\|BG300269 | barley | 40 | 509 |
| LNU566 | barley\|10v2\|BG309120 | barley | 41 | 510 |
| LNU567 | barley\|10v2\|BG417189 | barley | 42 | 511 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster Name | Organism | Polyn. SEQ ID NO: | Polyp. SEQ ID NO: |
|---|---|---|---|---|
| LNU568 | barley|10v2|BI947144 | barley | 43 | 512 |
| LNU569 | barley|10v2|BI947196 | barley | 44 | 513 |
| LNU570 | barley|10v2|BI950431 | barley | 45 | 514 |
| LNU571 | barley|10v2|BI950526 | barley | 46 | 515 |
| LNU572 | barley|10v2|BI950963 | barley | 47 | 516 |
| LNU573 | barley|10v2|BI960262 | barley | 48 | 517 |
| LNU574 | barley|10v2|BJ462932 | barley | 49 | 518 |
| LNU575 | barley|10v2|BQ659260 | barley | 50 | 519 |
| LNU576 | barley|10v2|BU973404 | barley | 51 | 520 |
| LNU577 | barley|10v2|BU999691 | barley | 52 | 521 |
| LNU578 | barley|10v2|CB868902 | barley | 53 | 522 |
| LNU579 | barley|10v2|CB878511 | barley | 54 | 523 |
| LNU580 | barley|10v2|Z48729 | barley | 55 | 524 |
| LNU581 | brachypodium|09v1|DV469029 | brachypodium | 56 | 525 |
| LNU582 | brachypodium|09v1|DV472127 | brachypodium | 57 | 526 |
| LNU583 | brachypodium|09v1|SRR031795S0001263 | brachypodium | 58 | 527 |
| LNU584 | brachypodium|09v1|SRR031795S0017394 | brachypodium | 59 | 528 |
| LNU585 | brachypodium|09v1|SRR031798S0072950 | brachypodium | 60 | 529 |
| LNU587 | foxtail_millet|10v2|FXTRMSLX00266823D1 | foxtail_millet | 61 | 530 |
| LNU588 | foxtail_millet|10v2|FXTRMSLX00411717D1 | foxtail_millet | 62 | 531 |
| LNU589 | foxtail_millet|10v2|FXTRMSLX03332481D2 | foxtail_millet | 63 | 532 |
| LNU590 | foxtail_millet|10v2|OXFXTRMSLX00011438D1T1 | foxtail_millet | 64 | 533 |
| LNU591 | foxtail_millet|11v3|PHY7SI023482M | foxtail_millet | 65 | 534 |
| LNU592 | maize|10v1|AA143918 | maize | 66 | 535 |
| LNU593 | maize|10v1|AA979993 | maize | 67 | 536 |
| LNU594 | maize|10v1|AI438640 | maize | 68 | 537 |
| LNU595 | maize|10v1|AI444678 | maize | 69 | 538 |
| LNU596 | maize|10v1|AI586636 | maize | 70 | 539 |
| LNU597 | maize|10v1|AI586691 | maize | 71 | 540 |
| LNU598 | maize|10v1|AI600810 | maize | 72 | 541 |
| LNU600 | maize|10v1|AI622464 | maize | 73 | 542 |
| LNU601 | maize|10v1|AI622797 | maize | 74 | 543 |
| LNU602 | maize|10v1|AI629493 | maize | 75 | 544 |
| LNU603 | maize|10v1|AI637144 | maize | 76 | 545 |
| LNU604 | maize|10v1|AI670644 | maize | 77 | 546 |
| LNU605 | maize|10v1|AI691677 | maize | 78 | 547 |
| LNU606 | maize|10v1|AI712003 | maize | 79 | 548 |
| LNU607 | maize|10v1|AI783268 | maize | 80 | 549 |
| LNU609 | maize|10v1|AI861477 | maize | 81 | 550 |
| LNU610 | maize|10v1|AI861566 | maize | 82 | 551 |
| LNU611 | maize|10v1|AI944027 | maize | 83 | 552 |
| LNU612 | maize|10v1|AI948344 | maize | 84 | 553 |
| LNU613 | maize|10v1|AI974911 | maize | 85 | 554 |
| LNU614 | maize|10v1|AW000143 | maize | 86 | 555 |
| LNU615 | maize|10v1|AW054615 | maize | 87 | 556 |
| LNU616 | maize|10v1|AW144871 | maize | 88 | 557 |
| LNU617 | maize|10v1|AW144890 | maize | 89 | 558 |
| LNU618 | maize|10v1|AW146733 | maize | 90 | 559 |
| LNU619 | maize|10v1|AW520296 | maize | 91 | 560 |
| LNU620 | maize|10v1|AW562913 | maize | 92 | 561 |
| LNU621 | maize|10v1|AW600599 | maize | 93 | 562 |
| LNU622 | maize|10v1|BE025475 | maize | 94 | 563 |
| LNU623 | maize|10v1|BE640500 | maize | 95 | 564 |
| LNU624 | maize|10v1|BG840447 | maize | 96 | 565 |
| LNU625 | maize|10v1|BG841548 | maize | 97 | 566 |
| LNU626 | maize|10v1|BG874041 | maize | 98 | 567 |
| LNU627 | maize|10v1|BI097536 | maize | 99 | 568 |
| LNU628 | maize|10v1|BI361072 | maize | 100 | 569 |
| LNU629 | maize|10v1|BI361248 | maize | 101 | 570 |
| LNU630 | maize|10v1|BM074263 | maize | 102 | 571 |
| LNU631 | maize|10v1|BM501089 | maize | 103 | 572 |
| LNU632 | maize|10v1|BQ162976 | maize | 104 | 573 |
| LNU634 | maize|10v1|BQ538878 | maize | 105 | 574 |
| LNU635 | maize|10v1|BQ539551 | maize | 106 | 575 |
| LNU636 | maize|10v1|CA399046 | maize | 107 | 576 |
| LNU637 | maize|10v1|CO439238 | maize | 108 | 577 |
| LNU638 | maize|10v1|EE183139 | maize | 109 | 578 |
| LNU639 | maize|10v1|T12737 | maize | 110 | 579 |
| LNU640 | maize|10v1|T18288 | maize | 111 | 580 |
| LNU641 | maize|10v1|T25257 | maize | 112 | 581 |
| LNU642 | maize|10v1|W59838 | maize | 113 | 582 |
| LNU643 | maize|gb170|AI947796 | maize | 114 | 583 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster Name | Organism | Polyn. SEQ ID NO: | Polyp. SEQ ID NO: |
|---|---|---|---|---|
| LNU644 | rice\|gb170\|OS02G02700 | rice | 115 | 584 |
| LNU645 | rice\|gb170\|OS02G44010 | rice | 116 | 585 |
| LNU646 | rice\|gb170\|OS02G45344 | rice | 117 | 586 |
| LNU647 | rice\|gb170\|OS03G44670 | rice | 118 | 587 |
| LNU648 | rice\|gb170\|OS10G39610 | rice | 119 | 588 |
| LNU649 | sorghum\|09v1\|SB01G002970 | sorghum | 120 | 589 |
| LNU650 | sorghum\|09v1\|SB01G003880 | sorghum | 121 | 590 |
| LNU651 | sorghum\|09v1\|SB01G007350 | sorghum | 122 | 591 |
| LNU652 | sorghum\|09v1\|SB01G038520 | sorghum | 123 | 592 |
| LNU653 | sorghum\|09v1\|SB01G044140 | sorghum | 124 | 593 |
| LNU654 | sorghum\|09v1\|SB01G044540 | sorghum | 125 | 594 |
| LNU655 | sorghum\|09v1\|SB01G049530 | sorghum | 126 | 595 |
| LNU656 | sorghum\|09v1\|SB02G005370 | sorghum | 127 | 596 |
| LNU657 | sorghum\|09v1\|SB02G023650 | sorghum | 128 | 597 |
| LNU658 | sorghum\|09v1\|SB02G025680 | sorghum | 129 | 598 |
| LNU659 | sorghum\|09v1\|SB02G032540 | sorghum | 130 | 599 |
| LNU660 | sorghum\|09v1\|SB02G036310 | sorghum | 131 | 600 |
| LNU661 | sorghum\|09v1\|SB02G040700 | sorghum | 132 | 601 |
| LNU662 | sorghum\|09v1\|SB02G041820 | sorghum | 133 | 602 |
| LNU663 | sorghum\|09v1\|SB03G001750 | sorghum | 134 | 603 |
| LNU664 | sorghum\|09v1\|SB03G002970 | sorghum | 135 | 604 |
| LNU665 | sorghum\|09v1\|SB03G006470 | sorghum | 136 | 605 |
| LNU666 | sorghum\|09v1\|SB03G010400 | sorghum | 137 | 606 |
| LNU667 | sorghum\|09v1\|SB03G012610 | sorghum | 138 | 607 |
| LNU668 | sorghum\|09v1\|SB03G024490 | sorghum | 139 | 608 |
| LNU669 | sorghum\|09v1\|SB03G033100 | sorghum | 140 | 609 |
| LNU670 | sorghum\|09v1\|SB03G033180 | sorghum | 141 | 610 |
| LNU671 | sorghum\|09v1\|SB03G034450 | sorghum | 142 | 611 |
| LNU672 | sorghum\|09v1\|SB03G038770 | sorghum | 143 | 612 |
| LNU673 | sorghum\|09v1\|SB03G042570 | sorghum | 144 | 613 |
| LNU674 | sorghum\|09v1\|SB03G044800 | sorghum | 145 | 614 |
| LNU675 | sorghum\|09v1\|SB04G001820 | sorghum | 146 | 615 |
| LNU676 | sorghum\|09v1\|SB04G005050 | sorghum | 147 | 616 |
| LNU677 | sorghum\|09v1\|SB04G020650 | sorghum | 148 | 617 |
| LNU679 | sorghum\|09v1\|SB04G028460 | sorghum | 149 | 618 |
| LNU680 | sorghum\|09v1\|SB04G029940 | sorghum | 150 | 619 |
| LNU682 | sorghum\|09v1\|SB05G022900 | sorghum | 151 | 620 |
| LNU683 | sorghum\|09v1\|SB06G005210 | sorghum | 152 | 621 |
| LNU684 | sorghum\|09v1\|SB06G018550 | sorghum | 153 | 622 |
| LNU685 | sorghum\|09v1\|SB06G019290 | sorghum | 154 | 623 |
| LNU686 | sorghum\|09v1\|SB06G028100 | sorghum | 155 | 624 |
| LNU687 | sorghum\|09v1\|SB06G032540 | sorghum | 156 | 625 |
| LNU688 | sorghum\|09v1\|SB07G021230 | sorghum | 157 | 626 |
| LNU689 | sorghum\|09v1\|SB07G021620 | sorghum | 158 | 627 |
| LNU690 | sorghum\|09v1\|SB07G021750 | sorghum | 159 | 628 |
| LNU691 | sorghum\|09v1\|SB08G018710 | sorghum | 160 | 629 |
| LNU692 | sorghum\|09v1\|SB08G022010 | sorghum | 161 | 630 |
| LNU693 | sorghum\|09v1\|SB08G022900 | sorghum | 162 | 631 |
| LNU694 | sorghum\|09v1\|SB09G005330 | sorghum | 163 | 632 |
| LNU695 | sorghum\|09v1\|SB09G006340 | sorghum | 164 | 633 |
| LNU696 | sorghum\|09v1\|SB09G021590 | sorghum | 165 | 634 |
| LNU697 | sorghum\|09v1\|SB09G022400 | sorghum | 166 | 635 |
| LNU698 | sorghum\|09v1\|SB09G027070 | sorghum | 167 | 636 |
| LNU699 | sorghum\|09v1\|SB09G028500 | sorghum | 168 | 637 |
| LNU700 | sorghum\|09v1\|SB10G002780 | sorghum | 169 | 638 |
| LNU701 | sorghum\|09v1\|SB10G004550 | sorghum | 170 | 639 |
| LNU702 | sorghum\|09v1\|SB10G009330 | sorghum | 171 | 640 |
| LNU703 | sorghum\|09v1\|SB10G010690 | sorghum | 172 | 641 |
| LNU704 | sorghum\|09v1\|SB10G021910 | sorghum | 173 | 642 |
| LNU705 | sorghum\|11v1\|SB02G043260 | sorghum | 174 | 643 |
| LNU706 | sorghum\|11v1\|SB04G028755 | sorghum | 175 | 644 |
| LNU707 | sorghum\|11v1\|SB06G027320 | sorghum | 176 | 645 |
| LNU708 | sorghum\|11v1\|SB06G031110 | sorghum | 177 | 646 |
| LNU709 | soybean\|11v1\|GLYMA07G02500 | soybean | 178 | 647 |
| LNU710 | soybean\|11v1\|GLYMA12G10290 | soybean | 179 | 648 |
| LNU711 | soybean\|11v1\|GLYMA15G07910 | soybean | 180 | 649 |
| LNU712 | tomato\|09v1\|AA668032 | tomato | 181 | 650 |
| LNU713 | tomato\|09v1\|AW429253 | tomato | 182 | 651 |
| LNU714 | tomato\|09v1\|BI203878 | tomato | 183 | 652 |
| LNU715 | tomato\|10v1\|AF211796 | tomato | 184 | 653 |
| LNU716 | tomato\|10v1\|AI485147 | tomato | 185 | 654 |
| LNU718 | tomato\|10v1\|AI781238 | tomato | 186 | 655 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster Name | Organism | Polyn. SEQ ID NO: | Polyp. SEQ ID NO: |
| --- | --- | --- | --- | --- |
| LNU719 | tomato\|10v1\|AI896451 | tomato | 187 | 656 |
| LNU720 | tomato\|11v1\|AW030717 | tomato | 188 | 657 |
| LNU721 | tomato\|10v1\|AW094309 | tomato | 189 | 658 |
| LNU722 | tomato\|10v1\|AW622680 | tomato | 190 | 659 |
| LNU723 | tomato\|10v1\|BG123237 | tomato | 191 | 660 |
| LNU724 | tomato\|10v1\|BG123504 | tomato | 192 | 661 |
| LNU725 | tomato\|10v1\|BG123834 | tomato | 193 | 662 |
| LNU726 | tomato\|10v1\|BG124017 | tomato | 194 | 663 |
| LNU727 | tomato\|10v1\|BG124542 | tomato | 195 | 664 |
| LNU728 | tomato\|10v1\|BG124612 | tomato | 196 | 665 |
| LNU729 | tomato\|10v1\|BG125266 | tomato | 197 | 666 |
| LNU730 | tomato\|10v1\|BG125581 | tomato | 198 | 667 |
| LNU732 | tomato\|10v1\|BG127018 | tomato | 199 | 668 |
| LNU733 | tomato\|10v1\|BG127771 | tomato | 200 | 669 |
| LNU734 | tomato\|10v1\|BG128324 | tomato | 201 | 670 |
| LNU735 | tomato\|10v1\|BG130581 | tomato | 202 | 671 |
| LNU736 | tomato\|10v1\|BG134404 | tomato | 203 | 672 |
| LNU738 | tomato\|10v1\|BG642771 | tomato | 204 | 673 |
| LNU739 | tomato\|10v1\|BG643777 | tomato | 205 | 674 |
| LNU740 | tomato\|10v1\|CA519077 | tomato | 206 | 675 |
| LNU741 | tomato\|10v1\|TOMRNAA | tomato | 207 | 676 |
| LNU742 | wheat\|10v2\|BE216941 | wheat | 208 | 677 |
| LNU744 | wheat\|10v2\|BE405926 | wheat | 209 | 678 |
| LNU745 | wheat\|10v2\|BE429231XX1 | wheat | 210 | 679 |
| LNU746 | wheat\|10v2\|BE497814 | wheat | 211 | 680 |
| LNU747 | wheat\|10v2\|BF201526 | wheat | 212 | 681 |
| LNU748 | wheat\|10v2\|BM136597 | wheat | 213 | 682 |
| LNU636_H1 | maize\|10v1\|BM079557 | maize | 214 | 683 |
| LNU608 | maize\|10v1\|AI855271 | maize | 215 | — |
| LNU688 | sorghum\|09v1\|SB07G021230 | sorghum | 157 | 700 |
| LNU527 | arabidopsis\|gb165\|AT5G48850 | arabidopsis | 216 | 684 |
| LNU540 | barley\|10v2\|BE060661 | barley | 217 | 685 |
| LNU546 | barley\|10v2\|BE413017 | barley | 218 | 686 |
| LNU555 | barley\|10v2\|BF254854 | barley | 219 | 499 |
| LNU561 | barley\|10v2\|BF628501 | barley | 220 | 687 |
| LNU563 | barley\|10v2\|BG299593 | barley | 221 | 507 |
| LNU567 | barley\|10v2\|BG417189 | barley | 222 | 511 |
| LNU572 | barley\|10v2\|BI950963 | barley | 223 | 688 |
| LNU573 | barley\|10v2\|BI960262 | barley | 224 | 689 |
| LNU578 | barley\|10v2\|CB868902 | barley | 225 | 690 |
| LNU583 | brachypodium\|09v1\|SRR031795S0001263 | brachypodium | 226 | 527 |
| LNU584 | brachypodium\|09v1\|SRR031795S0017394 | brachypodium | 227 | 528 |
| LNU585 | brachypodium\|09v1\|SRR031798S0072950 | brachypodium | 228 | 691 |
| LNU588 | foxtail_millet\|10v2\|FXTRMSLX00411717D1 | foxtail_millet | 229 | 692 |
| LNU591 | foxtail_millet\|11v3\|PHY7SI023482M | foxtail_millet | 230 | 534 |
| LNU593 | maize\|10v1\|AA979993 | maize | 231 | 536 |
| LNU597 | maize\|10v1\|AI586691 | maize | 232 | 540 |
| LNU601 | maize\|10v1\|AI622797 | maize | 233 | 693 |
| LNU613 | maize\|10v1\|AI974911 | maize | 234 | 694 |
| LNU615 | maize\|10v1\|AW054615 | maize | 235 | 556 |
| LNU618 | maize\|10v1\|AW146733 | maize | 236 | 695 |
| LNU638 | maize\|10v1\|EE183139 | maize | 237 | 696 |
| LNU654 | sorghum\|09v1\|SB01G044540 | sorghum | 238 | 697 |
| LNU659 | sorghum\|09v1\|SB02G032540 | sorghum | 239 | 698 |
| LNU663 | sorghum\|09v1\|SB03G001750 | sorghum | 240 | 603 |
| LNU664 | sorghum\|09v1\|SB03G002970 | sorghum | 241 | 604 |
| LNU665 | sorghum\|09v1\|SB03G006470 | sorghum | 242 | 605 |
| LNU666 | sorghum\|09v1\|SB03G010400 | sorghum | 243 | 606 |
| LNU672 | sorghum\|09v1\|SB03G038770 | sorghum | 244 | 699 |
| LNU683 | sorghum\|09v1\|SB06G005210 | sorghum | 245 | 621 |
| LNU692 | sorghum\|09v1\|SB08G022010 | sorghum | 246 | 630 |
| LNU693 | sorghum\|09v1\|SB08G022900 | sorghum | 247 | 701 |
| LNU695 | sorghum\|09v1\|SB09G006340 | sorghum | 248 | 633 |
| LNU701 | sorghum\|09v1\|SB10G004550 | sorghum | 249 | 639 |
| LNU702 | sorghum\|09v1\|SB10G009330 | sorghum | 250 | 640 |
| LNU708 | sorghum\|11v1\|SB06G031110 | sorghum | 251 | 646 |
| LNU720 | tomato\|10v1\|AW030717 | tomato | 252 | 657 |
| LNU736 | tomato\|10v1\|BG134404 | tomato | 253 | 672 |
| LNU742 | wheat\|10v2\|BE216941 | wheat | 254 | 677 |
| LNU746 | wheat\|10v2\|BE497814 | wheat | 255 | 702 |
| LNU748 | wheat\|10v2\|BM136597 | wheat | 256 | 703 |
| LNU533 | barley\|10v2\|AJ472995 | barley | 257 | — |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster Name | Organism | Polyn. SEQ ID NO: | Polyp. SEQ ID NO: |
|---|---|---|---|---|
| LNU608 | maize\|10v1\|AI855271 | maize | 258 | — |
| LNU521 | arabidopsis\|10v1\|AT2G15020 | arabidopsis | 259 | 470 |
| LNU522 | arabidopsis\|10v1\|AT2G27830 | arabidopsis | 260 | 471 |
| LNU523 | arabidopsis\|10v1\|AT3G03470 | arabidopsis | 261 | 472 |
| LNU524 | arabidopsis\|10v1\|AT3G14595 | arabidopsis | 262 | 473 |
| LNU526 | arabidopsis\|10v1\|AT5G59400 | arabidopsis | 263 | 704 |
| LNU527 | arabidopsis\|gb165\|AT5G48850 | arabidopsis | 264 | 475 |
| LNU528 | barley\|10v1\|AW982709 | barley | 265 | 476 |
| LNU529 | barley\|10v1\|BE193380 | barley | 266 | 477 |
| LNU530 | barley\|10v1\|BE413013 | barley | 267 | 478 |
| LNU531 | barley\|10v1\|BE421007 | barley | 268 | 479 |
| LNU532 | barley\|10v1\|BI952071 | barley | 269 | 480 |
| LNU533 | barley\|10v2\|AJ472995 | barley | 270 | 705 |
| LNU534 | barley\|10v2\|AV833720 | barley | 271 | 482 |
| LNU536 | barley\|10v2\|AV914259 | barley | 272 | 483 |
| LNU537 | barley\|10v2\|AV916104 | barley | 273 | 484 |
| LNU539 | barley\|10v2\|BE060525 | barley | 274 | 485 |
| LNU540 | barley\|10v2\|BE060661 | barley | 275 | 486 |
| LNU542 | barley\|10v2\|BE195860 | barley | 276 | 487 |
| LNU543 | barley\|10v2\|BE231191 | barley | 277 | 706 |
| LNU544 | barley\|10v2\|BE412660 | barley | 278 | 489 |
| LNU545 | barley\|10v2\|BE412860 | barley | 279 | 707 |
| LNU546 | barley\|10v2\|BE413017 | barley | 280 | 708 |
| LNU547 | barley\|10v2\|BE413119 | barley | 281 | 492 |
| LNU548 | barley\|10v2\|BE413156 | barley | 282 | 493 |
| LNU549 | barley\|10v2\|BE413426 | barley | 283 | 494 |
| LNU550 | barley\|10v2\|BE421949 | barley | 284 | 495 |
| LNU553 | barley\|10v2\|BE455696 | barley | 285 | 709 |
| LNU554 | barley\|10v2\|BE456091 | barley | 286 | 498 |
| LNU555 | barley\|10v2\|BF254854 | barley | 287 | 499 |
| LNU556 | barley\|10v2\|BF259755 | barley | 288 | 710 |
| LNU557 | barley\|10v2\|BF264561 | barley | 289 | 711 |
| LNU558 | barley\|10v2\|BF266013 | barley | 290 | 502 |
| LNU559 | barley\|10v2\|BF621977 | barley | 291 | 503 |
| LNU560 | barley\|10v2\|BF625119 | barley | 292 | 504 |
| LNU561 | barley\|10v2\|BF628501 | barley | 293 | 712 |
| LNU562 | barley\|10v2\|BG299277 | barley | 294 | 713 |
| LNU563 | barley\|10v2\|BG299593 | barley | 295 | 507 |
| LNU564 | barley\|10v2\|BG299649 | barley | 296 | 508 |
| LNU565 | barley\|10v2\|BG300269 | barley | 297 | 509 |
| LNU566 | barley\|10v2\|BG309120 | barley | 298 | 714 |
| LNU567 | barley\|10v2\|BG417189 | barley | 299 | 511 |
| LNU568 | barley\|10v2\|BI947144 | barley | 300 | 715 |
| LNU569 | barley\|10v2\|BI947196 | barley | 301 | 716 |
| LNU570 | barley\|10v2\|BI950431 | barley | 302 | 514 |
| LNU571 | barley\|10v2\|BI950526 | barley | 303 | 717 |
| LNU572 | barley\|10v2\|BI950963 | barley | 304 | 718 |
| LNU573 | barley\|10v2\|BI960262 | barley | 305 | 517 |
| LNU574 | barley\|10v2\|BJ462932 | barley | 306 | 719 |
| LNU575 | barley\|10v2\|BQ659260 | barley | 307 | 519 |
| LNU576 | barley\|10v2\|BU973404 | barley | 308 | 720 |
| LNU577 | barley\|10v2\|BU999691 | barley | 309 | 721 |
| LNU580 | barley\|10v2\|Z48729 | barley | 310 | 524 |
| LNU581 | brachypodium\|09v1\|DV469029 | brachypodium | 311 | 525 |
| LNU582 | brachypodium\|09v1\|DV472127 | brachypodium | 312 | 526 |
| LNU583 | brachypodium\|09v1\|SRR031795S0001263 | brachypodium | 313 | 722 |
| LNU584 | brachypodium\|09v1\|SRR031795S0017394 | brachypodium | 314 | 528 |
| LNU585 | brachypodium\|09v1\|SRR031798S0072950 | brachypodium | 315 | 529 |
| LNU587 | foxtail_millet\|10v2\|FXTRMSLX00266823D1 | foxtail_millet | 316 | 530 |
| LNU588 | foxtail_millet\|10v2\|FXTRMSLX00411717D1 | foxtail_millet | 317 | 531 |
| LNU589 | foxtail_millet\|10v2\|FXTRMSLX03332481D2 | foxtail_millet | 318 | 532 |
| LNU590 | foxtail_millet\|10v2\|OXFXTRMSLX00011438D1T1 | foxtail_millet | 319 | 723 |
| LNU591 | foxtail_millet\|11v3\|PHY7SI023482M | foxtail_millet | 320 | 534 |
| LNU592 | maize\|10v1\|AA143918 | maize | 321 | 535 |
| LNU593 | maize\|10v1\|AA979993 | maize | 322 | 536 |
| LNU594 | maize\|10v1\|AI438640 | maize | 323 | 537 |
| LNU595 | maize\|10v1\|AI444678 | maize | 324 | 724 |
| LNU596 | maize\|10v1\|AI586636 | maize | 325 | 539 |
| LNU597 | maize\|10v1\|AI586691 | maize | 326 | 725 |
| LNU598 | maize\|10v1\|AI600810 | maize | 327 | 726 |
| LNU600 | maize\|10v1\|AI622464 | maize | 328 | 727 |
| LNU601 | maize\|10v1\|AI622797 | maize | 329 | 728 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster Name | Organism | Polyn. SEQ ID NO: | Polyp. SEQ ID NO: |
| --- | --- | --- | --- | --- |
| LNU602 | maize\|10v1\|AI629493 | maize | 330 | 729 |
| LNU603 | maize\|10v1\|AI637144 | maize | 331 | 545 |
| LNU604 | maize\|10v1\|AI670644 | maize | 332 | 546 |
| LNU605 | maize\|10v1\|AI691677 | maize | 333 | 730 |
| LNU606 | maize\|10v1\|AI712003 | maize | 334 | 548 |
| LNU607 | maize\|10v1\|AI783268 | maize | 335 | 549 |
| LNU609 | maize\|10v1\|AI861477 | maize | 336 | 731 |
| LNU610 | maize\|10v1\|AI861566 | maize | 337 | 551 |
| LNU611 | maize\|10v1\|AI944027 | maize | 338 | 732 |
| LNU612 | maize\|10v1\|AI948344 | maize | 339 | 553 |
| LNU613 | maize\|10v1\|AI974911 | maize | 340 | 554 |
| LNU614 | maize\|10v1\|AW000143 | maize | 341 | 555 |
| LNU615 | maize\|10v1\|AW054615 | maize | 342 | 556 |
| LNU616 | maize\|10v1\|AW144871 | maize | 343 | 557 |
| LNU617 | maize\|10v1\|AW144890 | maize | 344 | 733 |
| LNU618 | maize\|10v1\|AW146733 | maize | 345 | 734 |
| LNU619 | maize\|10v1\|AW520296 | maize | 346 | 735 |
| LNU620 | maize\|10v1\|AW562913 | maize | 347 | 736 |
| LNU621 | maize\|10v1\|AW600599 | maize | 348 | 562 |
| LNU622 | maize\|10v1\|BE025475 | maize | 349 | 563 |
| LNU623 | maize\|10v1\|BE640500 | maize | 350 | 564 |
| LNU624 | maize\|10v1\|BG840447 | maize | 351 | 565 |
| LNU625 | maize\|10v1\|BG841548 | maize | 352 | 737 |
| LNU626 | maize\|10v1\|BG874041 | maize | 353 | 567 |
| LNU627 | maize\|10v1\|BI097536 | maize | 354 | 738 |
| LNU628 | maize\|10v1\|BI361072 | maize | 355 | 569 |
| LNU629 | maize\|10v1\|BI361248 | maize | 356 | 570 |
| LNU630 | maize\|10v1\|BM074263 | maize | 357 | 571 |
| LNU631 | maize\|10v1\|BM501089 | maize | 358 | 572 |
| LNU632 | maize\|10v1\|BQ162976 | maize | 359 | 573 |
| LNU634 | maize\|10v1\|BQ538878 | maize | 360 | 574 |
| LNU635 | maize\|10v1\|BQ539551 | maize | 361 | 739 |
| LNU637 | maize\|10v1\|CO439238 | maize | 362 | 740 |
| LNU638 | maize\|10v1\|EE183139 | maize | 363 | 696 |
| LNU639 | maize\|10v1\|T12737 | maize | 364 | 579 |
| LNU640 | maize\|10v1\|T18288 | maize | 365 | 741 |
| LNU641 | maize\|10v1\|T25257 | maize | 366 | 581 |
| LNU642 | maize\|10v1\|W59838 | maize | 367 | 742 |
| LNU643 | maize\|gb170\|AI947796 | maize | 368 | 583 |
| LNU644 | rice\|gb170\|OS02G02700 | rice | 369 | 743 |
| LNU645 | rice\|gb170\|OS02G44010 | rice | 370 | 585 |
| LNU646 | rice\|gb170\|OS02G45344 | rice | 371 | 586 |
| LNU647 | rice\|gb170\|OS03G44670 | rice | 372 | 587 |
| LNU648 | rice\|gb170\|OS10G39610 | rice | 373 | 588 |
| LNU649 | sorghum\|09v1\|SB01G002970 | sorghum | 374 | 589 |
| LNU650 | sorghum\|09v1\|SB01G003880 | sorghum | 375 | 590 |
| LNU651 | sorghum\|09v1\|SB01G007350 | sorghum | 376 | 591 |
| LNU652 | sorghum\|09v1\|SB01G038520 | sorghum | 377 | 744 |
| LNU653 | sorghum\|09v1\|SB01G044140 | sorghum | 378 | 593 |
| LNU654 | sorghum\|09v1\|SB01G044540 | sorghum | 379 | 594 |
| LNU655 | sorghum\|09v1\|SB01G049530 | sorghum | 380 | 745 |
| LNU656 | sorghum\|09v1\|SB02G005370 | sorghum | 381 | 596 |
| LNU657 | sorghum\|09v1\|SB02G023650 | sorghum | 382 | 597 |
| LNU658 | sorghum\|09v1\|SB02G025680 | sorghum | 383 | 598 |
| LNU659 | sorghum\|09v1\|SB02G032540 | sorghum | 384 | 599 |
| LNU660 | sorghum\|09v1\|SB02G036310 | sorghum | 385 | 600 |
| LNU661 | sorghum\|09v1\|SB02G040700 | sorghum | 386 | 746 |
| LNU662 | sorghum\|09v1\|SB02G041820 | sorghum | 387 | 602 |
| LNU663 | sorghum\|09v1\|SB03G001750 | sorghum | 388 | 603 |
| LNU664 | sorghum\|09v1\|SB03G002970 | sorghum | 389 | 747 |
| LNU665 | sorghum\|09v1\|SB03G006470 | sorghum | 390 | 605 |
| LNU666 | sorghum\|09v1\|SB03G010400 | sorghum | 391 | 748 |
| LNU667 | sorghum\|09v1\|SB03G012610 | sorghum | 392 | 607 |
| LNU668 | sorghum\|09v1\|SB03G024490 | sorghum | 393 | 608 |
| LNU669 | sorghum\|09v1\|SB03G033100 | sorghum | 394 | 609 |
| LNU670 | sorghum\|09v1\|SB03G033180 | sorghum | 395 | 610 |
| LNU671 | sorghum\|09v1\|SB03G034450 | sorghum | 396 | 611 |
| LNU672 | sorghum\|09v1\|SB03G038770 | sorghum | 397 | 612 |
| LNU673 | sorghum\|09v1\|SB03G042570 | sorghum | 398 | 613 |
| LNU674 | sorghum\|09v1\|SB03G044800 | sorghum | 399 | 614 |
| LNU675 | sorghum\|09v1\|SB04G001820 | sorghum | 400 | 615 |
| LNU676 | sorghum\|09v1\|SB04G005050 | sorghum | 401 | 616 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster Name | Organism | Polyn. SEQ ID NO: | Polyp. SEQ ID NO: |
|---|---|---|---|---|
| LNU677 | sorghum|09v1|SB04G020650 | sorghum | 402 | 617 |
| LNU679 | sorghum|09v1|SB04G028460 | sorghum | 403 | 618 |
| LNU680 | sorghum|09v1|SB04G029940 | sorghum | 404 | 619 |
| LNU682 | sorghum|09v1|SB05G022900 | sorghum | 405 | 620 |
| LNU683 | sorghum|09v1|SB06G005210 | sorghum | 406 | 621 |
| LNU684 | sorghum|09v1|SB06G018550 | sorghum | 407 | 622 |
| LNU685 | sorghum|09v1|SB06G019290 | sorghum | 408 | 623 |
| LNU686 | sorghum|09v1|SB06G028100 | sorghum | 409 | 624 |
| LNU687 | sorghum|09v1|SB06G032540 | sorghum | 410 | 625 |
| LNU688 | sorghum|09v1|SB07G021230 | sorghum | 411 | 749 |
| LNU689 | sorghum|09v1|SB07G021620 | sorghum | 412 | 627 |
| LNU690 | sorghum|09v1|SB07G021750 | sorghum | 413 | 750 |
| LNU691 | sorghum|09v1|SB08G018710 | sorghum | 414 | 629 |
| LNU692 | sorghum|09v1|SB08G022010 | sorghum | 415 | 630 |
| LNU693 | sorghum|09v1|SB08G022900 | sorghum | 416 | 751 |
| LNU694 | sorghum|09v1|SB09G005330 | sorghum | 417 | 632 |
| LNU695 | sorghum|09v1|SB09G006340 | sorghum | 418 | 633 |
| LNU696 | sorghum|09v1|SB09G021590 | sorghum | 419 | 634 |
| LNU697 | sorghum|09v1|SB09G022400 | sorghum | 420 | 752 |
| LNU698 | sorghum|09v1|SB09G027070 | sorghum | 421 | 636 |
| LNU699 | sorghum|09v1|SB09G028500 | sorghum | 422 | 637 |
| LNU700 | sorghum|09v1|SB10G002780 | sorghum | 423 | 638 |
| LNU701 | sorghum|09v1|SB10G004550 | sorghum | 424 | 639 |
| LNU702 | sorghum|09v1|SB10G009330 | sorghum | 425 | 753 |
| LNU703 | sorghum|09v1|SB10G010690 | sorghum | 426 | 641 |
| LNU704 | sorghum|09v1|SB10G021910 | sorghum | 427 | 642 |
| LNU705 | sorghum|11v1|SB02G043260 | sorghum | 428 | 643 |
| LNU706 | sorghum|11v1|SB04G028755 | sorghum | 429 | 644 |
| LNU707 | sorghum|11v1|SB06G027320 | sorghum | 430 | 645 |
| LNU708 | sorghum|11v1|SB06G031110 | sorghum | 431 | 754 |
| LNU709 | soybean|11v1|GLYMA07G02500 | soybean | 432 | 647 |
| LNU710 | soybean|11v1|GLYMA12G10290 | soybean | 433 | 648 |
| LNU711 | soybean|11v1|GLYMA15G07910 | soybean | 434 | 649 |
| LNU712 | tomato|09v1|AA668032 | tomato | 435 | 755 |
| LNU713 | tomato|09v1|AW429253 | tomato | 436 | 651 |
| LNU714 | tomato|09v1|BI203878 | tomato | 437 | 652 |
| LNU715 | tomato|10v1|AF211796 | tomato | 438 | 653 |
| LNU716 | tomato|10v1|AI485147 | tomato | 439 | 654 |
| LNU718 | tomato|10v1|AI781238 | tomato | 440 | 655 |
| LNU719 | tomato|10v1|AI896451 | tomato | 441 | 656 |
| LNU720 | tomato|11v1|AW030717 | tomato | 442 | 756 |
| LNU721 | tomato|10v1|AW094309 | tomato | 443 | 658 |
| LNU722 | tomato|10v1|AW622680 | tomato | 444 | 659 |
| LNU723 | tomato|10v1|BG123237 | tomato | 445 | 660 |
| LNU724 | tomato|10v1|BG123504 | tomato | 446 | 757 |
| LNU725 | tomato|10v1|BG123834 | tomato | 447 | 662 |
| LNU726 | tomato|10v1|BG124017 | tomato | 448 | 663 |
| LNU727 | tomato|10v1|BG124542 | tomato | 449 | 664 |
| LNU728 | tomato|10v1|BG124612 | tomato | 450 | 665 |
| LNU729 | tomato|10v1|BG125266 | tomato | 451 | 666 |
| LNU730 | tomato|10v1|BG125581 | tomato | 452 | 667 |
| LNU732 | tomato|10v1|BG127018 | tomato | 453 | 668 |
| LNU733 | tomato|10v1|BG127771 | tomato | 454 | 669 |
| LNU734 | tomato|10v1|BG128324 | tomato | 455 | 670 |
| LNU735 | tomato|10v1|BG130581 | tomato | 456 | 758 |
| LNU736 | tomato|10v1|BG134404 | tomato | 457 | 672 |
| LNU738 | tomato|10v1|BG642771 | tomato | 458 | 673 |
| LNU739 | tomato|10v1|BG643777 | tomato | 459 | 674 |
| LNU740 | tomato|10v1|CA519077 | tomato | 460 | 675 |
| LNU741 | tomato|10v1|TOMRNAA | tomato | 461 | 676 |
| LNU742 | wheat|10v2|BE216941 | wheat | 462 | 677 |
| LNU744 | wheat|10v2|BE405926 | wheat | 463 | 678 |
| LNU745 | wheat|10v2|BE429231XX1 | wheat | 464 | 759 |
| LNU746 | wheat|10v2|BE497814 | wheat | 465 | 760 |
| LNU747 | wheat|10v2|BF201526 | wheat | 466 | 761 |
| LNU748 | wheat|10v2|BM136597 | wheat | 467 | 762 |
| LNU636_H1 | maize|10v1|BM079557 | maize | 468 | 683 |
| LNU608 | maize|10v1|AI855271 | maize | 469 | — |

Table 1. "Polyp." = polypeptide; "Polyn."—Polynucleutide.

Example 2

Identification of Homologous Sequences that Increase Nitrogen Use Efficiency, Fertilizer Use Efficiency, Yield, Growth Rate, Vigor, Biomass, Oil Content, Abiotic Stress Tolerance and/or Water Use Efficiency in Plants The concepts of orthology and paralogy have recently been applied to functional characterizations and classifications on the scale of whole-genome comparisons. Orthologs and paralogs constitute two major types of homologs: The first evolved from a common ancestor by specialization, and the latter is related by duplication events. It is assumed that paralogs arising from ancient duplication events are likely to have diverged in function while true orthologs are more likely to retain identical function over evolutionary time.

To further investigate and identify putative orthologs of the genes affecting nitrogen use efficiency, fertilizer use efficiency, yield (e.g., seed yield, oil yield, grain quantity and/or quality), growth rate, vigor, biomass, oil content, abiotic stress tolerance and/or water use efficiency, all sequences were aligned using the BLAST (/Basic Local Alignment Search Tool/). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly. Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

The search and identification of homologous genes involves the screening of sequence information available, for example, in public databases, which include but are not limited to the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST programs. There are five implementations of BLAST, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST algorithm calculates percent sequence identity and performs a statistical analysis of the similarity between the two sequences. The software for performing BLAST analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbor-joining tree of the proteins homologous to the genes of some embodiments of the invention may be used to provide an overview of structural and ancestral relationships. Sequence identity may be calculated using an alignment program as described above. It is expected that other plants will carry a similar functional gene (orthologue) or a family of similar genes and those genes will provide the same preferred phenotype as the genes presented here. Advantageously, these family members may be useful in the methods of some embodiments of the invention. Example of other plants include, but not limited to, barley (*Hordeum vulgare*), Arabidopsis (*Arabidopsis thaliana*), maize (*Zea mays*), cotton (*Gossypium*), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*) and Wheat (*Triticum aestivum*), The above-mentioned analyses for sequence homology is preferably carried out on a full-length sequence, but may also be based on a comparison of certain regions such as conserved domains. The identification of such domains, would also be well within the realm of the person skilled in the art and would involve, for example, a computer readable format of the nucleic acids of some embodiments of the invention, the use of alignment software programs and the use of publicly available information on protein domains, conserved motifs and boxes. This information is available in the PRODOM (Hypertext Transfer Protocol://World Wide Web (dot) biochem (dot) ucl (dot) ac (dot) uk/bsm/db-browser/protocol/prodomqry (dot) html), PIR (Hypertext Transfer Protocol://pir (dot) Georgetown (dot) edu/) or Pfam (Hypertext Transfer Protocol://World Wide Web (dot) sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution Tables are well known in the art [see for example Creighton (1984) Proteins. W.H. Freeman and Company]. Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes described in Table 1 (Example 1 above) were identified from the databases using BLAST software with the Blastp and tBlastn algorithms as filters for the first stage, and the needle (EMBOSS package) or Frame+ algorithm alignment for the second stage. Local identity (Blast alignments) was defined with a very permissive cutoff—60% Identity on a span of 60% of the sequences lengths because it is used only as a filter for the global alignment stage. The default filtering of the Blast package was not utilized (by setting the parameter "-F F").

In the second stage, homologs were defined based on a global identity of at least 80% to the core gene polypeptide sequence.

Two distinct forms for finding the optimal global alignment for protein or nucleotide sequences were used in this application:

1. Between two proteins (following the blastp filter):

EMBOSS-6.0.1 Needleman-Wunsch algorithm with the following modified parameters: gapopen=8 gapextend=2. The rest of the parameters were unchanged from the default options described hereinabove.

2. Between a protein sequence and a nucleotide sequence (following the tblastn filter):

GenCore 6.0 OneModel application utilizing the Frame+ algorithm with the following parameters: model=frame+_p2n.model mode=qglobal -q=protein. sequence -db=nucleotide.sequence. The rest of the parameters were unchanged from the default options described hereinabove.

The query polypeptide sequences were SEQ ID NOs: 470-762 (which are encoded by the polynucleotides SEQ ID NOs:1-469, shown in Table 1 above) and the identified orthologous and homologous sequences having at least 80% global sequence identity are provided in Table 2, below. These homologous (e.g., orthologues) genes are expected to increase plant's NUE, yield, seed yield, oil yield, oil content, growth rate, fiber yield, fiber quality, biomass, vigor, and/or ABST.

TABLE 2

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 763 | LNU521 | arabidopsis_lyrata\|09v1\|JGIAL011856_P1 | 3706 | 470 | 96 | Globlastp |
| 764 | LNU521 | thellungiella_parvulum\|11v1\|BY825857_P1 | 3707 | 470 | 86 | Globlastp |
| 765 | LNU521 | thellungiella_halophilum\|11v1\|BY825857_P1 | 3708 | 470 | 85.6 | Globlastp |
| 766 | LNU521 | canola\|10v1\|EE568814 | 3709 | 470 | 85 | Globlastp |
| 767 | LNU521 | b_rapa\|11v1\|EV189570_P1 | 3710 | 470 | 84.5 | globlastp |
| 768 | LNU522 | arabidopsis_lyrata\|09v1\|JGIAL013830_P1 | 3711 | 471 | 94.7 | globlastp |
| 769 | LNU522 | b_rapa\|11v1\|AM060505_T1 | 3712 | 471 | 81.25 | glotblastn |
| 770 | LNU522 | b_rapa\|gb162\|EX031382 | 3712 | 471 | 81.25 | glotblastn |
| 771 | LNU522 | canola\|10v1\|DY000181 | 3712 | 471 | 81.25 | glotblastn |
| 772 | LNU522 | canola\|11v1\|DY000181_T1 | 3712 | 471 | 81.25 | glotblastn |
| 773 | LNU522 | canola\|11v1\|EE447336_P1 | 3713 | 471 | 81.1 | globlastp |
| 774 | LNU522 | radish\|gb164\|EV526178 | 3714 | 471 | 81.05 | globlastp |
| 775 | LNU522 | canola\|11v1\|EV163574XX1_T1 | 3715 | 471 | 80.73 | glotblastn |
| 776 | LNU522 | b_juncea\|12v1\|E6ANDIZ01B9BTC_P1 | 3716 | 471 | 80.6 | globlastp |
| 777 | LNU522 | b_oleracea\|gb161\|AM060505_P1 | 3717 | 471 | 80.6 | globlastp |
| 778 | LNU522 | canola\|10v1\|EE447336 | 3717 | 471 | 80.6 | globlastp |
| 779 | LNU523 | arabidopsis_lyrata\|09v1\|JGIAL008670_P1 | 3718 | 472 | 95.5 | globlastp |
| 780 | LNU523 | canola\|10v1\|CD822583 | 3719 | 472 | 90.2 | globlastp |
| 781 | LNU523 | canola\|11v1\|DY007804_P1 | 3719 | 472 | 90.2 | globlastp |
| 782 | LNU523 | b_rapa\|11v1\|CD822583_P1 | 3720 | 472 | 89.8 | globlastp |
| 783 | LNU523 | thellungiella_halophilum\|11v1\|EHJGI11003549_P1 | 3721 | 472 | 89.8 | globlastp |
| 784 | LNU523 | thellungiella_parvulum\|11v1\|EPCRP011487_P1 | 3722 | 472 | 89.8 | globlastp |
| 785 | LNU523 | b_rapa\|11v1\|CD836654_T1 | 3723 | 472 | 89.63 | glotblastn |
| 786 | LNU523 | canola\|11v1\|CN827707_T1 | 3724 | 472 | 89.04 | glotblastn |
| 787 | LNU526 | thellungiella_parvulum\|11v1\|BY835088_P1 | 3725 | 474 | 90.2 | globlastp |
| 788 | LNU527 | arabidopsis_lyrata\|09v1\|JGIAL029206_P1 | 3726 | 475 | 96.1 | globlastp |
| 789 | LNU527 | b_rapa\|11v1\|DY003379_P1 | 3727 | 475 | 92.5 | globlastp |
| 790 | LNU527 | canola\|10v1\|DY003379 | 3727 | 475 | 92.5 | globlastp |
| 791 | LNU527 | canola\|11v1\|DY003379_P1 | 3727 | 475 | 92.5 | globlastp |
| 792 | LNU527 | b_rapa\|11v1\|EE474104_P1 | 3728 | 475 | 91.8 | globlastp |
| 793 | LNU527 | b_rapa\|gb162\|EX024903 | 3728 | 475 | 91.8 | globlastp |
| 794 | LNU527 | canola\|11v1\|EE412227XX1_T1 | 3729 | 475 | 90.52 | glotblastn |
| 795 | LNU527 | canola\|11v1\|EE474104_T1 | 3730 | 475 | 89.87 | glotblastn |
| 796 | LNU527 | thellungiella_parvulum\|11v1\|DN776045_P1 | 3731 | 475 | 89.5 | globlastp |
| 797 | LNU527 | b_rapa\|gb162\|CV433835 | 3732 | 475 | 89.5 | globlastp |
| 798 | LNU527 | thellungiella_halophilum\|11v1\|DN776045_P1 | 3733 | 475 | 89.3 | globlastp |
| 799 | LNU527 | b_juncea\|12v1\|E6ANDIZ01CLER6_P1 | 3734 | 475 | 88.2 | globlastp |
| 800 | LNU527 | canola\|11v1\|EE435052_P1 | 3735 | 475 | 88.1 | globlastp |
| 801 | LNU527 | b_rapa\|11v1\|CV433835_P1 | 3736 | 475 | 88 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 802 | LNU527 | canola\|10v1\|EE434954 | 3737 | 475 | 87.7 | globlastp |
| 803 | LNU527 | canola\|11v1\|EE434954_P1 | 3738 | 475 | 87 | globlastp |
| 804 | LNU527 | b_juncea\|12v1\|E6ANDIZ01B6IIX_P1 | 3739 | 475 | 86.6 | globlastp |
| 805 | LNU528 | rye\|12v1\|BE704688_T1 | 3740 | 476 | 98.95 | glotblastn |
| 806 | LNU528 | wheat\|10v2\|BE403967 | 3741 | 476 | 90.5 | globlastp |
| 807 | LNU528 | wheat\|10v2\|BE637785 | 3742 | 476 | 90.5 | globlastp |
| 808 | LNU528 | wheat\|12v3\|BE403967_P1 | 3742 | 476 | 90.5 | globlastp |
| 809 | LNU528 | wheat\|10v2\|BE415930 | 3743 | 476 | 90.3 | globlastp |
| 810 | LNU528 | wheat\|12v3\|AW448105_P1 | 3744 | 476 | 89.2 | globlastp |
| 811 | LNU528 | brachypodium\|09v1\|GT780240 | 3745 | 476 | 88.7 | globlastp |
| 812 | LNU528 | brachypodium\|12v1\|BRADI4G19207_P1 | 3745 | 476 | 88.7 | globlastp |
| 813 | LNU528 | wheat\|12v3\|BE415930_P1 | 3746 | 476 | 87.1 | globlastp |
| 814 | LNU528 | rice\|11v1\|AU222855_P1 | 3747 | 476 | 87 | globlastp |
| 815 | LNU528 | rice\|gb170\|OS11G29380 | 3747 | 476 | 87 | globlastp |
| 816 | LNU528 | foxtail_millet\|11v3\|PHY7SI025993M_P1 | 3748 | 476 | 86.4 | globlastp |
| 817 | LNU528 | sugarcane\|10v1\|CA073499 | 3749 | 476 | 86.4 | globlastp |
| 818 | LNU528 | sorghum\|09v1\|SB0019S004400 | 3750 | 476 | 85.7 | globlastp |
| 819 | LNU528 | sorghum\|12v1\|SB0019S004400_P1 | 3750 | 476 | 85.7 | globlastp |
| 820 | LNU528 | maize\|10v1\|AI601049_P1 | 3751 | 476 | 84.7 | globlastp |
| 821 | LNU528 | banana\|12v1\|MAGEN2012025809_T1 | 3752 | 476 | 82.79 | glotblastn |
| 822 | LNU528 | oak\|10v1\|FP027506_T1 | 3753 | 476 | 81.12 | glotblastn |
| 823 | LNU528 | aquilegia\|10v2\|DR927968_T1 | 3754 | 476 | 80.25 | glotblastn |
| 824 | LNU529 | wheat\|10v2\|BE217016 | 3755 | 477 | 93.1 | globlastp |
| 825 | LNU529 | wheat\|12v3\|BE400155_P1 | 3755 | 477 | 93.1 | globlastp |
| 826 | LNU529 | wheat\|12v3\|BE515687_P1 | 3756 | 477 | 92 | globlastp |
| 827 | LNU529 | leymus\|gb166\|CD808904_P1 | 3757 | 477 | 92 | globlastp |
| 828 | LNU529 | rye\|12v1\|DRR001012.103220_P1 | 3758 | 477 | 91.6 | globlastp |
| 829 | LNU529 | rye\|12v1\|DRR001012.105351_P1 | 3759 | 477 | 91.6 | globlastp |
| 830 | LNU529 | rye\|12v1\|DRR001012.118853_T1 | 3760 | 477 | 91.6 | glotblastn |
| 831 | LNU529 | rye\|12v1\|DRR001012.127368_T1 | 3761 | 477 | 91.22 | glotblastn |
| 832 | LNU529 | pseudoroegneria\|gb167\|FF350026 | 3762 | 477 | 91.2 | globlastp |
| 833 | LNU529 | wheat\|10v2\|BE515687 | 3763 | 477 | 91.2 | globlastp |
| 834 | LNU529 | barley\|10v2\|BE412477 | 3764 | 477 | 90.5 | globlastp |
| 835 | LNU529 | rye\|12v1\|DRR001012.101401_P1 | 3765 | 477 | 89.3 | globlastp |
| 836 | LNU529 | rye\|12v1\|DRR001012.181262_T1 | 3766 | 477 | 88.59 | glotblastn |
| 837 | LNU529 | brachypodium\|09v1\|DV471515 | 3767 | 477 | 88.2 | globlastp |
| 838 | LNU529 | brachypodium\|12v1\|BRADI2G11000_P1 | 3767 | 477 | 88.2 | globlastp |
| 839 | LNU529 | lolium\|10v1\|DT671619_P1 | 3768 | 477 | 85.9 | globlastp |
| 840 | LNU529 | oat\|11v1\|CN821392_P1 | 3769 | 477 | 85.5 | globlastp |
| 841 | LNU529 | oat\|10v2\|CN821392 | 3769 | 477 | 85.5 | globlastp |
| 842 | LNU529 | sugarcane\|10v1\|CA077887 | 3770 | 477 | 83.8 | globlastp |
| 843 | LNU529 | sorghum\|09v1\|SB03G011540 | 3771 | 477 | 83.4 | globlastp |
| 844 | LNU529 | sorghum\|12v1\|SB03G011540_P1 | 3771 | 477 | 83.4 | globlastp |
| 845 | LNU529 | barley\|12v1\|BE412477_P1 | 3772 | 477 | 83.3 | globlastp |
| 846 | LNU529 | foxtail_millet\|11v3\|PHY7SI002591M_P1 | 3773 | 477 | 81.9 | globlastp |
| 847 | LNU529 | foxtail_millet\|10v2\|SICRP007530 | 3773 | 477 | 81.9 | globlastp |
| 848 | LNU529 | millet\|10v1\|EVO454PM007426_P1 | 3774 | 477 | 81.9 | globlastp |
| 849 | LNU529 | switchgrass\|gb167\|FE643848 | 3775 | 477 | 81.9 | globlastp |
| 850 | LNU529 | rice\|11v1\|AA231827_P1 | 3776 | 477 | 81.5 | globlastp |
| 851 | LNU529 | rice\|gb170\|OS01G18070 | 3776 | 477 | 81.5 | globlastp |
| 852 | LNU529 | switchgrass\|gb167\|DN142615 | 3777 | 477 | 81.5 | globlastp |
| 853 | LNU529 | maize\|10v1\|AA979925_P1 | 3778 | 477 | 81.1 | globlastp |
| 854 | LNU529 | maize\|10v1\|AW497454_P1 | 3779 | 477 | 81.1 | globlastp |
| 855 | LNU530 | wheat\|12v3\|BF202847_P1 | 3780 | 478 | 96.3 | globlastp |
| 856 | LNU530 | rye\|12v1\|DRR001012.906444_P1 | 3781 | 478 | 96 | globlastp |
| 857 | LNU530 | barley\|12v1\|BF627583_T1 | 3782 | 478 | 92.06 | glotblastn |
| 858 | LNU530 | sorghum\|09v1\|SB04G007160 | 3783 | 478 | 85.33 | glotblastn |
| 859 | LNU530 | sorghum\|12v1\|SB04G007160_T1 | 3783 | 478 | 85.33 | glotblastn |
| 860 | LNU530 | rice\|11v1\|BI801350_P1 | 3784 | 478 | 84.2 | globlastp |
| 861 | LNU530 | rice\|gb170\|OS02G11040 | 3784 | 478 | 84.2 | globlastp |
| 862 | LNU530 | maize\|10v1\|CF624912_P1 | 3785 | 478 | 83.5 | globlastp |
| 863 | LNU530 | switchgrass\|gb167\|FL826783 | 3786 | 478 | 82.9 | globlastp |
| 864 | LNU530 | foxtail_millet\|11v3\|PHY7SI017538M_T1 | 3787 | 478 | 80.95 | glotblastn |
| 865 | LNU531 | leymus\|gb166\|EG379051_P1 | 3788 | 479 | 96.7 | globlastp |
| 866 | LNU531 | wheat\|12v3\|CA500252_P1 | 3789 | 479 | 95.8 | globlastp |
| 867 | LNU531 | wheat\|10v2\|BE422660 | 3790 | 479 | 95.4 | globlastp |
| 868 | LNU531 | rye\|12v1\|BF145612_P1 | 3791 | 479 | 89.6 | globlastp |
| 869 | LNU531 | brachypodium\|09v1\|DV474726 | 3792 | 479 | 89.6 | globlastp |
| 870 | LNU531 | brachypodium\|12v1\|BRADI1G72110_P1 | 3792 | 479 | 89.6 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 871 | LNU531 | rice\|11v1\|CA758750_T1 | 3793 | 479 | 84.02 | glotblastn |
| 872 | LNU531 | rice\|11v1\|BI805039_P1 | 3794 | 479 | 84 | globlastp |
| 873 | LNU531 | rice\|gb170\|OS03G08790 | 3794 | 479 | 84 | globlastp |
| 874 | LNU531 | foxtail_millet\|11v3\|PHY7SI035816M_P1 | 3795 | 479 | 83.1 | globlastp |
| 875 | LNU531 | switchgrass\|gb167\|FE622389 | 3796 | 479 | 82.1 | globlastp |
| 876 | LNU531 | maize\|10v1\|BI319232_P1 | 3797 | 479 | 81.8 | globlastp |
| 877 | LNU531 | switchgrass\|gb167\|DN146903 | 3798 | 479 | 81.3 | globlastp |
| 878 | LNU532 | wheat\|12v3\|BM137240_P1 | 3799 | 480 | 94.3 | globlastp |
| 879 | LNU532 | rye\|12v1\|DRR001012.190950_P1 | 3800 | 480 | 88.3 | globlastp |
| 880 | LNU532 | brachypodium\|09v1\|DV478754 | 3801 | 480 | 81 | globlastp |
| 881 | LNU532 | brachypodium\|12v1\|BRADI2G23740_P1 | 3801 | 480 | 81 | globlastp |
| 882 | LNU534 | wheat\|12v3\|BG908725_P1 | 3802 | 482 | 98.3 | globlastp |
| 883 | LNU534 | rye\|12v1\|DRR001012.105981_P1 | 3803 | 482 | 98 | globlastp |
| 884 | LNU534 | wheat\|12v3\|BG905267_P1 | 3804 | 482 | 97.8 | globlastp |
| 885 | LNU534 | brachypodium\|09v1\|GT772563 | 3805 | 482 | 92.7 | globlastp |
| 886 | LNU534 | brachypodium\|12v1\|BRADI1G66480_P1 | 3805 | 482 | 92.7 | globlastp |
| 887 | LNU534 | rice\|11v1\|OSPRD054241_P1 | 3806 | 482 | 86.8 | globlastp |
| 888 | LNU534 | rice\|11v1\|BE229509_P1 | 3806 | 482 | 86.8 | globlastp |
| 889 | LNU534 | rice\|gb170\|OS03G16910 | 3806 | 482 | 86.8 | globlastp |
| 890 | LNU534 | sorghum\|09v1\|SB01G039400 | 3807 | 482 | 86 | globlastp |
| 891 | LNU534 | sorghum\|12v1\|SB01G039400_P1 | 3807 | 482 | 86 | globlastp |
| 892 | LNU534 | foxtail_millet\|11v3\|PHY7SI037806M_P1 | 3808 | 482 | 85.5 | globlastp |
| 893 | LNU534 | maize\|10v1\|AI615129_P1 | 3809 | 482 | 85.3 | globlastp |
| 894 | LNU534 | foxtail_millet\|10v2\|SICRP006750 | 3810 | 482 | 83.05 | glotblastn |
| 895 | LNU534 | maize\|10v1\|AW433478_P1 | 3811 | 482 | 82.4 | globlastp |
| 896 | LNU536 | rye\|12v1\|DRR001012.298753_P1 | 3812 | 483 | 93.2 | globlastp |
| 897 | LNU536 | wheat\|10v2\|BE471233 | 3813 | 483 | 92.7 | globlastp |
| 898 | LNU536 | wheat\|10v2\|BE403843 | 3814 | 483 | 91.5 | globlastp |
| 899 | LNU536 | wheat\|12v3\|BE403843_P1 | 3814 | 483 | 91.5 | globlastp |
| 900 | LNU536 | brachypodium\|09v1\|DV469028 | 3815 | 483 | 80.7 | globlastp |
| 901 | LNU536 | brachypodium\|12v1\|BRADI3G06280_P1 | 3815 | 483 | 80.7 | globlastp |
| 902 | LNU537 | rye\|12v1\|BQ160007_P1 | 3816 | 484 | 98.2 | globlastp |
| 903 | LNU537 | rye\|12v1\|DRR001012.111268_P1 | 3816 | 484 | 98.2 | globlastp |
| 904 | LNU537 | rye\|12v1\|BE494448_P1 | 3817 | 484 | 97.7 | globlastp |
| 905 | LNU537 | wheat\|12v3\|BE404957_P1 | 3818 | 484 | 97.1 | globlastp |
| 906 | LNU537 | wheat\|10v2\|BE400302 | 3819 | 484 | 96.9 | globlastp |
| 907 | LNU537 | brachypodium\|09v1\|DV471858 | 3820 | 484 | 87.2 | globlastp |
| 908 | LNU537 | brachypodium\|12v1\|BRADI1G42720_P1 | 3820 | 484 | 87.2 | globlastp |
| 909 | LNU537 | rice\|11v1\|AU065537_P1 | 3821 | 484 | 83 | globlastp |
| 910 | LNU537 | rice\|gb170\|OS06G21390 | 3821 | 484 | 83 | globlastp |
| 911 | LNU537 | foxtail_millet\|11v3\|PHY7SI006709M_P1 | 3822 | 484 | 81.7 | globlastp |
| 912 | LNU537 | maize\|10v1\|T15337_P1 | 3823 | 484 | 81.5 | globlastp |
| 913 | LNU537 | millet\|10v1\|EVO454PM067843_P1 | 3824 | 484 | 81.2 | globlastp |
| 914 | LNU537 | sorghum\|09v1\|SB10G012170 | 3825 | 484 | 81.2 | globlastp |
| 915 | LNU537 | sorghum\|12v1\|SB10G012170_P1 | 3825 | 484 | 81.2 | globlastp |
| 916 | LNU539 | rye\|12v1\|DRR001012.110371_P1 | 3826 | 485 | 94 | globlastp |
| 917 | LNU539 | wheat\|10v2\|BE414043 | 3827 | 485 | 94 | globlastp |
| 918 | LNU539 | wheat\|12v3\|BE414043_P1 | 3828 | 485 | 92.2 | globlastp |
| 919 | LNU539 | brachypodium\|09v1\|SRR031795S0047496 | 3829 | 485 | 81.2 | globlastp |
| 920 | LNU539 | brachypodium\|12v1\|BRADI1G77200_P1 | 3829 | 485 | 81.2 | globlastp |
| 921 | LNU540 | wheat\|12v3\|BE429724_P1 | 3830 | 486 | 88.8 | globlastp |
| 922 | LNU540 | wheat\|10v2\|BG606850 | 3831 | 486 | 87.6 | globlastp |
| 923 | LNU540 | rye\|12v1\|DRR001012.118640_P1 | 3832 | 486 | 87 | globlastp |
| 924 | LNU540 | leymus\|gb166\|EG376546_P1 | 3833 | 486 | 86.1 | globlastp |
| 925 | LNU540 | pseudoroegneria\|gb167\|FF339894 | 3834 | 486 | 85.2 | globlastp |
| 926 | LNU542 | wheat\|12v3\|BE405468_P1 | 3835 | 487 | 97.4 | globlastp |
| 927 | LNU542 | wheat\|12v3\|BE406424_P1 | 3836 | 487 | 96.5 | globlastp |
| 928 | LNU542 | wheat\|10v2\|BE405468 | 3837 | 487 | 96.5 | globlastp |
| 929 | LNU542 | brachypodium\|09v1\|DV470141 | 3838 | 487 | 90.9 | globlastp |
| 930 | LNU542 | brachypodium\|12v1\|BRADI2G43690_P1 | 3838 | 487 | 90.9 | globlastp |
| 931 | LNU542 | oat\|10v2\|CN818111 | 3839 | 487 | 89.7 | globlastp |
| 932 | LNU542 | oat\|11v1\|GO596959_P1 | 3840 | 487 | 88 | globlastp |
| 933 | LNU542 | wheat\|12v3\|BE402739_P1 | 3841 | 487 | 86.1 | globlastp |
| 934 | LNU542 | rice\|11v1\|AA753238_P1 | 3842 | 487 | 86 | globlastp |
| 935 | LNU542 | rice\|gb170\|OS01G43090 | 3842 | 487 | 86 | globlastp |
| 936 | LNU542 | switchgrass\|gb167\|DN150344 | 3843 | 487 | 86 | globlastp |
| 937 | LNU542 | wheat\|10v2\|BE402739 | 3844 | 487 | 85.8 | globlastp |
| 938 | LNU542 | switchgrass\|gb167\|FE601989 | 3845 | 487 | 84.9 | globlastp |
| 939 | LNU542 | oat\|11v1\|CN817126_P1 | 3846 | 487 | 84.5 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 940 | LNU542 | oat\|10v2\|GR339504 | 3846 | 487 | 84.5 | globlastp |
| 941 | LNU542 | sorghum\|09v1\|SB03G028060 | 3847 | 487 | 82.3 | globlastp |
| 942 | LNU542 | sorghum\|12v1\|SB03G028060_P1 | 3847 | 487 | 82.3 | globlastp |
| 943 | LNU542 | foxtail_millet\|10v2\|SICRP022640 | 3848 | 487 | 82 | globlastp |
| 944 | LNU542 | maize\|10v1\|AI612461_P1 | 3849 | 487 | 82 | globlastp |
| 945 | LNU542 | foxtail_millet\|11v3\|PHY7SI002084M_P1 | 3850 | 487 | 81.7 | globlastp |
| 946 | LNU542 | foxtail_millet\|11v3\|PHY7SI022559M_P1 | 3851 | 487 | 80.5 | globlastp |
| 947 | LNU542 | sorghum\|09v1\|SB03G028020 | 3852 | 487 | 80.5 | globlastp |
| 948 | LNU542 | sorghum\|12v1\|SB03G028020_P1 | 3852 | 487 | 80.5 | globlastp |
| 949 | LNU542 | sorghum\|09v1\|SB03G028050 | 3853 | 487 | 80.2 | globlastp |
| 950 | LNU542 | sorghum\|12v1\|SB03G028050_P1 | 3853 | 487 | 80.2 | globlastp |
| 951 | LNU542 | switchgrass\|gb167\|FE652777 | 3854 | 487 | 80.2 | globlastp |
| 952 | LNU543 | wheat\|10v2\|BE399816 | 3855 | 488 | 98.1 | globlastp |
| 953 | LNU543 | wheat\|12v3\|BE399816_P1 | 3855 | 488 | 98.1 | globlastp |
| 954 | LNU543 | brachypodium\|09v1\|SRR031795S0032234 | 3856 | 488 | 89.1 | globlastp |
| 955 | LNU543 | brachypodium\|12v1\|BRADI2G50650_P1 | 3856 | 488 | 89.1 | globlastp |
| 956 | LNU543 | foxtail_millet\|11v3\|PHY7SI003425M_P1 | 3857 | 488 | 86.4 | globlastp |
| 957 | LNU543 | foxtail_millet\|10v2\|SICRP004867 | 3857 | 488 | 86.4 | globlastp |
| 958 | LNU544 | rye\|12v1\|BE705783_P1 | 3858 | 489 | 95.9 | globlastp |
| 959 | LNU544 | rye\|12v1\|BE494084_P1 | 3859 | 489 | 95.7 | globlastp |
| 960 | LNU544 | wheat\|12v3\|BE404717_P1 | 3860 | 489 | 95.7 | globlastp |
| 961 | LNU544 | wheat\|12v3\|BF201478_P1 | 3861 | 489 | 95.7 | globlastp |
| 962 | LNU544 | wheat\|10v2\|BE404717 | 3862 | 489 | 95.4 | globlastp |
| 963 | LNU544 | wheat\|12v3\|BE404827_P1 | 3863 | 489 | 95.2 | globlastp |
| 964 | LNU544 | oat\|11v1\|CN820566_P1 | 3864 | 489 | 89.1 | globlastp |
| 965 | LNU544 | oat\|10v2\|CN820566 | 3864 | 489 | 89.1 | globlastp |
| 966 | LNU544 | rice\|11v1\|CK036840_P1 | 3865 | 489 | 85.2 | globlastp |
| 967 | LNU544 | rice\|11v1\|BE229968_P1 | 3865 | 489 | 85.2 | globlastp |
| 968 | LNU544 | rice\|gb170\|OS03G07530 | 3865 | 489 | 85.2 | globlastp |
| 969 | LNU544 | sorghum\|09v1\|SB01G045700 | 3866 | 489 | 84.1 | globlastp |
| 970 | LNU544 | sorghum\|12v1\|SB01G045700_P1 | 3866 | 489 | 84.1 | globlastp |
| 971 | LNU544 | switchgrass\|gb167\|DN141119 | 3867 | 489 | 84.1 | globlastp |
| 972 | LNU544 | sugarcane\|10v1\|BQ533229 | 3868 | 489 | 83.8 | globlastp |
| 973 | LNU544 | foxtail_millet\|11v3\|EC612137_P1 | 3869 | 489 | 82.9 | globlastp |
| 974 | LNU544 | foxtail_millet\|11v3\|PHY7SI035825M_P1 | 3869 | 489 | 82.9 | globlastp |
| 975 | LNU544 | maize\|10v1\|AI619266_P1 | 3870 | 489 | 82.2 | globlastp |
| 976 | LNU544 | maize\|10v1\|AI586700_P1 | 3871 | 489 | 81.3 | globlastp |
| 977 | LNU544 | millet\|10v1\|EVO454PM005418_P1 | 3872 | 489 | 81.3 | globlastp |
| 978 | LNU545 | wheat\|12v3\|BE443515_P1 | 3873 | 490 | 95 | globlastp |
| 979 | LNU545 | pseudoroegneria\|gb167\|FF344885 | 3874 | 490 | 93.6 | globlastp |
| 980 | LNU545 | brachypodium\|09v1\|DV479563 | 3875 | 490 | 82.5 | globlastp |
| 981 | LNU545 | brachypodium\|12v1\|BRADI1G75730_P1 | 3875 | 490 | 82.5 | globlastp |
| 982 | LNU547 | wheat\|10v2\|BE442903 | 3876 | 492 | 92.3 | globlastp |
| 983 | LNU547 | wheat\|12v3\|BE442903_P1 | 3876 | 492 | 92.3 | globlastp |
| 984 | LNU547 | rye\|12v1\|DRR001016.111179_T1 | 3877 | 492 | 91.35 | glotblastn |
| 985 | LNU547 | rye\|12v1\|DRR001013.120152_P1 | 3878 | 492 | 90.4 | globlastp |
| 986 | LNU547 | oat\|11v1\|GO583410_P1 | 3879 | 492 | 85.8 | globlastp |
| 987 | LNU547 | oat\|10v2\|GO583410 | 3879 | 492 | 85.8 | globlastp |
| 988 | LNU547 | brachypodium\|09v1\|GT761541 | 3880 | 492 | 84.9 | globlastp |
| 989 | LNU547 | brachypodium\|12v1\|BRADI1G19850_P1 | 3880 | 492 | 84.9 | globlastp |
| 990 | LNU547 | oat\|11v1\|GO598248_P1 | 3881 | 492 | 83 | globlastp |
| 991 | LNU547 | fescue\|gb161\|DT706039_P1 | 3882 | 492 | 83 | globlastp |
| 992 | LNU548 | rye\|12v1\|DRR001012.101811_P1 | 3883 | 493 | 99.6 | globlastp |
| 993 | LNU548 | rye\|12v1\|DRR001012.111969_P1 | 3883 | 493 | 99.6 | globlastp |
| 994 | LNU548 | rye\|12v1\|DRR001013.108696_P1 | 3884 | 493 | 99.6 | globlastp |
| 995 | LNU548 | wheat\|12v3\|CA650034_P1 | 3885 | 493 | 99.2 | globlastp |
| 996 | LNU548 | wheat\|10v2\|BQ168833 | 3885 | 493 | 99.2 | globlastp |
| 997 | LNU548 | wheat\|10v2\|CA638240 | 3886 | 493 | 99.2 | globlastp |
| 998 | LNU548 | wheat\|12v3\|CK166495_P1 | 3887 | 493 | 93.3 | globlastp |
| 999 | LNU548 | brachypodium\|09v1\|DV476809 | 3888 | 493 | 92.5 | globlastp |
| 1000 | LNU548 | brachypodium\|12v1\|BRADI5G21650_P1 | 3888 | 493 | 92.5 | globlastp |
| 1001 | LNU548 | rice\|11v1\|AU032133_P1 | 3889 | 493 | 91.3 | globlastp |
| 1002 | LNU548 | rice\|gb170\|OS04G52370 | 3890 | 493 | 90.9 | globlastp |
| 1003 | LNU548 | foxtail_millet\|10v2\|SICRP020027 | 3891 | 493 | 90.5 | globlastp |
| 1004 | LNU548 | switchgrass\|gb167\|FE618588 | 3892 | 493 | 90.3 | globlastp |
| 1005 | LNU548 | millet\|10v1\|EVO454PM001511_P1 | 3893 | 493 | 90.1 | globlastp |
| 1006 | LNU548 | maize\|10v1\|AW067011_P1 | 3894 | 493 | 89.9 | globlastp |
| 1007 | LNU548 | sorghum\|09v1\|SB06G028340 | 3895 | 493 | 89.86 | glotblastn |
| 1008 | LNU548 | sugarcane\|10v1\|BU925837 | 3896 | 493 | 89.7 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1009 | LNU548 | maize\|10v1\|AI396014_P1 | 3897 | 493 | 88.7 | globlastp |
| 1010 | LNU548 | rice\|11v1\|AU029638_P1 | 3898 | 493 | 86.4 | globlastp |
| 1011 | LNU548 | rice\|gb170\|OS08G10600 | 3898 | 493 | 86.4 | globlastp |
| 1012 | LNU548 | wheat\|12v3\|CA650182_P1 | 3899 | 493 | 86.2 | globlastp |
| 1013 | LNU548 | *brachypodium*\|09v1\|DV474137 | 3900 | 493 | 86 | globlastp |
| 1014 | LNU548 | *brachypodium*\|12v1\|BRADI3G17870T2_P1 | 3900 | 493 | 86 | globlastp |
| 1015 | LNU548 | foxtail_millet\|11v3\|PHY7SI013631M_P1 | 3901 | 493 | 85.6 | globlastp |
| 1016 | LNU548 | *sorghum*\|09v1\|SB07G006040 | 3902 | 493 | 85.2 | globlastp |
| 1017 | LNU548 | *sorghum*\|12v1\|SB07G006040P1_P1 | 3902 | 493 | 85.2 | globlastp |
| 1018 | LNU548 | maize\|10v1\|CD941513_P1 | 3903 | 493 | 84.8 | globlastp |
| 1019 | LNU548 | *sorghum*\|12v1\|SB06G028340_P1 | 3904 | 493 | 84.4 | globlastp |
| 1020 | LNU548 | oil_palm\|11v1\|EY406859_T1 | 3905 | 493 | 81.95 | glotblastn |
| 1021 | LNU548 | banana\|12v1\|FF560869_P1 | 3906 | 493 | 81.5 | globlastp |
| 1022 | LNU548 | banana\|12v1\|ES432344_P1 | 3907 | 493 | 81 | globlastp |
| 1023 | LNU549 | *leymus*\|gb166\|EG375412_P1 | 3908 | 494 | 98.8 | globlastp |
| 1024 | LNU549 | *pseudoroegneria*\|gb167\|FF342935 | 3909 | 494 | 98.8 | globlastp |
| 1025 | LNU549 | rye\|12v1\|DRR001012.284440_T1 | 3910 | 494 | 98.15 | glotblastn |
| 1026 | LNU549 | rye\|12v1\|DRR001012.155376_P1 | 3911 | 494 | 98.1 | globlastp |
| 1027 | LNU549 | wheat\|10v2\|BE405006XX1 | 3912 | 494 | 98.1 | globlastp |
| 1028 | LNU549 | wheat\|10v2\|BE442900 | 3913 | 494 | 98.1 | globlastp |
| 1029 | LNU549 | wheat\|12v3\|BE405006_P1 | 3913 | 494 | 98.1 | globlastp |
| 1030 | LNU549 | rye\|12v1\|DRR001017.1102065_P1 | 3914 | 494 | 97.5 | globlastp |
| 1031 | LNU549 | rye\|12v1\|DRR001013.141827_P1 | 3915 | 494 | 95.7 | globlastp |
| 1032 | LNU549 | *brachypodium*\|09v1\|DV470708 | 3916 | 494 | 90.2 | globlastp |
| 1033 | LNU549 | *brachypodium*\|12v1\|BRADI3G58240_P1 | 3916 | 494 | 90.2 | globlastp |
| 1034 | LNU549 | rice\|11v1\|D23959_P1 | 3917 | 494 | 90.1 | globlastp |
| 1035 | LNU549 | rice\|gb170\|OS02G52314 | 3917 | 494 | 90.1 | globlastp |
| 1036 | LNU549 | *sorghum*\|09v1\|SB04G033920 | 3918 | 494 | 87.7 | globlastp |
| 1037 | LNU549 | *sorghum*\|12v1\|SB04G033920_P1 | 3918 | 494 | 87.7 | globlastp |
| 1038 | LNU549 | oat\|10v2\|CN816552 | 3919 | 494 | 87.5 | globlastp |
| 1039 | LNU549 | sugarcane\|10v1\|BU103298 | 3920 | 494 | 87 | globlastp |
| 1040 | LNU549 | foxtail_millet\|11v3\|PHY7SI018541M_P1 | 3921 | 494 | 86.4 | globlastp |
| 1041 | LNU549 | foxtail_millet\|10v2\|FXTRMSLX00500849D1 | 3921 | 494 | 86.4 | globlastp |
| 1042 | LNU549 | maize\|10v1\|AI977810_P1 | 3922 | 494 | 85.8 | globlastp |
| 1043 | LNU549 | millet\|10v1\|CD726151_P1 | 3923 | 494 | 85.8 | globlastp |
| 1044 | LNU549 | *cynodon*\|10v1\|ES305036_P1 | 3924 | 494 | 85.2 | globlastp |
| 1045 | LNU549 | switchgrass\|gb167\|FE599686 | 3925 | 494 | 85.2 | globlastp |
| 1046 | LNU549 | switchgrass\|gb167\|DN145526 | 3926 | 494 | 84.8 | globlastp |
| 1047 | LNU550 | rye\|12v1\|DRR001012.12795_P1 | 3927 | 495 | 95.4 | globlastp |
| 1048 | LNU550 | *pseudoroegneria*\|gb167\|FF363837 | 3928 | 495 | 94.6 | globlastp |
| 1049 | LNU550 | wheat\|10v2\|BF474491 | 3929 | 495 | 94.2 | globlastp |
| 1050 | LNU550 | wheat\|12v3\|BF474491_P1 | 3929 | 495 | 94.2 | globlastp |
| 1051 | LNU550 | oat\|11v1\|GR319267_P1 | 3930 | 495 | 91.2 | globlastp |
| 1052 | LNU550 | oat\|10v2\|GR319267 | 3930 | 495 | 91.2 | globlastp |
| 1053 | LNU550 | *brachypodium*\|12v1\|BRADI1G75262_P1 | 3931 | 495 | 90.5 | globlastp |
| 1054 | LNU550 | rice\|11v1\|GFXAC090485X11_P1 | 3932 | 495 | 88.3 | globlastp |
| 1055 | LNU550 | rice\|gb170\|OS03G05320 | 3932 | 495 | 88.3 | globlastp |
| 1056 | LNU550 | *sorghum*\|09v1\|SB01G047110 | 3933 | 495 | 87.6 | globlastp |
| 1057 | LNU550 | *sorghum*\|12v1\|SB01G047110_P1 | 3933 | 495 | 87.6 | globlastp |
| 1058 | LNU550 | foxtail_millet\|11v3\|PHY7SI038987M_P1 | 3934 | 495 | 86.7 | globlastp |
| 1059 | LNU550 | foxtail_millet\|10v2\|FXTRMSLX00620851 | 3934 | 495 | 86.7 | globlastp |
| 1060 | LNU550 | maize\|10v1\|BM378914_P1 | 3935 | 495 | 85.4 | globlastp |
| 1061 | LNU553 | rye\|12v1\|DRR001012.152122_P1 | 3936 | 497 | 93.2 | globlastp |
| 1062 | LNU553 | oat\|11v1\|GO588728_P1 | 3937 | 497 | 90.9 | globlastp |
| 1063 | LNU553 | oat\|10v2\|GO588728 | 3937 | 497 | 90.9 | globlastp |
| 1064 | LNU553 | wheat\|12v3\|BJ227092_T1 | 3938 | 497 | 80.67 | glotblastn |
| 1065 | LNU554 | *pseudoroegneria*\|gb167\|FF353028 | 3939 | 498 | 94.3 | globlastp |
| 1066 | LNU554 | wheat\|10v2\|BE398941 | 3940 | 498 | 93.2 | globlastp |
| 1067 | LNU554 | rye\|12v1\|DRR001012.101032_P1 | 3941 | 498 | 91.7 | globlastp |
| 1068 | LNU554 | rye\|12v1\|DRR001012.310041_P1 | 3942 | 498 | 91.5 | globlastp |
| 1069 | LNU554 | oat\|11v1\|GO589328_P1 | 3943 | 498 | 83.6 | globlastp |
| 1070 | LNU554 | oat\|10v2\|GO589328 | 3943 | 498 | 83.6 | globlastp |
| 1071 | LNU554 | *brachypodium*\|09v1\|GT759275 | 3944 | 498 | 82.2 | globlastp |
| 1072 | LNU554 | *brachypodium*\|12v1\|BRADI1G37220_P1 | 3944 | 498 | 82.2 | globlastp |
| 1073 | LNU554 | wheat\|10v2\|CA593742 | 3945 | 498 | 82.05 | glotblastn |
| 1074 | LNU554 | wheat\|12v3\|CA593742_P1 | 3946 | 498 | 81.5 | globlastp |
| 1075 | LNU554 | rye\|12v1\|DRR001012.589560_P1 | 3947 | 498 | 80.9 | globlastp |
| 1076 | LNU554 | wheat\|12v3\|BE398941_P1 | 3948 | 498 | 80.6 | globlastp |
| 1077 | LNU555 | wheat\|12v3\|BE490516_T1 | 3949 | 499 | 93.01 | glotblastn |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1078 | LNU555 | wheat\|10v2\|BE403443 | 3950 | 499 | 92.6 | globlastp |
| 1079 | LNU555 | rye\|12v1\|DRR001012.115863_P1 | 3951 | 499 | 92.1 | globlastp |
| 1080 | LNU556 | rye\|12v1\|BQ160634_P1 | 3952 | 500 | 91.2 | globlastp |
| 1081 | LNU556 | foxtail_millet\|11v3\|PHY7SI019277M_P1 | 3953 | 500 | 82.9 | globlastp |
| 1082 | LNU556 | rice\|11v1\|CB642844_T1 | 3954 | 500 | 81.07 | glotblastn |
| 1083 | LNU556 | rice\|gb170\|OS07G23120 | 3954 | 500 | 81.07 | glotblastn |
| 1084 | LNU557 | rye\|12v1\|BF145773_P1 | 3955 | 501 | 87.1 | globlastp |
| 1085 | LNU557 | rye\|12v1\|DRR001012.107682_P1 | 3955 | 501 | 87.1 | globlastp |
| 1086 | LNU557 | wheat\|12v3\|BE446316_P1 | 3956 | 501 | 86.9 | globlastp |
| 1087 | LNU557 | rye\|gb164\|BF145773 | 3957 | 501 | 85.88 | globlastn |
| 1088 | LNU557 | rye\|12v1\|DRR001012.322408_P1 | 3958 | 501 | 84.7 | globlastp |
| 1089 | LNU557 | wheat\|10v2\|BE446316XX1 | 3959 | 501 | 84.5 | globlastp |
| 1090 | LNU557 | wheat\|12v3\|BQ162466_P1 | 3960 | 501 | 82.1 | globlastp |
| 1091 | LNU557 | barley\|12v1\|CV057311_P1 | 3961 | 501 | 80.2 | globlastp |
| 1092 | LNU558 | wheat\|10v2\|BF291319 | 3962 | 502 | 97.8 | globlastp |
| 1093 | LNU558 | wheat\|12v3\|BQ236771_P1 | 3963 | 502 | 97.8 | globlastp |
| 1094 | LNU558 | rye\|12v1\|BE496036_P1 | 3964 | 502 | 97.5 | globlastp |
| 1095 | LNU558 | rye\|12v1\|BQ160050_P1 | 3964 | 502 | 97.5 | globlastp |
| 1096 | LNU558 | rye\|12v1\|DRR001012.111967_P1 | 3964 | 502 | 97.5 | globlastp |
| 1097 | LNU558 | leymus\|gb166\|EG374728_P1 | 3965 | 502 | 96.9 | globlastp |
| 1098 | LNU558 | brachypodium\|09v1\|DV469495 | 3966 | 502 | 86.9 | globlastp |
| 1099 | LNU558 | brachypodium\|12v1\|BRADI4G03420_P1 | 3966 | 502 | 86.9 | globlastp |
| 1100 | LNU558 | foxtail_millet\|11v3\|PHY7SI021643M_P1 | 3967 | 502 | 85.8 | globlastp |
| 1101 | LNU558 | rice\|11v1\|BI795604_P1 | 3968 | 502 | 85.5 | globlastp |
| 1102 | LNU558 | rice\|gb170\|OS12G39420 | 3968 | 502 | 85.5 | globlastp |
| 1103 | LNU558 | millet\|10v1\|EVO454PM002369_P1 | 3969 | 502 | 85.3 | globlastp |
| 1104 | LNU558 | switchgrass\|gb167\|FE644040 | 3970 | 502 | 85.3 | globlastp |
| 1105 | LNU558 | sorghum\|09v1\|SB08G019580 | 3971 | 502 | 83.6 | globlastp |
| 1106 | LNU558 | sorghum\|12v1\|SB08G019580_P1 | 3971 | 502 | 83.6 | globlastp |
| 1107 | LNU558 | maize\|10v1\|AW066943_P1 | 3972 | 502 | 83.2 | globlastp |
| 1108 | LNU559 | rye\|12v1\|DRR001012.103862_P1 | 3973 | 503 | 96.3 | globlastp |
| 1109 | LNU559 | wheat\|12v3\|CA700183_P1 | 3974 | 503 | 93.6 | globlastp |
| 1110 | LNU559 | lolium\|10v1\|AU246050_P1 | 3975 | 503 | 88.2 | globlastp |
| 1111 | LNU559 | brachypodium\|12v1\|BRADI5G12720_P1 | 3976 | 503 | 80.9 | globlastp |
| 1112 | LNU559 | brachypodium\|09v1\|GT761677 | 3976 | 503 | 80.9 | globlastp |
| 1113 | LNU560 | wheat\|10v2\|BE427996 | 3977 | 504 | 95.9 | globlastp |
| 1114 | LNU560 | wheat\|10v2\|BE403224 | 3978 | 504 | 95.3 | globlastp |
| 1115 | LNU560 | wheat\|12v3\|BE403224_P1 | 3979 | 504 | 95 | globlastp |
| 1116 | LNU560 | wheat\|12v3\|BQ619848_P1 | 3980 | 504 | 95 | globlastp |
| 1117 | LNU560 | rye\|12v1\|DRR001012.30309_P1 | 3981 | 504 | 94.4 | globlastp |
| 1118 | LNU560 | oat\|10v2\|GR313071 | 3982 | 504 | 89.7 | globlastp |
| 1119 | LNU560 | brachypodium\|09v1\|DV472311 | 3983 | 504 | 88.8 | globlastp |
| 1120 | LNU560 | brachypodium\|12v1\|BRADI5G19240_P1 | 3983 | 504 | 88.8 | globlastp |
| 1121 | LNU560 | rice\|11v1\|BI812597_P1 | 3984 | 504 | 85.6 | globlastp |
| 1122 | LNU560 | rice\|gb170\|OS04G49194 | 3985 | 504 | 85.3 | globlastp |
| 1123 | LNU560 | sorghum\|09v1\|SB06G026330 | 3986 | 504 | 80.2 | globlastp |
| 1124 | LNU560 | sorghum\|12v1\|SB06G026330_P1 | 3986 | 504 | 80.2 | globlastp |
| 1125 | LNU562 | rye\|12v1\|DRR001012.102719_P1 | 506 | 506 | 100 | globlastp |
| 1126 | LNU562 | pseudoroegneria\|gb167\|FF342064 | 3987 | 506 | 99.7 | globlastp |
| 1127 | LNU562 | wheat\|10v2\|BE400261 | 3987 | 506 | 99.7 | globlastp |
| 1128 | LNU562 | wheat\|10v2\|BE429346 | 3987 | 506 | 99.7 | globlastp |
| 1129 | LNU562 | wheat\|12v3\|BE400261_P1 | 3987 | 506 | 99.7 | globlastp |
| 1130 | LNU562 | leymus\|gb166\|CD809100_T1 | 3988 | 506 | 99.44 | glotblastn |
| 1131 | LNU562 | brachypodium\|09v1\|DV471229 | 3989 | 506 | 96.1 | globlastp |
| 1132 | LNU562 | brachypodium\|12v1\|BRADI1G75150_P1 | 3989 | 506 | 96.1 | globlastp |
| 1133 | LNU562 | oat\|10v2\|GO593334 | 3990 | 506 | 95.5 | globlastp |
| 1134 | LNU562 | rice\|11v1\|AA751646_P1 | 3991 | 506 | 93.5 | globlastp |
| 1135 | LNU562 | rice\|gb170\|OS01G32660 | 3991 | 506 | 93.5 | globlastp |
| 1136 | LNU562 | foxtail_millet\|11v3\|PHY7SI002024M_P1 | 3992 | 506 | 93.2 | globlastp |
| 1137 | LNU562 | foxtail_millet\|10v2\|FXTRMSLX00118812D1 | 3992 | 506 | 93.2 | globlastp |
| 1138 | LNU562 | millet\|10v1\|EVO454PM002414_P1 | 3993 | 506 | 93.2 | globlastp |
| 1139 | LNU562 | switchgrass\|gb167\|FE611046 | 3994 | 506 | 93.2 | globlastp |
| 1140 | LNU562 | sorghum\|09v1\|SB03G033190 | 3995 | 506 | 93 | globlastp |
| 1141 | LNU562 | sorghum\|12v1\|SB03G033190_P1 | 3995 | 506 | 93 | globlastp |
| 1142 | LNU562 | sugarcane\|10v1\|CA074140 | 3996 | 506 | 92.7 | globlastp |
| 1143 | LNU562 | oat\|11v1\|GR351499_T1 | 3997 | 506 | 92.11 | glotblastn |
| 1144 | LNU562 | foxtail_millet\|10v2\|SICRP018316 | 3998 | 506 | 91.8 | globlastp |
| 1145 | LNU562 | oil_palm\|11v1\|SRR190698.172236_P1 | 3999 | 506 | 80.2 | globlastp |
| 1146 | LNU563 | wheat\|12v3\|BE418433_P1 | 4000 | 507 | 97.2 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to Polyp. SEQ ID NO: | % global identity | Algor. |
|---|---|---|---|---|---|---|
| 1147 | LNU563 | brachypodium|09v1|DV486623 | 4001 | 507 | 83.8 | globlastp |
| 1148 | LNU563 | brachypodium|12v1|BRADI4G26900_P1 | 4001 | 507 | 83.8 | globlastp |
| 1149 | LNU563 | wheat|12v3|CA501127_P1 | 4002 | 507 | 81.6 | globlastp |
| 1150 | LNU563 | wheat|10v2|BE490215 | 4003 | 507 | 80.1 | globlastp |
| 1151 | LNU564 | rye|12v1|DRR001012.10122_P1 | 4004 | 508 | 99 | globlastp |
| 1152 | LNU564 | rye|12v1|DRR001012.101244_P1 | 4004 | 508 | 99 | globlastp |
| 1153 | LNU564 | rye|12v1|DRR001012.712021_P1 | 4004 | 508 | 99 | globlastp |
| 1154 | LNU564 | wheat|10v2|BM135255 | 4005 | 508 | 98 | globlastp |
| 1155 | LNU564 | wheat|12v3|BE404184_P1 | 4005 | 508 | 98 | globlastp |
| 1156 | LNU564 | fescue|gb161|DT701460_P1 | 4006 | 508 | 90.8 | globlastp |
| 1157 | LNU564 | oat|11v1|CN815699XX1_P1 | 4007 | 508 | 88.8 | globlastp |
| 1158 | LNU564 | oat|10v2|CN815699 | 4007 | 508 | 88.8 | globlastp |
| 1159 | LNU564 | oat|10v2|SRR020741S0028656 | 4007 | 508 | 88.8 | globlastp |
| 1160 | LNU564 | oat|11v1|SRR020741.309804_T1 | 4008 | 508 | 85.71 | glotblastn |
| 1161 | LNU565 | wheat|12v3|BQ903445_P1 | 4009 | 509 | 93.8 | globlastp |
| 1162 | LNU565 | rye|12v1|DRR001012.310382_P1 | 4010 | 509 | 92.9 | globlastp |
| 1163 | LNU565 | rye|12v1|DRR001012.415887_P1 | 4011 | 509 | 92.9 | globlastp |
| 1164 | LNU565 | wheat|10v2|BQ903445 | 4012 | 509 | 92.9 | globlastp |
| 1165 | LNU565 | oat|11v1|SRR020741.350129_P1 | 4013 | 509 | 88.5 | globlastp |
| 1166 | LNU565 | fescue|gb161|DT707414_P1 | 4014 | 509 | 88.5 | globlastp |
| 1167 | LNU565 | oat|11v1|SRR020741.209814_P1 | 4015 | 509 | 87.6 | globlastp |
| 1168 | LNU565 | oat|10v2|SRR020741S0024929 | 4015 | 509 | 87.6 | globlastp |
| 1169 | LNU565 | rice|11v1|BE229290_P1 | 4016 | 509 | 85.8 | globlastp |
| 1170 | LNU565 | rice|gb170|OS01G53079 | 4016 | 509 | 85.8 | globlastp |
| 1171 | LNU565 | fescue|gb161|DT681188_P1 | 4017 | 509 | 85.1 | globlastp |
| 1172 | LNU565 | foxtail_millet|11v3|PHY7SI023492M_P1 | 4018 | 509 | 85 | globlastp |
| 1173 | LNU565 | foxtail_millet|10v2|FXTRMSLX01016738D1 | 4018 | 509 | 85 | globlastp |
| 1174 | LNU565 | millet|10v1|EVO454PM059888_P1 | 4019 | 509 | 85 | globlastp |
| 1175 | LNU565 | rice|11v1|CF282121_P1 | 4020 | 509 | 85 | globlastp |
| 1176 | LNU565 | rice|gb170|OS05G45320 | 4020 | 509 | 85 | globlastp |
| 1177 | LNU565 | sorghum|09v1|SB09G026390 | 4021 | 509 | 85 | globlastp |
| 1178 | LNU565 | oat|11v1|CN821224_P1 | 4022 | 509 | 84.2 | globlastp |
| 1179 | LNU565 | oat|10v2|CN821224 | 4022 | 509 | 84.2 | globlastp |
| 1180 | LNU565 | foxtail_millet|11v3|PHY7SI003401M_P1 | 4023 | 509 | 84.1 | globlastp |
| 1181 | LNU565 | foxtail_millet|10v2|SICRP036337 | 4023 | 509 | 84.1 | globlastp |
| 1182 | LNU565 | maize|10v1|BM074716_P1 | 4024 | 509 | 84.1 | globlastp |
| 1183 | LNU565 | millet|10v1|EVO454PM017182_P1 | 4025 | 509 | 84.1 | globlastp |
| 1184 | LNU565 | sugarcane|10v1|CA101323 | 4026 | 509 | 84.1 | globlastp |
| 1185 | LNU565 | switchgrass|gb167|FL897819 | 4027 | 509 | 84.1 | globlastp |
| 1186 | LNU565 | switchgrass|gb167|FL931825 | 4028 | 509 | 84.1 | globlastp |
| 1187 | LNU565 | wheat|10v2|BJ264698 | 4029 | 509 | 84.1 | globlastp |
| 1188 | LNU565 | wheat|12v3|BJ264698_P1 | 4030 | 509 | 83.2 | globlastp |
| 1189 | LNU565 | barley|10v2|BM371871 | 4031 | 509 | 83.2 | globlastp |
| 1190 | LNU565 | barley|12v1|BM371871_P1 | 4031 | 509 | 83.2 | globlastp |
| 1191 | LNU565 | switchgrass|gb167|FL888216 | 4032 | 509 | 83.2 | globlastp |
| 1192 | LNU565 | wheat|10v2|CA655303 | 4030 | 509 | 83.2 | globlastp |
| 1193 | LNU565 | rye|12v1|DRR001012.132359_P1 | 4033 | 509 | 82.3 | globlastp |
| 1194 | LNU565 | banana|10v1|ES431711 | 4034 | 509 | 81.6 | globlastp |
| 1195 | LNU565 | switchgrass|gb167|FL899538 | 4035 | 509 | 81.4 | globlastp |
| 1196 | LNU565 | brachypodium|09v1|DV476669 | 4036 | 509 | 80.5 | globlastp |
| 1197 | LNU565 | brachypodium|12v1|BRADI2G19030_P1 | 4036 | 509 | 80.5 | globlastp |
| 1198 | LNU565 | sorghum|09v1|SB03G033670 | 4037 | 509 | 80.5 | globlastp |
| 1199 | LNU565 | sorghum|12v1|SB03G033670_P1 | 4037 | 509 | 80.5 | globlastp |
| 1200 | LNU565 | wheat|10v2|CA486679 | 4037 | 509 | 80.5 | globlastp |
| 1201 | LNU566 | rye|12v1|DRR001012.299081_P1 | 4038 | 510 | 95.5 | globlastp |
| 1202 | LNU566 | wheat|12v3|BG908521_T1 | 4039 | 510 | 94.21 | glotblastn |
| 1203 | LNU566 | wheat|12v3|BQ236156_P1 | 4040 | 510 | 94.2 | globlastp |
| 1204 | LNU566 | leymus|gb166|EG375284_P1 | 4041 | 510 | 92.2 | globlastp |
| 1205 | LNU566 | brachypodium|09v1|DV469170 | 4042 | 510 | 82.9 | globlastp |
| 1206 | LNU566 | brachypodium|12v1|BRADI3G05940_P1 | 4042 | 510 | 82.9 | globlastp |
| 1207 | LNU566 | sorghum|09v1|SB04G005400 | 4043 | 510 | 80.9 | globlastp |
| 1208 | LNU566 | sorghum|12v1|SB04G005400_P1 | 4043 | 510 | 80.9 | globlastp |
| 1209 | LNU568 | rye|12v1|DRR001012.165191_P1 | 512 | 512 | 100 | globlastp |
| 1210 | LNU568 | wheat|10v2|BE406062 | 512 | 512 | 100 | globlastp |
| 1211 | LNU568 | wheat|12v3|BE406062_P1 | 512 | 512 | 100 | globlastp |
| 1212 | LNU568 | rye|12v1|DRR001012.207438_P1 | 4044 | 512 | 98.3 | globlastp |
| 1213 | LNU568 | oat|10v2|GO592149 | 4045 | 512 | 96.6 | globlastp |
| 1214 | LNU568 | lolium|10v1|AU249773_P1 | 4046 | 512 | 93.2 | globlastp |
| 1215 | LNU568 | brachypodium|09v1|DV474260 | 4047 | 512 | 91.6 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1216 | LNU568 | brachypodium|12v1|BRADI3G59100_P1 | 4047 | 512 | 91.6 | globlastp |
| 1217 | LNU568 | rice|11v1|BI802986_P1 | 4048 | 512 | 91.6 | globlastp |
| 1218 | LNU568 | rice|gb170|OS02G51500 | 4048 | 512 | 91.6 | globlastp |
| 1219 | LNU568 | cynodon|10v1|ES296031_P1 | 4049 | 512 | 89.8 | globlastp |
| 1220 | LNU568 | foxtail_millet|11v3|EC612458_P1 | 4050 | 512 | 88.2 | globlastp |
| 1221 | LNU568 | foxtail_millet|10v2|EC612458 | 4050 | 512 | 88.2 | globlastp |
| 1222 | LNU568 | millet|10v1|EVO454PM014449_P1 | 4050 | 512 | 88.2 | globlastp |
| 1223 | LNU568 | switchgrass|gb167|DN144171 | 4050 | 512 | 88.2 | globlastp |
| 1224 | LNU568 | switchgrass|gb167|FL801879 | 4050 | 512 | 88.2 | globlastp |
| 1225 | LNU568 | maize|10v1|BU037215_P1 | 4051 | 512 | 87.4 | globlastp |
| 1226 | LNU568 | sorghum|12v1|SB04G027780_P1 | 4052 | 512 | 86.6 | globlastp |
| 1227 | LNU568 | maize|10v1|BG317084_P1 | 4053 | 512 | 86.6 | globlastp |
| 1228 | LNU568 | barley|12v1|BF254486_T1 | 4054 | 512 | 85.95 | glotblastn |
| 1229 | LNU568 | brachypodium|09v1|DV479671 | 4055 | 512 | 85.6 | globlastp |
| 1230 | LNU568 | brachypodium|12v1|BRADI1G45380_P1 | 4055 | 512 | 85.6 | globlastp |
| 1231 | LNU568 | rye|12v1|BE586543_P1 | 4056 | 512 | 84.7 | globlastp |
| 1232 | LNU568 | barley|10v2|BI954698 | 4057 | 512 | 84.7 | globlastp |
| 1233 | LNU568 | barley|12v1|BI954698_P1 | 4057 | 512 | 84.7 | globlastp |
| 1234 | LNU568 | rye|gb164|BE586543 | 4056 | 512 | 84.7 | globlastp |
| 1235 | LNU568 | wheat|10v2|BF200084 | 4056 | 512 | 84.7 | globlastp |
| 1236 | LNU568 | wheat|12v3|CA599349_P1 | 4056 | 512 | 84.7 | globlastp |
| 1237 | LNU568 | rye|12v1|DRR001013.163364_P1 | 4058 | 512 | 83.9 | globlastp |
| 1238 | LNU568 | pseudoroegneria|gb167|FF357577 | 4059 | 512 | 83.9 | globlastp |
| 1239 | LNU568 | oat|11v1|GR343476_P1 | 4060 | 512 | 83.1 | globlastp |
| 1240 | LNU568 | millet|10v1|EVO454PM044540_P1 | 4061 | 512 | 83.1 | globlastp |
| 1241 | LNU568 | oat|10v2|GR343476 | 4060 | 512 | 83.1 | globlastp |
| 1242 | LNU568 | sorghum|12v1|SB10G007900_P1 | 4062 | 512 | 83.1 | globlastp |
| 1243 | LNU568 | foxtail_millet|10v2|EC612964 | 4063 | 512 | 82.2 | globlastp |
| 1244 | LNU568 | sorghum|09v1|SB10G007900 | 4064 | 512 | 82.2 | globlastp |
| 1245 | LNU568 | switchgrass|gb167|FL849287 | 4065 | 512 | 82.2 | globlastp |
| 1246 | LNU568 | foxtail_millet|11v3|EC612964_P1 | 4066 | 512 | 81.4 | globlastp |
| 1247 | LNU568 | maize|10v1|AI891362_P1 | 4067 | 512 | 81.4 | globlastp |
| 1248 | LNU568 | sugarcane|10v1|CF575659 | 4068 | 512 | 81.36 | glotblastn |
| 1249 | LNU568 | oil_palm|11v1|SRR190698.382099_P1 | 4069 | 512 | 80.7 | globlastp |
| 1250 | LNU569 | wheat|10v2|BE401474 | 4070 | 513 | 89.3 | globlastp |
| 1251 | LNU569 | oat|10v2|GR338371 | 4071 | 513 | 83.33 | glotblastn |
| 1252 | LNU569 | wheat|12v3|CA709852_T1 | 4072 | 513 | 80.99 | glotblastn |
| 1253 | LNU570 | pseudoroegneria|gb167|FF340861 | 4073 | 514 | 98.2 | globlastp |
| 1254 | LNU570 | wheat|12v3|BE420313_P1 | 4074 | 514 | 97.8 | globlastp |
| 1255 | LNU570 | wheat|10v2|BE420313 | 4074 | 514 | 97.8 | globlastp |
| 1256 | LNU570 | wheat|12v3|BE637555_P1 | 4074 | 514 | 97.8 | globlastp |
| 1257 | LNU570 | wheat|12v3|CA600886_P1 | 4075 | 514 | 96.7 | globlastp |
| 1258 | LNU570 | brachypodium|09v1|GT836107 | 4076 | 514 | 94.18 | glotblastn |
| 1259 | LNU570 | rye|12v1|DRR001012.100414_P1 | 4077 | 514 | 93.8 | globlastp |
| 1260 | LNU570 | brachypodium|12v1|BRADI5G20280_P1 | 4078 | 514 | 93.5 | globlastp |
| 1261 | LNU570 | sorghum|09v1|SB06G027280 | 4079 | 514 | 91.6 | globlastp |
| 1262 | LNU570 | sorghum|12v1|SB06G0272801_P1 | 4079 | 514 | 91.6 | globlastp |
| 1263 | LNU570 | switchgrass|gb167|DN143101 | 4080 | 514 | 91 | globlastp |
| 1264 | LNU570 | foxtail_millet|11v3|PHY7SI010835M_P1 | 4081 | 514 | 90.5 | globlastp |
| 1265 | LNU570 | foxtail_millet|10v2|FXTRMSLX00013490D1 | 4081 | 514 | 90.5 | globlastp |
| 1266 | LNU570 | rice|11v1|AA751177_P1 | 4082 | 514 | 88.9 | globlastp |
| 1267 | LNU570 | rice|gb170|OS04G50890 | 4082 | 514 | 88.9 | globlastp |
| 1268 | LNU570 | sugarcane|10v1|CA069657 | 4083 | 514 | 88.36 | glotblastn |
| 1269 | LNU570 | millet|10v1|EVO454PM068470_P1 | 4084 | 514 | 86.5 | globlastp |
| 1270 | LNU570 | sorghum|09v1|SB04G030960 | 4085 | 514 | 84.9 | globlastp |
| 1271 | LNU570 | sorghum|12v1|SB04G030960_P1 | 4085 | 514 | 84.9 | globlastp |
| 1272 | LNU570 | sugarcane|10v1|BU103470 | 4086 | 514 | 84.6 | globlastp |
| 1273 | LNU570 | maize|10v1|AI948401_P1 | 4087 | 514 | 84.2 | globlastp |
| 1274 | LNU570 | switchgrass|gb167|FE637155 | 4088 | 514 | 83.7 | globlastp |
| 1275 | LNU570 | maize|10v1|AI944338_P1 | 4089 | 514 | 83.6 | globlastp |
| 1276 | LNU570 | millet|10v1|EVO454PM061544_P1 | 4090 | 514 | 82.7 | globlastp |
| 1277 | LNU570 | foxtail_millet|11v3|PHY7SI018052M_P1 | 4091 | 514 | 82.3 | globlastp |
| 1278 | LNU570 | foxtail_millet|10v2|SICRP015089 | 4091 | 514 | 82.3 | globlastp |
| 1279 | LNU570 | brachypodium|09v1|GT769252 | 4092 | 514 | 80.7 | globlastp |
| 1280 | LNU570 | brachypodium|12v1|BRADI3G52390_P1 | 4092 | 514 | 80.7 | globlastp |
| 1281 | LNU573 | rye|12v1|DRR001012.29634_P1 | 4093 | 517 | 99 | globlastp |
| 1282 | LNU573 | rye|12v1|DRR001013.167491_P1 | 4093 | 517 | 99 | globlastp |
| 1283 | LNU573 | wheat|12v3|CA654124_P1 | 4094 | 517 | 97.1 | globlastp |
| 1284 | LNU573 | oat|11v1|CN819184_P1 | 4095 | 517 | 91.2 | globlastp |

TABLE 2-continued

Homologues of the identified genes/polypeptides for increasing nitrogen use
efficiency, fertilizer use efficiency, yield, seed yield, growth rate, vigor, biomass, oil
content, fiber yield, fiber quality, fiber length, abiotic stress tolerance and/or water
use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1285 | LNU573 | oat\|10v2\|CN819184 | 4095 | 517 | 91.2 | globlastp |
| 1286 | LNU573 | wheat\|10v2\|CA593546XX1 | 4096 | 517 | 91.2 | globlastp |
| 1287 | LNU573 | wheat\|12v3\|CA593546_P1 | 4096 | 517 | 91.2 | globlastp |
| 1288 | LNU573 | brachypodium\|12v1\|BRADI4G07390_P1 | 4097 | 517 | 88.2 | globlastp |
| 1289 | LNU573 | sorghum\|12v1\|SB02G029700_P1 | 4098 | 517 | 84.3 | globlastp |
| 1290 | LNU573 | sugarcane\|10v1\|CA111147_P1 | 4099 | 517 | 83.3 | globlastp |
| 1291 | LNU573 | foxtail_millet\|11v3\|PHY7SI023754M_P1 | 4100 | 517 | 82.4 | globlastp |
| 1292 | LNU573 | millet\|10v1\|EVO454PM034554_P1 | 4101 | 517 | 81.7 | globlastp |
| 1293 | LNU573 | rice\|11v1\|BF430716_T1 | 4102 | 517 | 81.37 | glotblastn |
| 1294 | LNU573 | millet\|10v1\|EVO454PM020217_P1 | 4103 | 517 | 80.4 | globlastp |
| 1295 | LNU573 | switchgrass\|gb167\|GD010595_P1 | 4104 | 517 | 80.4 | globlastp |
| 1296 | LNU575 | wheat\|12v3\|BM137296_P1 | 4105 | 519 | 97.3 | globlastp |
| 1297 | LNU575 | rye\|12v1\|DRR001012.121525_P1 | 4106 | 519 | 97 | globlastp |
| 1298 | LNU575 | wheat\|10v2\|CD888162 | 4107 | 519 | 96.5 | globlastp |
| 1299 | LNU575 | wheat\|10v2\|BM137296 | 4108 | 519 | 95.7 | globlastp |
| 1300 | LNU575 | brachypodium\|09v1\|SRR031797S0273439 | 4109 | 519 | 89.7 | globlastp |
| 1301 | LNU575 | brachypodium\|12v1\|BRADI4G39120_P1 | 4109 | 519 | 89.7 | globlastp |
| 1302 | LNU575 | switchgrass\|gb167\|FE642091 | 4110 | 519 | 86.76 | glotblastn |
| 1303 | LNU575 | foxtail_millet\|11v3\|PHY7SI022212M_P1 | 4111 | 519 | 86.5 | globlastp |
| 1304 | LNU575 | switchgrass\|gb167\|FL764751 | 4112 | 519 | 86 | globlastp |
| 1305 | LNU575 | rice\|11v1\|CA759502_P1 | 4113 | 519 | 85.3 | globlastp |
| 1306 | LNU575 | rice\|gb170\|OS12G18200 | 4113 | 519 | 85.3 | globlastp |
| 1307 | LNU575 | sorghum\|09v1\|SB07G002730 | 4114 | 519 | 84.1 | globlastp |
| 1308 | LNU575 | maize\|10v1\|AI600914_P1 | 4115 | 519 | 83.9 | globlastp |
| 1309 | LNU577 | wheat\|12v3\|HX150031_T1 | 4116 | 521 | 85.38 | glotblastn |
| 1310 | LNU578 | rye\|12v1\|DRR001013.59970_P1 | 4117 | 522 | 92.6 | globlastp |
| 1311 | LNU578 | wheat\|12v3\|CA661320_P1 | 4118 | 522 | 87.6 | globlastp |
| 1312 | LNU578 | rye\|12v1\|DRR001012.310880_P1 | 4119 | 522 | 87 | globlastp |
| 1313 | LNU578 | wheat\|12v3\|CD930656_P1 | 4120 | 522 | 85 | globlastp |
| 1314 | LNU578 | wheat\|12v3\|HX139345_T1 | 4121 | 522 | 84.37 | glotblastn |
| 1315 | LNU578 | barley\|12v1\|BF621280_P1 | 4122 | 522 | 83.6 | globlastp |
| 1316 | LNU578 | barley\|12v1\|BY847513_P1 | 4123 | 522 | 81.8 | globlastp |
| 1317 | LNU580 | rye\|12v1\|BE438509_P1 | 4124 | 524 | 94.4 | globlastp |
| 1318 | LNU580 | rye\|12v1\|DRR001012.102272_P1 | 4124 | 524 | 94.4 | globlastp |
| 1319 | LNU580 | rye\|12v1\|DRR001012.102713_P1 | 4124 | 524 | 94.4 | globlastp |
| 1320 | LNU580 | rye\|12v1\|DRR001012.116525_P1 | 4124 | 524 | 94.4 | globlastp |
| 1321 | LNU580 | rye\|12v1\|DRR001012.116996_P1 | 4124 | 524 | 94.4 | globlastp |
| 1322 | LNU580 | rye\|12v1\|DRR001012.142666_P1 | 4124 | 524 | 94.4 | globlastp |
| 1323 | LNU580 | rye\|gb164\|BE438505 | 4124 | 524 | 94.4 | globlastp |
| 1324 | LNU580 | rye\|12v1\|DRR001012.484776_T1 | 4125 | 524 | 94.38 | glotblastn |
| 1325 | LNU580 | rye\|12v1\|DRR001012.297185_T1 | 4126 | 524 | 93.26 | glotblastn |
| 1326 | LNU580 | rye\|12v1\|DRR001012.176214_T1 | 4127 | 524 | 92.13 | glotblastn |
| 1327 | LNU580 | fescue\|gb161\|CK800910_P1 | 4128 | 524 | 92.1 | globlastp |
| 1328 | LNU580 | pseudoroegneria\|gb167\|FF340234 | 4129 | 524 | 92.1 | globlastp |
| 1329 | LNU580 | rye\|12v1\|DRR001012.426399_T1 | 4130 | 524 | 91.01 | glotblastn |
| 1330 | LNU580 | rye\|12v1\|BE586269_P1 | 4131 | 524 | 90 | globlastp |
| 1331 | LNU580 | rye\|12v1\|DRR001012.104655_P1 | 4131 | 524 | 90 | globlastp |
| 1332 | LNU580 | rye\|12v1\|DRR001018.17000_P1 | 4132 | 524 | 89.9 | globlastp |
| 1333 | LNU580 | wheat\|12v3\|CA602237_P1 | 4132 | 524 | 89.9 | globlastp |
| 1334 | LNU580 | foxtail_millet\|10v2\|FXTSLX00097545 | 4132 | 524 | 89.9 | globlastp |
| 1335 | LNU580 | leymus\|gb166\|CN465808_P1 | 4133 | 524 | 89.9 | globlastp |
| 1336 | LNU580 | wheat\|10v2\|BF200404 | 4132 | 524 | 89.9 | globlastp |
| 1337 | LNU580 | wheat\|12v3\|BE406476_P1 | 4132 | 524 | 89.9 | globlastp |
| 1338 | LNU580 | wheat\|10v2\|CA665066 | 4132 | 524 | 89.9 | globlastp |
| 1339 | LNU580 | wheat\|10v2\|CA666962 | 4132 | 524 | 89.9 | globlastp |
| 1340 | LNU580 | wheat\|10v2\|CA695387 | 4132 | 524 | 89.9 | globlastp |
| 1341 | LNU580 | wheat\|12v3\|HX051163_P1 | 4132 | 524 | 89.9 | globlastp |
| 1342 | LNU580 | rye\|12v1\|BE438565_P1 | 4134 | 524 | 88.9 | globlastp |
| 1343 | LNU580 | rye\|12v1\|BE586442_P1 | 4134 | 524 | 88.9 | globlastp |
| 1344 | LNU580 | rye\|12v1\|BE704851_P1 | 4134 | 524 | 88.9 | globlastp |
| 1345 | LNU580 | rye\|12v1\|DRR001012.17807_P1 | 4134 | 524 | 88.9 | globlastp |
| 1346 | LNU580 | rye\|12v1\|DRR001012.21624_P1 | 4134 | 524 | 88.9 | globlastp |
| 1347 | LNU580 | wheat\|12v3\|BE404509_P1 | 4135 | 524 | 88.9 | globlastp |
| 1348 | LNU580 | wheat\|12v3\|BE404797_P1 | 4135 | 524 | 88.9 | globlastp |
| 1349 | LNU580 | rye\|gb164\|BE438524 | 4134 | 524 | 88.9 | globlastp |
| 1350 | LNU580 | wheat\|10v2\|BQ789510 | 4135 | 524 | 88.9 | globlastp |
| 1351 | LNU580 | rye\|12v1\|DRR001012.107816_T1 | 4136 | 524 | 88.89 | glotblastn |
| 1352 | LNU580 | rye\|12v1\|DRR001012.229092_T1 | 4137 | 524 | 88.89 | glotblastn |
| 1353 | LNU580 | rye\|12v1\|DRR001012.862317_T1 | 4138 | 524 | 88.89 | glotblastn |

TABLE 2-continued

Homologues of the identified genes/polypeptides for increasing nitrogen use
efficiency, fertilizer use efficiency, yield, seed yield, growth rate, vigor, biomass, oil
content, fiber yield, fiber quality, fiber length, abiotic stress tolerance and/or water
use efficiency of a plant

| Polyn. SEQ ID NO: | Hom. to Gene Name | cluster name | Polyp. SEQ ID NO: | Hom. to Polyp. SEQ ID NO: | % global identity | Algor. |
|---|---|---|---|---|---|---|
| 1354 | LNU580 | rye\|12v1\|DRR001012.110130_P1 | 4139 | 524 | 88.8 | globlastp |
| 1355 | LNU580 | rye\|12v1\|DRR001012.12918_P1 | 4139 | 524 | 88.8 | globlastp |
| 1356 | LNU580 | wheat\|12v3\|HX052806_P1 | 4140 | 524 | 88.8 | globlastp |
| 1357 | LNU580 | wheat\|10v2\|BE428112 | 4140 | 524 | 88.8 | globlastp |
| 1358 | LNU580 | wheat\|10v2\|CA610150XX1 | 4140 | 524 | 88.8 | globlastp |
| 1359 | LNU580 | wheat\|12v3\|HX128319_P1 | 4140 | 524 | 88.8 | globlastp |
| 1360 | LNU580 | wheat\|10v2\|CA663746 | 4140 | 524 | 88.8 | globlastp |
| 1361 | LNU580 | wheat\|10v2\|CA665769 | 4140 | 524 | 88.8 | globlastp |
| 1362 | LNU580 | wheat\|10v2\|CA606454XX1 | 4141 | 524 | 88.76 | glotblastn |
| 1363 | LNU580 | wheat\|12v3\|BE402692_T1 | 4142 | 524 | 88.76 | glotblastn |
| 1364 | LNU580 | barley\|12v1\|AV927574_P1 | 4143 | 524 | 87.8 | globlastp |
| 1365 | LNU580 | wheat\|12v3\|BE352610XX1_P1 | 4143 | 524 | 87.8 | globlastp |
| 1366 | LNU580 | wheat\|12v3\|CA598850_P1 | 4144 | 524 | 87.8 | globlastp |
| 1367 | LNU580 | barley\|10v2\|BE420622XX1 | 4145 | 524 | 87.8 | globlastp |
| 1368 | LNU580 | barley\|10v2\|BE420624 | 4143 | 524 | 87.8 | globlastp |
| 1369 | LNU580 | oat\|10v2\|CN816055 | 4146 | 524 | 87.8 | globlastp |
| 1370 | LNU580 | wheat\|10v2\|BE428349 | 4144 | 524 | 87.8 | globlastp |
| 1371 | LNU580 | wheat\|10v2\|BG607318 | 4143 | 524 | 87.8 | globlastp |
| 1372 | LNU580 | wheat\|12v3\|BE405494_P1 | 4144 | 524 | 87.8 | globlastp |
| 1373 | LNU580 | wheat\|10v2\|CA662523 | 4147 | 524 | 87.64 | glotblastn |
| 1374 | LNU580 | wheat\|12v3\|CA667726_P1 | 4148 | 524 | 87.6 | globlastp |
| 1375 | LNU580 | wheat\|10v2\|CA602237XX1 | 4148 | 524 | 87.6 | globlastp |
| 1376 | LNU580 | wheat\|10v2\|CA603776 | 4148 | 524 | 87.6 | globlastp |
| 1377 | LNU580 | wheat\|10v2\|WHTWALI5A | 4148 | 524 | 87.6 | globlastp |
| 1378 | LNU580 | wheat\|12v3\|WHTWALI5A_P1 | 4148 | 524 | 87.6 | globlastp |
| 1379 | LNU580 | rye\|12v1\|DRR001012.101284_P1 | 4149 | 524 | 87.4 | globlastp |
| 1380 | LNU580 | wheat\|10v2\|CA662770 | 4150 | 524 | 86.52 | glotblastn |
| 1381 | LNU580 | oat\|11v1\|CN816055XX1_P1 | 4151 | 524 | 85.9 | globlastp |
| 1382 | LNU580 | rye\|12v1\|DRR001012.19347_T1 | 4152 | 524 | 84.27 | glotblastn |
| 1383 | LNU580 | oat\|11v1\|CN821142_P1 | 4153 | 524 | 83.3 | globlastp |
| 1384 | LNU580 | oat\|10v2\|CN821142 | 4153 | 524 | 83.3 | globlastp |
| 1385 | LNU580 | oat\|11v1\|CN814903_P1 | 4154 | 524 | 82.2 | globlastp |
| 1386 | LNU580 | oat\|10v2\|CN821430 | 4155 | 524 | 82.2 | globlastp |
| 1387 | LNU580 | rye\|12v1\|DRR001012.215828_T1 | 4156 | 524 | 82.02 | glotblastn |
| 1388 | LNU580 | rye\|12v1\|DRR001012.364837_T1 | 4157 | 524 | 82.02 | glotblastn |
| 1389 | LNU580 | fescue\|gb161\|DT690944_P1 | 4158 | 524 | 81.1 | globlastp |
| 1390 | LNU580 | lolium\|10v1\|AU246259_P1 | 4159 | 524 | 81.1 | globlastp |
| 1391 | LNU580 | wheat\|10v2\|CA604006 | 4160 | 524 | 81.05 | glotblastn |
| 1392 | LNU582 | barley\|10v2\|BE412527 | 4161 | 526 | 94.4 | globlastp |
| 1393 | LNU582 | rye\|12v1\|DRR001012.110425_P1 | 4162 | 526 | 93.5 | globlastp |
| 1394 | LNU582 | wheat\|10v2\|BE428630 | 4163 | 526 | 93 | globlastp |
| 1395 | LNU582 | barley\|12v1\|BE412527_P1 | 4164 | 526 | 92.2 | globlastp |
| 1396 | LNU582 | wheat\|12v3\|BE405489_P1 | 4165 | 526 | 91.9 | globlastp |
| 1397 | LNU582 | oat\|11v1\|GO586515_P1 | 4166 | 526 | 87.9 | globlastp |
| 1398 | LNU582 | oat\|10v2\|GO586515 | 4166 | 526 | 87.9 | globlastp |
| 1399 | LNU582 | rice\|11v1\|AU029708_P1 | 4167 | 526 | 87.6 | globlastp |
| 1400 | LNU582 | rice\|gb170\|OS07G42960 | 4167 | 526 | 87.6 | globlastp |
| 1401 | LNU582 | foxtail_millet\|11v3\|EC613242_P1 | 4168 | 526 | 87.5 | globlastp |
| 1402 | LNU582 | sorghum\|09v1\|SB02G039660 | 4169 | 526 | 87.4 | globlastp |
| 1403 | LNU582 | sorghum\|12v1\|SB02G039660_P1 | 4169 | 526 | 87.4 | globlastp |
| 1404 | LNU582 | maize\|10v1\|AA661448_P1 | 4170 | 526 | 86.5 | globlastp |
| 1405 | LNU582 | maize\|10v1\|AI612388_P1 | 4171 | 526 | 85.2 | globlastp |
| 1406 | LNU582 | rye\|12v1\|DRR001012.110666_P1 | 4172 | 526 | 83.8 | globlastp |
| 1407 | LNU582 | foxtail_millet\|11v3\|PHY7SI035017M_P1 | 4173 | 526 | 82.2 | globlastp |
| 1408 | LNU582 | foxtail_millet\|10v2\|SICRP008294 | 4173 | 526 | 82.2 | globlastp |
| 1409 | LNU582 | millet\|10v1\|CD725304_P1 | 4174 | 526 | 82.1 | globlastp |
| 1410 | LNU582 | sugarcane\|10v1\|CA067121 | 4175 | 526 | 81.9 | globlastp |
| 1411 | LNU582 | sorghum\|09v1\|SB01G033590 | 4176 | 526 | 81.7 | globlastp |
| 1412 | LNU582 | sorghum\|12v1\|SB01G033590_P1 | 4176 | 526 | 81.7 | globlastp |
| 1413 | LNU582 | foxtail_millet\|10v2\|OXEC613242T1 | 4177 | 526 | 81.3 | globlastp |
| 1414 | LNU582 | switchgrass\|gb167\|DN148528 | 4178 | 526 | 80.9 | globlastp |
| 1415 | LNU582 | sugarcane\|10v1\|BQ529726 | 4179 | 526 | 80.7 | globlastp |
| 1416 | LNU582 | brachypodium\|09v1\|DV486219 | 4180 | 526 | 80.6 | globlastp |
| 1417 | LNU582 | brachypodium\|12v1\|BRADI1G60750_P1 | 4180 | 526 | 80.6 | globlastp |
| 1418 | LNU585 | wheat\|12v3\|CA597944_P1 | 4181 | 529 | 80.9 | globlastp |
| 1419 | LNU585 | rye\|12v1\|DRR001016.263675_P1 | 4182 | 529 | 80.1 | globlastp |
| 1420 | LNU587 | millet\|10v1\|EVO454PM006803_P1 | 4183 | 530 | 97.2 | globlastp |
| 1421 | LNU587 | switchgrass\|gb167\|DN151903 | 4184 | 530 | 94.24 | glotblastn |
| 1422 | LNU587 | sugarcane\|10v1\|CA068541 | 4185 | 530 | 93.7 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1423 | LNU587 | maize\|10v1\|AI691550_P1 | 4186 | 530 | 93 | globlastp |
| 1424 | LNU587 | maize\|10v1\|BQ487085_P1 | 4187 | 530 | 92.5 | globlastp |
| 1425 | LNU587 | sorghum\|09v1\|SB01G047830 | 4188 | 530 | 92.5 | globlastp |
| 1426 | LNU587 | sorghum\|12v1\|SB01G047830_P1 | 4188 | 530 | 92.5 | globlastp |
| 1427 | LNU587 | maize\|10v1\|BM501330_P1 | 4189 | 530 | 92.2 | globlastp |
| 1428 | LNU587 | rice\|11v1\|BI808263_P1 | 4190 | 530 | 87 | globlastp |
| 1429 | LNU587 | rice\|gb170\|OS03G04430 | 4190 | 530 | 87 | globlastp |
| 1430 | LNU587 | wheat\|10v2\|BE425309 | 4191 | 530 | 85.29 | glotblastn |
| 1431 | LNU587 | rye\|12v1\|DRR001012.141878_P1 | 4192 | 530 | 85 | globlastp |
| 1432 | LNU587 | wheat\|12v3\|BE415141_P1 | 4193 | 530 | 85 | globlastp |
| 1433 | LNU587 | barley\|12v1\|BI949529_P1 | 4194 | 530 | 84.8 | globlastp |
| 1434 | LNU587 | barley\|12v1\|AK371581_P1 | 4195 | 530 | 84.5 | globlastp |
| 1435 | LNU587 | wheat\|10v2\|BE403305 | 4196 | 530 | 84.5 | globlastp |
| 1436 | LNU587 | brachypodium\|09v1\|DV468947 | 4197 | 530 | 84 | globlastp |
| 1437 | LNU587 | brachypodium\|12v1\|BRADI1G75940_P1 | 4197 | 530 | 84 | globlastp |
| 1438 | LNU587 | rye\|12v1\|BF145608_T1 | 4198 | 530 | 83.79 | glotblastn |
| 1439 | LNU587 | maize\|10v1\|BG462699_P1 | 4199 | 530 | 82.2 | globlastp |
| 1440 | LNU587 | barley\|10v2\|BI949529 | 4200 | 530 | 81.5 | globlastp |
| 1441 | LNU588 | switchgrass\|gb167\|FL706016 | 4201 | 531 | 86.7 | globlastp |
| 1442 | LNU588 | sorghum\|09v1\|SB05G024860 | 4202 | 531 | 83 | globlastp |
| 1443 | LNU588 | sorghum\|12v1\|SB05G024860_P1 | 4202 | 531 | 83 | globlastp |
| 1444 | LNU588 | sugarcane\|10v1\|CA147927 | 4203 | 531 | 81.5 | glotblastn |
| 1445 | LNU589 | millet\|10v1\|PMSLX0020338D1_P1 | 4204 | 532 | 95.7 | globlastp |
| 1446 | LNU589 | sugarcane\|10v1\|CA119659 | 4205 | 532 | 83.5 | globlastp |
| 1447 | LNU589 | maize\|10v1\|BQ172711_P1 | 4206 | 532 | 80.1 | globlastp |
| 1448 | LNU591 | foxtail_millet\|10v2\|FXTRMSLX00513071D1 | 4207 | 534 | 83.8 | globlastp |
| 1449 | LNU591 | foxtail_millet\|11v3\|PHY7SI025004M_P1 | 4208 | 534 | 82.9 | globlastp |
| 1450 | LNU591 | sugarcane\|10v1\|CA152035 | 4209 | 534 | 81.9 | globlastp |
| 1451 | LNU591 | foxtail_millet\|10v2\|SICRP027519 | 4210 | 534 | 80.7 | glotblastn |
| 1452 | LNU592 | sorghum\|09v1\|SB06G027520 | 4211 | 535 | 95.2 | globlastp |
| 1453 | LNU592 | sorghum\|12v1\|SB06G027520_P1 | 4211 | 535 | 95.2 | globlastp |
| 1454 | LNU592 | foxtail_millet\|11v3\|PHY7SI010467M_P1 | 4212 | 535 | 88.7 | globlastp |
| 1455 | LNU592 | foxtail_millet\|10v2\|SICRP008741 | 4212 | 535 | 88.7 | globlastp |
| 1456 | LNU592 | switchgrass\|gb167\|FE643714 | 4213 | 535 | 88.2 | globlastp |
| 1457 | LNU592 | millet\|10v1\|EVO454PM023758_P1 | 4214 | 535 | 86.3 | globlastp |
| 1458 | LNU593 | sorghum\|09v1\|SB01G008810 | 4215 | 536 | 84.8 | globlastp |
| 1459 | LNU593 | sorghum\|12v1\|SB01G008810_P1 | 4215 | 536 | 84.8 | globlastp |
| 1460 | LNU593 | maize\|10v1\|AA979792_P1 | 4216 | 536 | 84 | globlastp |
| 1461 | LNU594 | sorghum\|09v1\|SB02G029345 | 4217 | 537 | 94 | globlastp |
| 1462 | LNU594 | sorghum\|12v1\|SB02G029350_P1 | 4217 | 537 | 94 | globlastp |
| 1463 | LNU594 | foxtail_millet\|11v3\|PHY7SI028963M_P1 | 4218 | 537 | 91.4 | globlastp |
| 1464 | LNU594 | oat\|10v2\|CN820557 | 4219 | 537 | 83.6 | globlastp |
| 1465 | LNU594 | oat\|11v1\|CN820557_P1 | 4220 | 537 | 83.4 | globlastp |
| 1466 | LNU594 | brachypodium\|12v1\|BRADI5G02490_P1 | 4221 | 537 | 83.4 | globlastp |
| 1467 | LNU594 | wheat\|12v3\|BE489611_P1 | 4222 | 537 | 83.2 | globlastp |
| 1468 | LNU594 | rye\|12v1\|DRR001012.109107_P1 | 4223 | 537 | 82.2 | globlastp |
| 1469 | LNU594 | brachypodium\|09v1\|GT782509 | 4224 | 537 | 81.9 | globlastp |
| 1470 | LNU596 | sorghum\|09v1\|SB0019S003300 | 4225 | 539 | 96.6 | globlastp |
| 1471 | LNU596 | sorghum\|12v1\|SB0019S003300_P1 | 4225 | 539 | 96.6 | globlastp |
| 1472 | LNU596 | wheat\|10v2\|CA485009 | 4225 | 539 | 96.6 | globlastp |
| 1473 | LNU596 | sugarcane\|10v1\|CA075122 | 4226 | 539 | 96 | globlastp |
| 1474 | LNU596 | maize\|10v1\|AI820183_P1 | 4227 | 539 | 93.8 | globlastp |
| 1475 | LNU596 | foxtail_millet\|11v3\|PHY7SI019313M_P1 | 4228 | 539 | 91.8 | globlastp |
| 1476 | LNU596 | foxtail_millet\|10v2\|SICRP038224 | 4228 | 539 | 91.8 | globlastp |
| 1477 | LNU596 | switchgrass\|gb167\|FE646420 | 4229 | 539 | 91.7 | globlastp |
| 1478 | LNU596 | millet\|10v1\|EVO454PM107820_P1 | 4230 | 539 | 89.2 | globlastp |
| 1479 | LNU596 | oat\|11v1\|GR320565_P1 | 4231 | 539 | 87.6 | globlastp |
| 1480 | LNU596 | oat\|10v2\|GR320565 | 4231 | 539 | 87.6 | globlastp |
| 1481 | LNU596 | rice\|11v1\|AU101273_P1 | 4232 | 539 | 87 | globlastp |
| 1482 | LNU596 | rice\|gb170\|OS02G21080 | 4232 | 539 | 87 | globlastp |
| 1483 | LNU596 | brachypodium\|09v1\|GT765080 | 4233 | 539 | 86.4 | globlastp |
| 1484 | LNU596 | brachypodium\|12v1\|BRADI3G11020_P1 | 4233 | 539 | 86.4 | globlastp |
| 1485 | LNU596 | rye\|12v1\|BE493788_P1 | 4234 | 539 | 84.7 | globlastp |
| 1486 | LNU596 | barley\|10v2\|BI949563 | 4235 | 539 | 84.3 | globlastp |
| 1487 | LNU596 | wheat\|12v3\|CA485009_P1 | 4236 | 539 | 83.8 | globlastp |
| 1488 | LNU596 | wheat\|10v2\|CA496996 | 4237 | 539 | 83.2 | globlastp |
| 1489 | LNU597 | foxtail_millet\|11v3\|PHY7SI036053M_P1 | 4238 | 540 | 84.4 | globlastp |
| 1490 | LNU597 | foxtail_millet\|10v2\|SICRP000164 | 4239 | 540 | 81.68 | glotblastn |
| 1491 | LNU598 | sorghum\|12v1\|BM328081_P1 | 4240 | 541 | 99.4 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to Polyp. SEQ ID NO: | % global identity | Algor. |
|---|---|---|---|---|---|---|
| 1492 | LNU598 | brachypodium|12v1|BRADI2G13106_P1 | 4241 | 541 | 98.2 | globlastp |
| 1493 | LNU598 | brachypodium|09v1|GFXEU325680X10 | 4242 | 541 | 92.22 | glotblastn |
| 1494 | LNU598 | brachypodium|09v1|CRPBD013356 | 4242 | 541 | 90 | glotblastn |
| 1495 | LNU598 | amborella|12v3|CD482584_P1 | 4243 | 541 | 89.4 | globlastp |
| 1496 | LNU598 | sorghum|12v1|EVOER6772_P1 | 4244 | 541 | 84.7 | globlastp |
| 1497 | LNU600 | sorghum|09v1|SB01G003910 | 4245 | 542 | 85.8 | globlastp |
| 1498 | LNU600 | sorghum|12v1|SB01G003910_P1 | 4245 | 542 | 85.8 | globlastp |
| 1499 | LNU603 | sugarcane|10v1|AA644753 | 4246 | 545 | 91.4 | globlastp |
| 1500 | LNU603 | sorghum|09v1|SB06G033070 | 4247 | 545 | 91.1 | globlastp |
| 1501 | LNU603 | sorghum|12v1|SB06G033070P1_P1 | 4247 | 545 | 91.1 | globlastp |
| 1502 | LNU603 | maize|10v1|AI677306_P1 | 4248 | 545 | 90.5 | globlastp |
| 1503 | LNU603 | foxtail_millet|11v3|PHY7SI022765M_P1 | 4249 | 545 | 85.4 | globlastp |
| 1504 | LNU603 | switchgrass|gb167|DN143607 | 4250 | 545 | 85.3 | globlastp |
| 1505 | LNU603 | switchgrass|gb167|DN141542 | 4251 | 545 | 85 | globlastp |
| 1506 | LNU603 | cenchrus|gb166|EB654394_P1 | 4252 | 545 | 84.4 | globlastp |
| 1507 | LNU603 | foxtail_millet|10v2|SICRP017605 | 4253 | 545 | 84.09 | glotblastn |
| 1508 | LNU603 | millet|10v1|EVO454PM187151_P1 | 4254 | 545 | 81.7 | globlastp |
| 1509 | LNU604 | foxtail_millet|11v3|PHY7SI014010M_P1 | 4255 | 546 | 93.4 | globlastp |
| 1510 | LNU604 | sorghum|09v1|SB07G022590 | 4256 | 546 | 93.3 | globlastp |
| 1511 | LNU604 | sorghum|12v1|SB07G022590_P1 | 4256 | 546 | 93.3 | globlastp |
| 1512 | LNU604 | switchgrass|gb167|FE631615 | 4257 | 546 | 93.2 | globlastp |
| 1513 | LNU604 | millet|10v1|EVO454PM031832_P1 | 4258 | 546 | 91.5 | globlastp |
| 1514 | LNU604 | maize|10v1|CD568693_P1 | 4259 | 546 | 91.2 | globlastp |
| 1515 | LNU604 | switchgrass|gb167|DN146330 | 4260 | 546 | 91 | globlastp |
| 1516 | LNU604 | oat|11v1|GR320976_P1 | 4261 | 546 | 84.6 | globlastp |
| 1517 | LNU604 | oat|10v2|GO588126 | 4261 | 546 | 84.6 | globlastp |
| 1518 | LNU604 | rice|11v1|AA749571_P1 | 4262 | 546 | 84.3 | globlastp |
| 1519 | LNU604 | rice|gb170|OS08G36150 | 4262 | 546 | 84.3 | globlastp |
| 1520 | LNU604 | brachypodium|09v1|DV469079 | 4263 | 546 | 83.8 | globlastp |
| 1521 | LNU604 | brachypodium|12v1|BRADI3G37790_P1 | 4263 | 546 | 83.8 | globlastp |
| 1522 | LNU604 | barley|10v2|BE437861 | 4264 | 546 | 80.7 | globlastp |
| 1523 | LNU606 | sorghum|09v1|SB04G027710 | 4265 | 548 | 92 | globlastp |
| 1524 | LNU606 | sorghum|12v1|SB04G027710_P1 | 4265 | 548 | 92 | globlastp |
| 1525 | LNU606 | foxtail_millet|11v3|PHY7SI017655M_P1 | 4266 | 548 | 85.5 | globlastp |
| 1526 | LNU606 | millet|10v1|EVO454PM003563_P1 | 4267 | 548 | 83.5 | globlastp |
| 1527 | LNU606 | switchgrass|gb167|FL851644 | 4268 | 548 | 82.7 | globlastp |
| 1528 | LNU607 | sorghum|09v1|SB06G030570 | 4269 | 549 | 94.7 | globlastp |
| 1529 | LNU607 | sorghum|12v1|SB06G030570_P1 | 4269 | 549 | 94.7 | globlastp |
| 1530 | LNU607 | sugarcane|10v1|CA109804 | 4270 | 549 | 93 | globlastp |
| 1531 | LNU607 | foxtail_millet|11v3|PHY7SI010303M_P1 | 4271 | 549 | 92 | globlastp |
| 1532 | LNU607 | millet|10v1|EVO454PM005929_P1 | 4272 | 549 | 92 | globlastp |
| 1533 | LNU607 | switchgrass|gb167|DN146073 | 4273 | 549 | 91.5 | globlastp |
| 1534 | LNU607 | maize|10v1|DW750368_T1 | 4274 | 549 | 88.19 | glotblastn |
| 1535 | LNU607 | rice|11v1|BI805145_P1 | 4275 | 549 | 85.4 | globlastp |
| 1536 | LNU607 | rice|gb170|OS04G55250 | 4275 | 549 | 85.4 | globlastp |
| 1537 | LNU607 | wheat|12v3|BJ267712_P1 | 4276 | 549 | 83.2 | globlastp |
| 1538 | LNU607 | wheat|10v2|BJ269075 | 4277 | 549 | 82.7 | globlastp |
| 1539 | LNU607 | wheat|12v3|BJ269075_P1 | 4278 | 549 | 82.5 | globlastp |
| 1540 | LNU607 | wheat|12v3|CO345942_P1 | 4279 | 549 | 82.5 | globlastp |
| 1541 | LNU607 | barley|10v2|AK248570 | 4280 | 549 | 82.2 | globlastp |
| 1542 | LNU607 | barley|12v1|AK248570_P1 | 4280 | 549 | 82.2 | globlastp |
| 1543 | LNU607 | rye|12v1|DRR001012.101599_P1 | 4281 | 549 | 82 | globlastp |
| 1544 | LNU607 | rye|12v1|DRR001012.827135_P1 | 4281 | 549 | 82 | globlastp |
| 1545 | LNU607 | rye|12v1|DRR001012.364428_T1 | 4282 | 549 | 81.95 | glotblastn |
| 1546 | LNU607 | rye|12v1|DRR001012.804069_P1 | 4283 | 549 | 81.7 | globlastp |
| 1547 | LNU607 | rye|12v1|DRR001012.113650_P1 | 4284 | 549 | 81.5 | globlastp |
| 1548 | LNU607 | brachypodium|09v1|SRR031797S0090525 | 4285 | 549 | 81 | globlastp |
| 1549 | LNU607 | brachypodium|12v1|BRADI5G23910_P1 | 4285 | 549 | 81 | globlastp |
| 1550 | LNU607 | wheat|12v3|GR884606_P1 | 4286 | 549 | 80.7 | globlastp |
| 1551 | LNU609 | sorghum|09v1|SB07G026290 | 4287 | 550 | 94.5 | globlastp |
| 1552 | LNU609 | sorghum|12v1|SB07G026290_P1 | 4287 | 550 | 94.5 | globlastp |
| 1553 | LNU609 | sugarcane|10v1|CA111428 | 4288 | 550 | 94.2 | globlastp |
| 1554 | LNU609 | switchgrass|gb167|FE615979 | 4289 | 550 | 94 | globlastp |
| 1555 | LNU609 | foxtail_millet|11v3|PHY7SI013470M_P1 | 4290 | 550 | 93.5 | globlastp |
| 1556 | LNU609 | foxtail_millet|10v2|OXFXTSLX00014141D1T1 | 4291 | 550 | 93.2 | globlastp |
| 1557 | LNU609 | millet|10v1|EVO454PM030416_P1 | 4292 | 550 | 91.4 | globlastp |
| 1558 | LNU609 | rye|12v1|DRR001012.115400_P1 | 4293 | 550 | 89.7 | globlastp |
| 1559 | LNU609 | wheat|12v3|CD864346_P1 | 4294 | 550 | 89.7 | globlastp |
| 1560 | LNU609 | barley|10v2|AV832765 | 4295 | 550 | 89.4 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to Polyp. SEQ ID NO: | % global identity | Algor. |
|---|---|---|---|---|---|---|
| 1561 | LNU609 | barley\|12v1\|AV832765_P1 | 4295 | 550 | 89.4 | globlastp |
| 1562 | LNU609 | pseudoroegneria\|gb167\|FF343104 | 4296 | 550 | 89.4 | globlastp |
| 1563 | LNU609 | rice\|11v1\|AA751890_P1 | 4297 | 550 | 89.4 | globlastp |
| 1564 | LNU609 | rice\|gb170\|OS08G41830 | 4297 | 550 | 89.4 | globlastp |
| 1565 | LNU609 | wheat\|10v2\|BM138552 | 4298 | 550 | 89.2 | globlastp |
| 1566 | LNU610 | sorghum\|12v1\|SB10G022620_P1 | 4299 | 551 | 94.1 | globlastp |
| 1567 | LNU610 | sorghum\|09v1\|SB10G022620 | 4299 | 551 | 94.1 | globlastp |
| 1568 | LNU610 | sugarcane\|10v1\|CA130470 | 4300 | 551 | 92.1 | globlastp |
| 1569 | LNU610 | foxtail_millet\|11v3\|EC612979_T1 | 4301 | 551 | 90.61 | glotblastn |
| 1570 | LNU610 | brachypodium\|09v1\|DV470910 | 4302 | 551 | 89.6 | globlastp |
| 1571 | LNU610 | brachypodium\|12v1\|BRADI1G37450_P1 | 4302 | 551 | 89.6 | globlastp |
| 1572 | LNU610 | switchgrass\|gb167\|FL701133 | 4303 | 551 | 89.5 | globlastp |
| 1573 | LNU610 | millet\|10v1\|EVO454PM029173_P1 | 4304 | 551 | 88.9 | globlastp |
| 1574 | LNU610 | rye\|12v1\|DRR001012.144667_P1 | 4305 | 551 | 88.1 | globlastp |
| 1575 | LNU610 | barley\|12v1\|AV836641_P1 | 4306 | 551 | 87.7 | globlastp |
| 1576 | LNU610 | rye\|12v1\|DRR001012.148007_P1 | 4307 | 551 | 86.6 | globlastp |
| 1577 | LNU610 | rice\|11v1\|BI805738_P1 | 4308 | 551 | 85.5 | globlastp |
| 1578 | LNU610 | rice\|gb170\|OS06G37560 | 4308 | 551 | 85.5 | globlastp |
| 1579 | LNU610 | wheat\|10v2\|BI751317 | 4309 | 551 | 81.7 | globlastp |
| 1580 | LNU610 | wheat\|12v3\|BI751317_P1 | 4309 | 551 | 81.7 | globlastp |
| 1581 | LNU610 | barley\|12v1\|CA026324_P1 | 4310 | 551 | 81.5 | globlastp |
| 1582 | LNU610 | foxtail_millet\|10v2\|OXEC612979T1 | 4311 | 551 | 81.3 | globlastp |
| 1583 | LNU610 | wheat\|12v3\|BE426281_P1 | 4312 | 551 | 81.2 | globlastp |
| 1584 | LNU610 | brachypodium\|09v1\|SRR031797S0001936 | 4313 | 551 | 81.2 | globlastp |
| 1585 | LNU610 | maize\|10v1\|AI901880_T1 | 4314 | 551 | 80.88 | glotblastn |
| 1586 | LNU610 | sorghum\|09v1\|SB04G007660 | 4315 | 551 | 80.77 | glotblastn |
| 1587 | LNU610 | sorghum\|12v1\|SB04G007660_T1 | 4315 | 551 | 80.77 | glotblastn |
| 1588 | LNU610 | foxtail_millet\|11v3\|PHY7SI016472M_T1 | 4316 | 551 | 80.27 | glotblastn |
| 1589 | LNU610 | rice\|11v1\|BI805861_T1 | 4317 | 551 | 80.06 | glotblastn |
| 1590 | LNU610 | rice\|gb170\|OS02G12730 | 4317 | 551 | 80.06 | glotblastn |
| 1591 | LNU611 | sugarcane\|10v1\|CA069060 | 4318 | 552 | 97.4 | globlastp |
| 1592 | LNU611 | sorghum\|09v1\|SB02G035680 | 4319 | 552 | 96.8 | globlastp |
| 1593 | LNU611 | sorghum\|12v1\|SB02G035680_P1 | 4319 | 552 | 96.8 | globlastp |
| 1594 | LNU611 | foxtail_millet\|11v3\|GT228332_P1 | 4320 | 552 | 94.2 | globlastp |
| 1595 | LNU611 | switchgrass\|gb167\|FE600831 | 4321 | 552 | 93.2 | globlastp |
| 1596 | LNU611 | millet\|10v1\|EVO454PM001221_P1 | 4322 | 552 | 91.8 | globlastp |
| 1597 | LNU611 | rice\|11v1\|BI809794_P1 | 4323 | 552 | 88.6 | globlastp |
| 1598 | LNU611 | rice\|gb170\|OS07G36170 | 4323 | 552 | 88.6 | globlastp |
| 1599 | LNU611 | brachypodium\|09v1\|DV481204 | 4324 | 552 | 88.3 | globlastp |
| 1600 | LNU611 | brachypodium\|12v1\|BRADI1G25370_P1 | 4324 | 552 | 88.3 | globlastp |
| 1601 | LNU611 | rye\|12v1\|DRR001012.103432_P1 | 4325 | 552 | 87.4 | globlastp |
| 1602 | LNU611 | wheat\|12v3\|BQ838864_P1 | 4326 | 552 | 87 | globlastp |
| 1603 | LNU611 | barley\|12v1\|BQ469071_P1 | 4327 | 552 | 86.9 | globlastp |
| 1604 | LNU612 | sugarcane\|10v1\|CA132519 | 4328 | 553 | 87.1 | globlastp |
| 1605 | LNU612 | sorghum\|12v1\|SB04G033350_P1 | 4329 | 553 | 85.1 | globlastp |
| 1606 | LNU612 | sorghum\|09v1\|SB04G033350 | 4329 | 553 | 85.1 | globlastp |
| 1607 | LNU613 | sorghum\|12v1\|AW286102_P1 | 4330 | 554 | 85.7 | globlastp |
| 1608 | LNU613 | sorghum\|12v1\|SB02G043670_P1 | 4330 | 554 | 85.7 | globlastp |
| 1609 | LNU613 | sorghum\|12v1\|AW677100_P1 | 4331 | 554 | 83.6 | globlastp |
| 1610 | LNU613 | sorghum\|12v1\|SB01G013150_P1 | 4331 | 554 | 83.6 | globlastp |
| 1611 | LNU613 | maize\|10v1\|CF243453_P1 | 4332 | 554 | 83.5 | globlastp |
| 1612 | LNU613 | foxtail_millet\|11v3\|PHY7SI030392M_P1 | 4333 | 554 | 81 | globlastp |
| 1613 | LNU613 | foxtail_millet\|11v3\|SICRP012595_P1 | 4333 | 554 | 81 | globlastp |
| 1614 | LNU614 | sugarcane\|10v1\|BQ533035 | 4334 | 555 | 91.4 | globlastp |
| 1615 | LNU614 | sorghum\|09v1\|SB02G032600 | 4335 | 555 | 89.4 | globlastp |
| 1616 | LNU614 | sorghum\|12v1\|SB02G032600_P1 | 4336 | 555 | 88.8 | globlastp |
| 1617 | LNU614 | maize\|10v1\|AW257896_P1 | 4337 | 555 | 88.2 | globlastp |
| 1618 | LNU614 | foxtail_millet\|11v3\|PHY7SI030430M_P1 | 4338 | 555 | 86.1 | globlastp |
| 1619 | LNU614 | foxtail_millet\|10v2\|SICRP040406 | 4338 | 555 | 86.1 | globlastp |
| 1620 | LNU614 | millet\|10v1\|EVO454PM120062_P1 | 4339 | 555 | 82.8 | globlastp |
| 1621 | LNU614 | switchgrass\|gb167\|DN150612 | 4340 | 555 | 82.79 | glotblastn |
| 1622 | LNU615 | maize\|10v1\|AW055901_P1 | 4341 | 556 | 91.2 | globlastp |
| 1623 | LNU615 | sorghum\|09v1\|SB02G034970 | 4342 | 556 | 86.4 | globlastp |
| 1624 | LNU615 | sorghum\|12v1\|SB02G034970_P1 | 4343 | 556 | 85.1 | globlastp |
| 1625 | LNU615 | foxtail_millet\|11v3\|PHY7SI030589M_P1 | 4344 | 556 | 83.1 | globlastp |
| 1626 | LNU615 | millet\|10v1\|EVO454PM103745_P1 | 4345 | 556 | 81.8 | globlastp |
| 1627 | LNU615 | rye\|12v1\|DRR001012.101335_P1 | 4346 | 556 | 81.1 | globlastp |
| 1628 | LNU615 | wheat\|10v2\|CA685634 | 4347 | 556 | 80.5 | globlastp |
| 1629 | LNU616 | sorghum\|09v1\|SB08G007360 | 4348 | 557 | 88.8 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1630 | LNU616 | foxtail_millet|11v3|PHY7SI001933M_P1 | 4349 | 557 | 82.8 | globlastp |
| 1631 | LNU617 | sorghum|09v1|SB10G029730 | 4350 | 558 | 80.6 | globlastp |
| 1632 | LNU617 | sorghum|12v1|SB10G029730_P1 | 4350 | 558 | 80.6 | globlastp |
| 1633 | LNU617 | maize|10v1|BG841101_P1 | 4351 | 558 | 80.4 | globlastp |
| 1634 | LNU619 | sorghum|09v1|SB09G029860 | 4352 | 560 | 92.2 | globlastp |
| 1635 | LNU619 | sorghum|12v1|SB09G029860_P1 | 4352 | 560 | 92.2 | globlastp |
| 1636 | LNU619 | wheat|10v2|CA484983 | 4352 | 560 | 92.2 | globlastp |
| 1637 | LNU619 | sugarcane|10v1|BQ534174 | 4353 | 560 | 91.6 | globlastp |
| 1638 | LNU619 | switchgrass|gb167|DN146640 | 4354 | 560 | 86.1 | globlastp |
| 1639 | LNU619 | switchgrass|gb167|FL956284 | 4355 | 560 | 86.1 | globlastp |
| 1640 | LNU619 | cenchrus|gb166|EB664255_T1 | 4356 | 560 | 84.34 | glotblastn |
| 1641 | LNU619 | cynodon|10v1|ES292738_P1 | 4357 | 560 | 83.1 | globlastp |
| 1642 | LNU619 | millet|10v1|AY823547_T1 | 4358 | 560 | 80.12 | glotblastn |
| 1643 | LNU619 | foxtail_millet|11v3|PHY7SI022591M_P1 | 4359 | 560 | 80 | globlastp |
| 1644 | LNU620 | sorghum|09v1|SB06G021070 | 4360 | 561 | 94.5 | globlastp |
| 1645 | LNU620 | sorghum|12v1|SB06G021070_P1 | 4360 | 561 | 94.5 | globlastp |
| 1646 | LNU620 | millet|10v1|EVO454PM010657_P1 | 4361 | 561 | 90 | globlastp |
| 1647 | LNU620 | foxtail_millet|11v3|PHY7SI009899M_P1 | 4362 | 561 | 89.6 | globlastp |
| 1648 | LNU620 | rice|11v1|BI808294_P1 | 4363 | 561 | 88.6 | globlastp |
| 1649 | LNU620 | rice|gb170|OS04G41460 | 4363 | 561 | 88.6 | globlastp |
| 1650 | LNU620 | brachypodium|12v1|BRADI5G14367_P1 | 4364 | 561 | 88 | globlastp |
| 1651 | LNU620 | wheat|12v3|BI751987_P1 | 4365 | 561 | 86.4 | globlastp |
| 1652 | LNU620 | wheat|12v3|SRR073322X406810D1_P1 | 4366 | 561 | 86.2 | globlastp |
| 1653 | LNU620 | wheat|12v3|BQ578564_T1 | 4367 | 561 | 85.96 | glotblastn |
| 1654 | LNU620 | barley|12v1|BI955355_P1 | 4368 | 561 | 85.9 | globlastp |
| 1655 | LNU620 | foxtail_millet|10v2|FXTRMSLX02076007D1 | 4369 | 561 | 85.9 | globlastp |
| 1656 | LNU620 | rye|12v1|DRR001012.185554_P1 | 4370 | 561 | 85.5 | globlastp |
| 1657 | LNU620 | brachypodium|09v1|DV470090 | 4371 | 561 | 84.1 | globlastp |
| 1658 | LNU621 | sorghum|09v1|SB02G040350 | 4372 | 562 | 91.4 | globlastp |
| 1659 | LNU621 | sorghum|12v1|SB02G040350_P1 | 4372 | 562 | 91.4 | globlastp |
| 1660 | LNU621 | switchgrass|gb167|FE623316 | 4373 | 562 | 89.5 | globlastp |
| 1661 | LNU621 | switchgrass|gb167|FE651182 | 4374 | 562 | 89.5 | globlastp |
| 1662 | LNU621 | foxtail_millet|11v3|PHY7SI031122M_P1 | 4375 | 562 | 88.1 | globlastp |
| 1663 | LNU621 | cenchrus|gb166|EB659649_P1 | 4376 | 562 | 88.1 | globlastp |
| 1664 | LNU621 | millet|10v1|EVO454PM014243_P1 | 4377 | 562 | 87.6 | globlastp |
| 1665 | LNU622 | sorghum|12v1|SB09G005880_T1 | 4378 | 563 | 87.16 | glotblastn |
| 1666 | LNU623 | sorghum|09v1|SB10G007430 | 4379 | 564 | 89.6 | globlastp |
| 1667 | LNU623 | sorghum|12v1|SB10G007430_P1 | 4379 | 564 | 89.6 | globlastp |
| 1668 | LNU623 | sugarcane|10v1|CA106219 | 4380 | 564 | 89 | globlastp |
| 1669 | LNU623 | foxtail_millet|11v3|PHY7SI007426M_P1 | 4381 | 564 | 87.1 | globlastp |
| 1670 | LNU623 | millet|10v1|PMSLX0069182D1_P1 | 4382 | 564 | 85.7 | globlastp |
| 1671 | LNU623 | rice|11v1|CF992509_P1 | 4383 | 564 | 82.5 | globlastp |
| 1672 | LNU623 | rice|gb170|OS06G11310 | 4383 | 564 | 82.5 | globlastp |
| 1673 | LNU623 | foxtail_millet|10v2|FXTRMSLX00180744D2 | 4384 | 564 | 81.8 | globlastp |
| 1674 | LNU624 | foxtail_millet|11v3|PHY7SI031886M_T1 | 4385 | 565 | 81.85 | glotblastn |
| 1675 | LNU624 | maize|10v1|CO527697_P1 | 4386 | 565 | 81.5 | globlastp |
| 1676 | LNU624 | sorghum|09v1|SB02G005120 | 4387 | 565 | 80.3 | globlastp |
| 1677 | LNU624 | sorghum|12v1|SB02G005120_P1 | 4387 | 565 | 80.3 | globlastp |
| 1678 | LNU625 | sorghum|09v1|SB01G038310 | 4388 | 566 | 90.6 | globlastp |
| 1679 | LNU625 | sorghum|12v1|SB01G038310_P1 | 4388 | 566 | 90.6 | globlastp |
| 1680 | LNU626 | sorghum|12v1|SB12V1CUFF41669T1P1_P1 | 4389 | 567 | 94.2 | globlastp |
| 1681 | LNU626 | sorghum|12v1|SB09G020060_T1 | 4390 | 567 | 91.3 | glotblastn |
| 1682 | LNU626 | sorghum|09v1|SB09G020060 | 4391 | 567 | 91.3 | glotblastn |
| 1683 | LNU626 | switchgrass|gb167|FL727337 | 4392 | 567 | 91.2 | globlastp |
| 1684 | LNU626 | foxtail_millet|11v3|PHY7SI021987M_T1 | 4393 | 567 | 89.55 | glotblastn |
| 1685 | LNU626 | switchgrass|gb167|FE647741 | — | 567 | 88.24 | glotblastn |
| 1686 | LNU626 | switchgrass|gb167|FL729354 | — | 567 | 88.24 | glotblastn |
| 1687 | LNU626 | sugarcane|10v1|CA184280 | 4394 | 567 | 87.32 | glotblastn |
| 1688 | LNU626 | foxtail_millet|11v3|PHY7SI023892M_P1 | 4395 | 567 | 87.3 | globlastp |
| 1689 | LNU626 | wheat|10v2|BE488248 | 4396 | 567 | 82.6 | globlastp |
| 1690 | LNU626 | rice|11v1|BI795910_T1 | 4397 | 567 | 81.94 | glotblastn |
| 1691 | LNU626 | barley|12v1|BI950705_P1 | 4398 | 567 | 81.2 | globlastp |
| 1692 | LNU626 | rye|12v1|BE495496_P1 | 4399 | 567 | 80.9 | globlastp |
| 1693 | LNU626 | rye|12v1|DRR001012.131266_P1 | 4399 | 567 | 80.9 | globlastp |
| 1694 | LNU626 | brachypodium|09v1|DV468913 | 4400 | 567 | 80.9 | globlastp |
| 1695 | LNU626 | brachypodium|12v1|BRADI2G25610T2_T1 | 4401 | 567 | 80.88 | glotblastn |
| 1696 | LNU626 | oat|11v1|GR318302_P1 | 4402 | 567 | 80.6 | globlastp |
| 1697 | LNU626 | oat|10v2|GR318302 | 4402 | 567 | 80.6 | globlastp |
| 1698 | LNU628 | sugarcane|10v1|CA083982 | 4403 | 569 | 90.1 | globlastp |

TABLE 2-continued

Homologues of the identified genes/polypeptides for increasing nitrogen use
efficiency, fertilizer use efficiency, yield, seed yield, growth rate, vigor, biomass, oil
content, fiber yield, fiber quality, fiber length, abiotic stress tolerance and/or water
use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1699 | LNU628 | switchgrass\|gb167\|FL737690 | 4404 | 569 | 88.2 | globlastp |
| 1700 | LNU628 | foxtail_millet\|11v3\|PHY7SI027642M_P1 | 4405 | 569 | 86.5 | globlastp |
| 1701 | LNU628 | foxtail_millet\|10v2\|FXTRMSLX01235015D2 | 4405 | 569 | 86.5 | globlastp |
| 1702 | LNU628 | switchgrass\|gb167\|FL726971 | 4406 | 569 | 86.36 | glotblastn |
| 1703 | LNU629 | sugarcane\|10v1\|BQ533778 | 4407 | 570 | 92.3 | globlastp |
| 1704 | LNU629 | foxtail_millet\|11v3\|PHY7SI010402M_P1 | 4408 | 570 | 92.2 | globlastp |
| 1705 | LNU629 | sorghum\|09v1\|SB06G024400 | 4409 | 570 | 91.8 | globlastp |
| 1706 | LNU629 | sorghum\|12v1\|SB06G024400_P1 | 4409 | 570 | 91.8 | globlastp |
| 1707 | LNU629 | switchgrass\|gb167\|DN143299 | 4410 | 570 | 89.2 | globlastp |
| 1708 | LNU629 | millet\|10v1\|EVO454PM225388_P1 | 4411 | 570 | 87.9 | globlastp |
| 1709 | LNU629 | brachypodium\|09v1\|DV481027 | 4412 | 570 | 81.8 | globlastp |
| 1710 | LNU629 | brachypodium\|12v1\|BRADI5G17500_P1 | 4412 | 570 | 81.8 | globlastp |
| 1711 | LNU629 | rye\|12v1\|DRR001012.102258_T1 | 4413 | 570 | 81.72 | glotblastn |
| 1712 | LNU629 | rye\|12v1\|BF429364_P1 | 4414 | 570 | 81.7 | globlastp |
| 1713 | LNU629 | wheat\|10v2\|BE497047 | 4415 | 570 | 81.5 | globlastp |
| 1714 | LNU629 | wheat\|12v3\|BE497047_P1 | 4416 | 570 | 81.2 | globlastp |
| 1715 | LNU629 | rice\|11v1\|BI805954_P1 | 4417 | 570 | 80.7 | globlastp |
| 1716 | LNU629 | rice\|gb170\|OS04G46280 | 4417 | 570 | 80.7 | globlastp |
| 1717 | LNU630 | sorghum\|09v1\|SB01G043250 | 4418 | 571 | 89.8 | globlastp |
| 1718 | LNU630 | sorghum\|12v1\|SB01G043250_P1 | 4418 | 571 | 89.8 | globlastp |
| 1719 | LNU630 | sugarcane\|10v1\|CA090110 | 4419 | 571 | 86.1 | globlastp |
| 1720 | LNU630 | foxtail_millet\|11v3\|PHY7SI037853M_P1 | 4420 | 571 | 85.3 | globlastp |
| 1721 | LNU630 | cynodon\|10v1\|ES296931_P1 | 4421 | 571 | 80.7 | globlastp |
| 1722 | LNU631 | sorghum\|09v1\|SB04G035780 | 4422 | 572 | 89 | globlastp |
| 1723 | LNU631 | sorghum\|12v1\|SB04G035780_P1 | 4422 | 572 | 89 | globlastp |
| 1724 | LNU631 | sorghum\|12v1\|SB12V1CUFF26737T1_T1 | 4423 | 572 | 80.89 | glotblastn |
| 1725 | LNU631 | foxtail_millet\|11v3\|PHY7SI016494M_T1 | 4424 | 572 | 80.59 | glotblastn |
| 1726 | LNU636 | sorghum\|12v1\|SB06G023140_T1 | 4425 | 576 | 85.57 | glotblastn |
| 1727 | LNU636 | foxtail_millet\|11v3\|PHY7SI010511M_T1 | 4426 | 576 | 83.5 | glotblastn |
| 1728 | LNU636 | sugarcane\|10v1\|CA070212 | 4427 | 576 | 83.33 | glotblastn |
| 1729 | LNU636 | switchgrass\|gb167\|DN143844 | 4428 | 576 | 82.52 | glotblastn |
| 1730 | LNU636 | sorghum\|09v1\|SB06G023140 | 4429 | 576 | 82.3 | glotblastn |
| 1731 | LNU637 | sorghum\|09v1\|SB06G032630 | 4430 | 577 | 82.3 | globlastp |
| 1732 | LNU637 | sorghum\|12v1\|SB06G032630_P1 | 4430 | 577 | 82.3 | globlastp |
| 1733 | LNU638 | sorghum\|09v1\|SB09G021250 | 4431 | 578 | 87.4 | globlastp |
| 1734 | LNU638 | sorghum\|12v1\|SB09G021250_P1 | 4431 | 578 | 87.4 | globlastp |
| 1735 | LNU639 | sorghum\|09v1\|SB09G029520 | 4432 | 579 | 97 | globlastp |
| 1736 | LNU639 | sorghum\|12v1\|SB09G029520_P1 | 4432 | 579 | 97 | globlastp |
| 1737 | LNU639 | sugarcane\|10v1\|BQ530628 | 4433 | 579 | 96 | globlastp |
| 1738 | LNU639 | switchgrass\|gb167\|FE621284 | 4434 | 579 | 93.9 | globlastp |
| 1739 | LNU639 | foxtail_millet\|11v3\|EC612482_P1 | 4435 | 579 | 92.9 | globlastp |
| 1740 | LNU639 | millet\|10v1\|EVO454PM006692_P1 | 4436 | 579 | 90.3 | globlastp |
| 1741 | LNU639 | brachypodium\|09v1\|DV469298 | 4437 | 579 | 89.2 | globlastp |
| 1742 | LNU639 | brachypodium\|12v1\|BRADI2G14900_P1 | 4437 | 579 | 89.2 | globlastp |
| 1743 | LNU639 | rice\|11v1\|AU062620_P1 | 4438 | 579 | 88.1 | globlastp |
| 1744 | LNU639 | rice\|gb170\|OS05G50280 | 4438 | 579 | 88.1 | globlastp |
| 1745 | LNU639 | rye\|12v1\|DRR001012.163239_P1 | 4439 | 579 | 85.4 | globlastp |
| 1746 | LNU639 | rye\|12v1\|DRR001012.222446_P1 | 4439 | 579 | 85.4 | globlastp |
| 1747 | LNU639 | rye\|12v1\|DRR001012.148115_T1 | 4440 | 579 | 85.04 | glotblastn |
| 1748 | LNU639 | wheat\|10v2\|BG604701 | 4441 | 579 | 81.2 | globlastp |
| 1749 | LNU640 | sugarcane\|10v1\|CA103381 | 4442 | 580 | 95.1 | globlastp |
| 1750 | LNU640 | sugarcane\|10v1\|CA075747 | 4443 | 580 | 94.3 | globlastp |
| 1751 | LNU640 | switchgrass\|gb167\|DN141995 | 4444 | 580 | 94.2 | globlastp |
| 1752 | LNU640 | switchgrass\|gb167\|FE617205 | 4445 | 580 | 94.2 | globlastp |
| 1753 | LNU640 | foxtail_millet\|11v3\|PHY7SI031612M_P1 | 4446 | 580 | 93.2 | globlastp |
| 1754 | LNU640 | sorghum\|09v1\|SB02G042700 | 4447 | 580 | 91.4 | globlastp |
| 1755 | LNU640 | sorghum\|12v1\|SB02G042700_P1 | 4447 | 580 | 91.4 | globlastp |
| 1756 | LNU640 | millet\|10v1\|EVO454PM109640_P1 | 4448 | 580 | 91.3 | globlastp |
| 1757 | LNU640 | oat\|11v1\|GR356912_P1 | 4449 | 580 | 85.4 | globlastp |
| 1758 | LNU640 | oat\|10v2\|CN816524 | 4449 | 580 | 85.4 | globlastp |
| 1759 | LNU640 | oat\|10v2\|GO581986 | 4449 | 580 | 85.4 | globlastp |
| 1760 | LNU640 | oat\|11v1\|CN816524_P1 | 4450 | 580 | 84.5 | globlastp |
| 1761 | LNU640 | brachypodium\|09v1\|DV487625 | 4451 | 580 | 82.5 | globlastp |
| 1762 | LNU640 | brachypodium\|12v1\|BRADI1G18030_P1 | 4451 | 580 | 82.5 | globlastp |
| 1763 | LNU640 | rice\|11v1\|C27791_P1 | 4452 | 580 | 82.5 | globlastp |
| 1764 | LNU640 | rice\|gb170\|OS07G47670 | 4452 | 580 | 82.5 | globlastp |
| 1765 | LNU640 | fescue\|gb161\|CK802543_P1 | 4453 | 580 | 81.7 | globlastp |
| 1766 | LNU640 | rye\|12v1\|DRR001012.107875_P1 | 4454 | 580 | 81 | globlastp |
| 1767 | LNU640 | rye\|12v1\|DRR001012.111110_P1 | 4455 | 580 | 81 | globlastp |

TABLE 2-continued

Homologues of the identified genes/polypeptides for increasing nitrogen use
efficiency, fertilizer use efficiency, yield, seed yield, growth rate, vigor, biomass, oil
content, fiber yield, fiber quality, fiber length, abiotic stress tolerance and/or water
use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1768 | LNU640 | rye\|12v1\|DRR001012.127235_P1 | 4455 | 580 | 81 | globlastp |
| 1769 | LNU640 | rye\|12v1\|DRR001012.147261_P1 | 4455 | 580 | 81 | globlastp |
| 1770 | LNU640 | wheat\|10v2\|BE492348 | 4455 | 580 | 81 | globlastp |
| 1771 | LNU640 | wheat\|12v3\|BE402632_P1 | 4455 | 580 | 81 | globlastp |
| 1772 | LNU640 | wheat\|10v2\|CA609757 | 4455 | 580 | 81 | globlastp |
| 1773 | LNU640 | wheat\|10v2\|CA710441 | 4455 | 580 | 81 | globlastp |
| 1774 | LNU640 | wheat\|12v3\|BE399841XX1_P1 | 4455 | 580 | 81 | globlastp |
| 1775 | LNU640 | barley\|12v1\|AK252431_T1 | 4456 | 580 | 80.58 | glotblastn |
| 1776 | LNU640 | barley\|12v1\|BF623708_P1 | 4457 | 580 | 80 | globlastp |
| 1777 | LNU640 | barley\|10v2\|BF623708 | 4457 | 580 | 80 | globlastp |
| 1778 | LNU641 | sugarcane\|10v1\|BQ536792 | 4458 | 581 | 98 | globlastp |
| 1779 | LNU641 | sorghum\|09v1\|SB02G008930 | 4459 | 581 | 95.9 | globlastp |
| 1780 | LNU641 | sorghum\|12v1\|SB02G008930_P1 | 4459 | 581 | 95.9 | globlastp |
| 1781 | LNU642 | sorghum\|09v1\|SB05G024850 | 4460 | 582 | 89.2 | globlastp |
| 1782 | LNU642 | sorghum\|12v1\|SB05G024850_P1 | 4460 | 582 | 89.2 | globlastp |
| 1783 | LNU642 | wheat\|12v3\|BE497909_T1 | 4461 | 582 | 81.72 | glotblastn |
| 1784 | LNU642 | wheat\|10v2\|BE497909 | 4462 | 582 | 81.06 | glotblastn |
| 1785 | LNU642 | barley\|10v2\|BE412794 | 4463 | 582 | 80.5 | globlastp |
| 1786 | LNU642 | rice\|11v1\|AA751698_T1 | 4464 | 582 | 80.13 | glotblastn |
| 1787 | LNU642 | rice\|gb170\|OS11G40510 | 4465 | 582 | 80.13 | glotblastn |
| 1788 | LNU646 | foxtail_millet\|11v3\|PHY7SI016961M_P1 | 4466 | 586 | 91.5 | globlastp |
| 1789 | LNU646 | millet\|10v1\|EVO454PM013263_P1 | 4467 | 586 | 90.4 | globlastp |
| 1790 | LNU646 | brachypodium\|09v1\|DV477169 | 4468 | 586 | 90 | globlastp |
| 1791 | LNU646 | brachypodium\|12v1\|BRADI3G51577_P1 | 4468 | 586 | 90 | globlastp |
| 1792 | LNU646 | switchgrass\|gb167\|DN143961 | 4469 | 586 | 90 | globlastp |
| 1793 | LNU646 | rye\|12v1\|DRR001012.128773_P1 | 4470 | 586 | 89.8 | globlastp |
| 1794 | LNU646 | switchgrass\|gb167\|DN143611 | 4471 | 586 | 89.8 | globlastp |
| 1795 | LNU646 | wheat\|10v2\|BE585663 | 4472 | 586 | 89.6 | globlastp |
| 1796 | LNU646 | wheat\|12v3\|BE585663_P1 | 4473 | 586 | 89.6 | globlastp |
| 1797 | LNU646 | wheat\|10v2\|BE585663 | — | 586 | 89.6 | globlastp |
| 1798 | LNU646 | sugarcane\|10v1\|CA076243 | 4474 | 586 | 89.5 | globlastp |
| 1799 | LNU646 | sorghum\|09v1\|SB04G031990 | 4475 | 586 | 89.1 | globlastp |
| 1800 | LNU646 | sorghum\|12v1\|SB04G031990_P1 | 4475 | 586 | 89.1 | globlastp |
| 1801 | LNU646 | barley\|10v2\|AJ000229 | 4476 | 586 | 88.9 | globlastp |
| 1802 | LNU646 | maize\|10v1\|AI491387_P1 | 4477 | 586 | 88.9 | globlastp |
| 1803 | LNU646 | barley\|12v1\|AJ000229_P1 | 4478 | 586 | 83.7 | globlastp |
| 1804 | LNU647 | foxtail_millet\|11v3\|PHY7SI034367M_P1 | 4479 | 587 | 80.9 | globlastp |
| 1805 | LNU649 | maize\|10v1\|BE344739_P1 | 4480 | 589 | 96.7 | globlastp |
| 1806 | LNU649 | sugarcane\|10v1\|CA090939 | 4481 | 589 | 96.7 | globlastp |
| 1807 | LNU649 | maize\|10v1\|BI359405_P1 | 4482 | 589 | 95.9 | globlastp |
| 1808 | LNU649 | foxtail_millet\|11v3\|PHY7SI023653M_P1 | 4483 | 589 | 95.1 | globlastp |
| 1809 | LNU649 | foxtail_millet\|10v2\|SICRP008866 | 4483 | 589 | 95.1 | globlastp |
| 1810 | LNU649 | millet\|10v1\|PMSLX0076328D1_P1 | 4484 | 589 | 87.7 | globlastp |
| 1811 | LNU649 | switchgrass\|gb167\|FL776361 | 4485 | 589 | 86.9 | globlastp |
| 1812 | LNU649 | wheat\|12v3\|BE399625_P1 | 4486 | 589 | 86.1 | globlastp |
| 1813 | LNU649 | wheat\|10v2\|BE399625 | 4486 | 589 | 86.1 | globlastp |
| 1814 | LNU649 | rye\|12v1\|DRR001012.205062_P1 | 4487 | 589 | 84.4 | globlastp |
| 1815 | LNU649 | barley\|10v2\|BF622063 | 4488 | 589 | 84.4 | globlastp |
| 1816 | LNU649 | barley\|12v1\|BF622063_P1 | 4489 | 589 | 84.4 | globlastp |
| 1817 | LNU649 | barley\|12v1\|BF254617_P1 | 4490 | 589 | 83.6 | globlastp |
| 1818 | LNU649 | foxtail_millet\|11v3\|PHY7SI011675M_T1 | 4491 | 589 | 82.79 | glotblastn |
| 1819 | LNU649 | brachypodium\|09v1\|DV472759 | 4492 | 589 | 80.5 | globlastp |
| 1820 | LNU649 | brachypodium\|12v1\|BRADI5G03950_P1 | 4492 | 589 | 80.5 | globlastp |
| 1821 | LNU650 | sugarcane\|10v1\|CA083728 | 4493 | 590 | 97.2 | globlastp |
| 1822 | LNU650 | foxtail_millet\|11v3\|PHY7SI036946M_P1 | 4494 | 590 | 89 | globlastp |
| 1823 | LNU650 | switchgrass\|gb167\|FL690836 | 4495 | 590 | 86.93 | glotblastn |
| 1824 | LNU650 | cenchrus\|gb166\|EB655050_P1 | 4496 | 590 | 86.9 | globlastp |
| 1825 | LNU650 | foxtail_millet\|11v3\|PHY7SI036937M_P1 | 4497 | 590 | 84.5 | globlastp |
| 1826 | LNU650 | foxtail_millet\|10v2\|SICRP023692 | 4497 | 590 | 84.5 | globlastp |
| 1827 | LNU650 | foxtail_millet\|11v3\|PHY7SI034209M_T1 | 4498 | 590 | 84.4 | glotblastn |
| 1828 | LNU650 | brachypodium\|09v1\|SRR031797S0002550 | 4499 | 590 | 81.3 | globlastp |
| 1829 | LNU650 | brachypodium\|12v1\|BRADI1G04320_P1 | 4499 | 590 | 81.3 | globlastp |
| 1830 | LNU650 | maize\|10v1\|AI967009_P1 | 4500 | 590 | 80.9 | globlastp |
| 1831 | LNU650 | maize\|10v1\|CA989069_P1 | 4500 | 590 | 80.9 | globlastp |
| 1832 | LNU650 | wheat\|12v3\|CA646923_T1 | 4501 | 590 | 80.63 | glotblastn |
| 1833 | LNU650 | wheat\|10v2\|BE585690 | 4502 | 590 | 80.3 | globlastp |
| 1834 | LNU650 | wheat\|12v3\|BE585690_P1 | 4502 | 590 | 80.3 | globlastp |
| 1835 | LNU650 | pseudoroegneria\|gb167\|FF358010 | 4503 | 590 | 80.2 | globlastp |
| 1836 | LNU651 | maize\|10v1\|AI941898_P1 | 4504 | 591 | 89 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1837 | LNU652 | maize\|10v1\|SRR014549S0057343_P1 | 4505 | 592 | 83.1 | globlastp |
| 1838 | LNU653 | maize\|10v1\|AW062130_P1 | 4506 | 593 | 85.1 | globlastp |
| 1839 | LNU653 | maize\|10v1\|CK347105_P1 | 4507 | 593 | 85.1 | globlastp |
| 1840 | LNU655 | sugarcane\|10v1\|BQ533948 | 4508 | 595 | 97.5 | globlastp |
| 1841 | LNU655 | switchgrass\|gb167\|DN144892 | 4509 | 595 | 90.7 | globlastp |
| 1842 | LNU655 | switchgrass\|gb167\|DN142239 | 4510 | 595 | 88.8 | globlastp |
| 1843 | LNU655 | rice\|11v1\|AU172330_P1 | 4511 | 595 | 86.6 | globlastp |
| 1844 | LNU655 | rye\|12v1\|DRR001012.11779_P1 | 4512 | 595 | 85.6 | globlastp |
| 1845 | LNU655 | wheat\|10v2\|BE499042 | 4513 | 595 | 85.3 | globlastp |
| 1846 | LNU655 | rye\|12v1\|DRR001012.251657_P1 | 4514 | 595 | 85.1 | globlastp |
| 1847 | LNU655 | wheat\|12v3\|BE488261_P1 | 4515 | 595 | 85 | globlastp |
| 1848 | LNU655 | wheat\|10v2\|BE488261 | 4516 | 595 | 84.2 | globlastp |
| 1849 | LNU655 | *brachypodium*\|09v1\|DV473717 | 4517 | 595 | 83.6 | globlastp |
| 1850 | LNU655 | foxtail_millet\|10v2\|SICRP008719 | 4518 | 595 | 83.33 | glotblastn |
| 1851 | LNU655 | oat\|11v1\|GR320474_P1 | 4519 | 595 | 80.9 | globlastp |
| 1852 | LNU655 | foxtail_millet\|11v3\|PHY7SI036323M_P1 | 4520 | 595 | 80.3 | globlastp |
| 1853 | LNU655 | oat\|10v2\|GR320474 | 4521 | 595 | 80.3 | globlastp |
| 1854 | LNU656 | *sorghum*\|09v1\|SB02G035030 | 4522 | 596 | 89 | globlastp |
| 1855 | LNU656 | *sorghum*\|12v1\|SB02G035030_P1 | 4522 | 596 | 89 | globlastp |
| 1856 | LNU656 | maize\|10v1\|AI637198_P1 | 4523 | 596 | 88.8 | globlastp |
| 1857 | LNU656 | switchgrass\|gb167\|FE610306 | 4524 | 596 | 80.1 | globlastp |
| 1858 | LNU658 | sugarcane\|10v1\|CA072327 | 4525 | 598 | 93.4 | globlastp |
| 1859 | LNU658 | maize\|10v1\|BG878594_P1 | 4526 | 598 | 87.3 | globlastp |
| 1860 | LNU658 | switchgrass\|gb167\|DN144698 | 4527 | 598 | 82.7 | globlastp |
| 1861 | LNU658 | foxtail_millet\|11v3\|PHY7SI029394M_P1 | 4528 | 598 | 81.5 | globlastp |
| 1862 | LNU658 | foxtail_millet\|10v2\|FXTRMSLX01561284D1 | 4529 | 598 | 81.2 | globlastp |
| 1863 | LNU660 | foxtail_millet\|11v3\|PHY7SI029479M_P1 | 4530 | 600 | 96.2 | globlastp |
| 1864 | LNU660 | switchgrass\|gb167\|DN140730 | 4531 | 600 | 96 | globlastp |
| 1865 | LNU660 | maize\|10v1\|BI596082_P1 | 4532 | 600 | 95.3 | globlastp |
| 1866 | LNU660 | rice\|11v1\|AU057160_P1 | 4533 | 600 | 92.7 | globlastp |
| 1867 | LNU660 | rice\|gb170\|OS07G37320 | 4533 | 600 | 92.7 | globlastp |
| 1868 | LNU660 | wheat\|10v2\|BE415584 | 4534 | 600 | 92.1 | globlastp |
| 1869 | LNU660 | wheat\|12v3\|BE415584_P1 | 4534 | 600 | 92.1 | globlastp |
| 1870 | LNU660 | barley\|12v1\|BQ768859_P1 | 4535 | 600 | 91.9 | globlastp |
| 1871 | LNU660 | rye\|12v1\|DRR001012.186208_T1 | 4536 | 600 | 91.37 | glotblastn |
| 1872 | LNU660 | *brachypodium*\|09v1\|DV475580 | 4537 | 600 | 91.2 | globlastp |
| 1873 | LNU660 | *brachypodium*\|12v1\|BRADI1G24820_P1 | 4537 | 600 | 91.2 | globlastp |
| 1874 | LNU660 | oat\|11v1\|GR327292_P1 | 4538 | 600 | 90.6 | globlastp |
| 1875 | LNU660 | oat\|10v2\|GR327292 | 4538 | 600 | 90.6 | globlastp |
| 1876 | LNU660 | millet\|10v1\|PMSLX0024631D1_P1 | 4539 | 600 | 81.9 | globlastp |
| 1877 | LNU662 | sugarcane\|10v1\|BQ533776 | 4540 | 602 | 97.12 | glotblastn |
| 1878 | LNU662 | maize\|10v1\|W49442_P1 | 4541 | 602 | 92.9 | globlastp |
| 1879 | LNU662 | maize\|10v1\|AW258069_P1 | 4542 | 602 | 91.7 | globlastp |
| 1880 | LNU662 | foxtail_millet\|11v3\|PHY7SI030696M_P1 | 4543 | 602 | 88.7 | globlastp |
| 1881 | LNU662 | rice\|11v1\|BI305189_P1 | 4544 | 602 | 85.4 | globlastp |
| 1882 | LNU662 | wheat\|12v3\|EV254010_P1 | 4545 | 602 | 85.3 | globlastp |
| 1883 | LNU662 | wheat\|12v3\|BE604331_P1 | 4545 | 602 | 85.3 | globlastp |
| 1884 | LNU662 | wheat\|10v2\|BE604331 | 4546 | 602 | 85.1 | globlastp |
| 1885 | LNU662 | wheat\|12v3\|BE591429_P1 | 4547 | 602 | 85 | globlastp |
| 1886 | LNU662 | oat\|11v1\|GR314358_P1 | 4548 | 602 | 84.9 | globlastp |
| 1887 | LNU662 | oat\|10v2\|GR314358 | 4549 | 602 | 84.9 | globlastp |
| 1888 | LNU662 | oat\|11v1\|GR318043_P1 | 4550 | 602 | 83.7 | globlastp |
| 1889 | LNU662 | *brachypodium*\|09v1\|DV484093 | 4551 | 602 | 83.6 | globlastp |
| 1890 | LNU662 | *brachypodium*\|12v1\|BRADI1G19010_P1 | 4551 | 602 | 83.6 | globlastp |
| 1891 | LNU662 | wheat\|10v2\|BE591429 | 4552 | 602 | 83.6 | globlastp |
| 1892 | LNU662 | foxtail_millet\|10v2\|FXTRMSLX00003847D1 | 4553 | 602 | 82.9 | globlastp |
| 1893 | LNU662 | fescue\|gb161\|DT679383_P1 | 4554 | 602 | 82.7 | globlastp |
| 1894 | LNU662 | millet\|10v1\|EVO454PM008580_P1 | 4555 | 602 | 82.4 | globlastp |
| 1895 | LNU662 | wheat\|12v3\|BQ903127_T1 | 4556 | 602 | 81.23 | glotblastn |
| 1896 | LNU662 | switchgrass\|gb167\|DN147295 | 4557 | 602 | 81.2 | globlastp |
| 1897 | LNU663 | maize\|10v1\|BM381036_P1 | 4558 | 603 | 86.1 | globlastp |
| 1898 | LNU664 | maize\|10v1\|ES702547_P1 | 4559 | 604 | 90 | globlastp |
| 1899 | LNU664 | maize\|10v1\|BM056056_P1 | 4560 | 604 | 87.6 | globlastp |
| 1900 | LNU664 | millet\|10v1\|PMSLX0024589D1_P1 | 4561 | 604 | 85.4 | globlastp |
| 1901 | LNU664 | foxtail_millet\|11v3\|PHY7SI003362M_P1 | 4562 | 604 | 85.1 | globlastp |
| 1902 | LNU664 | foxtail_millet\|10v2\|SICRP026413 | 4562 | 604 | 85.1 | globlastp |
| 1903 | LNU664 | sugarcane\|10v1\|CA183749 | 4563 | 604 | 85 | globlastp |
| 1904 | LNU665 | maize\|10v1\|CD651118_P1 | 4564 | 605 | 95 | globlastp |
| 1905 | LNU665 | foxtail_millet\|11v3\|PHY7SI001496M_P1 | 4565 | 605 | 94.3 | globlastp |

TABLE 2-continued

Homologues of the identified genes/polypeptides for increasing nitrogen use
efficiency, fertilizer use efficiency, yield, seed yield, growth rate, vigor, biomass, oil
content, fiber yield, fiber quality, fiber length, abiotic stress tolerance and/or water
use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1906 | LNU665 | rice\|11v1\|AU056833_T1 | 4566 | 605 | 92.66 | glotblastn |
| 1907 | LNU665 | rice\|gb170\|OS01G04920 | 4567 | 605 | 92.2 | globlastp |
| 1908 | LNU665 | switchgrass\|gb167\|FE598013 | 4568 | 605 | 91.8 | globlastp |
| 1909 | LNU665 | wheat\|10v2\|CA484002 | 4569 | 605 | 89.3 | globlastp |
| 1910 | LNU665 | brachypodium\|09v1\|GT769615 | 4570 | 605 | 89.1 | globlastp |
| 1911 | LNU665 | brachypodium\|12v1\|BRADI2G02800_P1 | 4570 | 605 | 89.1 | globlastp |
| 1912 | LNU665 | wheat\|10v2\|BG908437 | 4571 | 605 | 88 | globlastp |
| 1913 | LNU665 | barley\|12v1\|AV835505_P1 | 4572 | 605 | 87.9 | globlastp |
| 1914 | LNU665 | foxtail_millet\|10v2\|SICRP013378 | 4573 | 605 | 87.87 | glotblastn |
| 1915 | LNU665 | wheat\|12v3\|BG908437_P1 | 4574 | 605 | 87.8 | globlastp |
| 1916 | LNU665 | barley\|10v2\|AV835505 | 4575 | 605 | 86.76 | glotblastn |
| 1917 | LNU665 | millet\|10v1\|EVO454PM870210_P1 | 4576 | 605 | 86 | globlastp |
| 1918 | LNU666 | switchgrass\|gb167\|DN146306 | 4577 | 606 | 89.7 | globlastp |
| 1919 | LNU666 | foxtail_millet\|11v3\|PHY7SI002363M_P1 | 4578 | 606 | 89.4 | globlastp |
| 1920 | LNU666 | cenchrus\|gb166\|EB654062_P1 | 4579 | 606 | 89.4 | globlastp |
| 1921 | LNU666 | lovegrass\|gb167\|EH185704_T1 | 4580 | 606 | 82.96 | glotblastn |
| 1922 | LNU666 | wheat\|12v3\|BE403522_P1 | 4581 | 606 | 81.5 | globlastp |
| 1923 | LNU666 | wheat\|10v2\|CA719396 | 4582 | 606 | 80.9 | globlastp |
| 1924 | LNU666 | rye\|12v1\|DRR001012.222186_P1 | 4583 | 606 | 80.6 | globlastp |
| 1925 | LNU666 | rice\|11v1\|BI813772_P1 | 4584 | 606 | 80.4 | globlastp |
| 1926 | LNU666 | barley\|10v2\|AJ464727 | 4585 | 606 | 80.1 | globlastp |
| 1927 | LNU667 | maize\|10v1\|AW498017_P1 | 4586 | 607 | 92.4 | globlastp |
| 1928 | LNU667 | foxtail_millet\|11v3\|PHY7SI002170M_P1 | 4587 | 607 | 86.3 | globlastp |
| 1929 | LNU667 | foxtail_millet\|10v2\|SICRP020587 | 4588 | 607 | 85.9 | globlastp |
| 1930 | LNU667 | millet\|10v1\|PMSLX0089529D1_P1 | 4589 | 607 | 84 | globlastp |
| 1931 | LNU667 | wheat\|12v3\|BE489911_P1 | 4590 | 607 | 82 | globlastp |
| 1932 | LNU667 | wheat\|10v2\|BE489911 | 4591 | 607 | 81.6 | globlastp |
| 1933 | LNU667 | barley\|10v2\|BF621713 | 4592 | 607 | 81.15 | glotblastn |
| 1934 | LNU667 | barley\|12v1\|BF621713_T1 | 4592 | 607 | 81.15 | glotblastn |
| 1935 | LNU667 | oat\|11v1\|GR318859_P1 | 4593 | 607 | 81 | globlastp |
| 1936 | LNU667 | oat\|10v2\|GR318859 | 4593 | 607 | 81 | globlastp |
| 1937 | LNU667 | brachypodium\|09v1\|DV484501 | 4594 | 607 | 80.92 | glotblastn |
| 1938 | LNU667 | brachypodium\|12v1\|BRADI2G11740_T1 | 4594 | 607 | 80.92 | glotblastn |
| 1939 | LNU668 | maize\|10v1\|AI622437_P1 | 4595 | 608 | 97.9 | globlastp |
| 1940 | LNU668 | maize\|10v1\|BQ034119_P1 | 4596 | 608 | 96.9 | globlastp |
| 1941 | LNU668 | foxtail_millet\|11v3\|PHY7SI000286M_P1 | 4597 | 608 | 96.6 | globlastp |
| 1942 | LNU668 | rice\|11v1\|CR278698_P1 | 4598 | 608 | 93.2 | globlastp |
| 1943 | LNU668 | brachypodium\|09v1\|GT825903 | 4599 | 608 | 91.2 | globlastp |
| 1944 | LNU668 | brachypodium\|12v1\|BRADI2G40600_P1 | 4599 | 608 | 91.2 | globlastp |
| 1945 | LNU668 | wheat\|10v2\|BE515709 | 4600 | 608 | 88.79 | glotblastn |
| 1946 | LNU668 | rice\|gb170\|OS01G36390 | 4601 | 608 | 88.1 | globlastp |
| 1947 | LNU668 | barley\|12v1\|BI950624_P1 | 4602 | 608 | 88 | globlastp |
| 1948 | LNU668 | rye\|12v1\|DRR0011012.119621_P1 | 4603 | 608 | 80.5 | globlastp |
| 1949 | LNU668 | wheat\|12v3\|CA651520_P1 | 4604 | 608 | 80.3 | globlastp |
| 1950 | LNU669 | sugarcane\|10v1\|CA066446 | 4605 | 609 | 95 | globlastp |
| 1951 | LNU669 | foxtail_millet\|11v3\|PHY7SI004153M_P1 | 4606 | 609 | 84.6 | globlastp |
| 1952 | LNU669 | maize\|10v1\|AI861163_P1 | 4607 | 609 | 84.6 | globlastp |
| 1953 | LNU669 | maize\|10v1\|AI670565_P1 | 4608 | 609 | 82.6 | globlastp |
| 1954 | LNU669 | switchgrass\|gb167\|DN147528 | 4609 | 609 | 82.2 | globlastp |
| 1955 | LNU669 | millet\|10v1\|EVO454PM009523_P1 | 4610 | 609 | 81.9 | globlastp |
| 1956 | LNU670 | maize\|10v1\|BM379220_P1 | 4611 | 610 | 89.9 | globlastp |
| 1957 | LNU671 | maize\|10v1\|AI711610_P1 | 4612 | 611 | 96.8 | globlastp |
| 1958 | LNU671 | foxtail_millet\|11v3\|PHY7SI010253M_P1 | 4613 | 611 | 86.4 | globlastp |
| 1959 | LNU671 | rice\|11v1\|BI813150_P1 | 4614 | 611 | 82.6 | globlastp |
| 1960 | LNU671 | rice\|gb170\|OS01G54370 | 4614 | 611 | 82.6 | globlastp |
| 1961 | LNU671 | rye\|12v1\|DRR0011012.162604_P1 | 4615 | 611 | 82.4 | globlastp |
| 1962 | LNU671 | barley\|12v1\|BF625533_P1 | 4616 | 611 | 82.2 | globlastp |
| 1963 | LNU671 | brachypodium\|09v1\|DV483246 | 4617 | 611 | 82.1 | globlastp |
| 1964 | LNU671 | brachypodium\|12v1\|BRADI2G49710_P1 | 4617 | 611 | 82.1 | globlastp |
| 1965 | LNU671 | wheat\|10v2\|BE605041 | 4618 | 611 | 81.6 | globlastp |
| 1966 | LNU671 | foxtail_millet\|11v3\|PHY7SI013743M_P1 | 4619 | 611 | 80.6 | globlastp |
| 1967 | LNU671 | foxtail_millet\|10v2\|FXTRMSLX00006190D1 | 4620 | 611 | 80.1 | globlastp |
| 1968 | LNU673 | maize\|10v1\|BE123351_T1 | 4621 | 613 | 87.96 | glotblastn |
| 1969 | LNU673 | foxtail_millet\|11v3\|PHY7SI000879M_P1 | 4622 | 613 | 87.7 | globlastp |
| 1970 | LNU673 | switchgrass\|gb167\|DN144194 | 4623 | 613 | 86.3 | globlastp |
| 1971 | LNU673 | switchgrass\|gb167\|FL694044 | 4624 | 613 | 86.06 | glotblastn |
| 1972 | LNU673 | foxtail_millet\|10v2\|SICRP023497 | 4625 | 613 | 84.84 | glotblastn |
| 1973 | LNU673 | sugarcane\|10v1\|CA167167 | 4626 | 613 | 84.5 | globlastp |
| 1974 | LNU674 | maize\|10v1\|BQ280294_P1 | 4627 | 614 | 93.5 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to Polyp. SEQ ID NO: | % global identity | Algor. |
|---|---|---|---|---|---|---|
| 1975 | LNU674 | foxtail_millet\|11v3\|PHY7SI013549M_P1 | 4628 | 614 | 87.5 | globlastp |
| 1976 | LNU674 | foxtail_millet\|11v3\|PHY7SI038938M_P1 | 4629 | 614 | 84.4 | globlastp |
| 1977 | LNU674 | foxtail_millet\|10v2\|SICRP021815 | 4629 | 614 | 84.4 | globlastp |
| 1978 | LNU674 | barley\|12v1\|BY845995_P1 | 4630 | 614 | 81.7 | globlastp |
| 1979 | LNU674 | foxtail_millet\|11v3\|SICRP033665_P1 | 4631 | 614 | 81.4 | globlastp |
| 1980 | LNU675 | maize\|10v1\|AI615026_P1 | 615 | 615 | 100 | globlastp |
| 1981 | LNU675 | millet\|10v1\|EVO454PM002806_P1 | 615 | 615 | 100 | globlastp |
| 1982 | LNU675 | sugarcane\|10v1\|CA076219 | 615 | 615 | 100 | globlastp |
| 1983 | LNU675 | foxtail_millet\|11v3\|PHY7SI018590M_P1 | 4632 | 615 | 99.3 | globlastp |
| 1984 | LNU675 | foxtail_millet\|10v2\|FXTRMSLX00471806D1 | 4632 | 615 | 99.3 | globlastp |
| 1985 | LNU675 | switchgrass\|gb167\|DN145674 | 4633 | 615 | 99.3 | globlastp |
| 1986 | LNU675 | maize\|10v1\|AI600408_P1 | 4634 | 615 | 98.7 | globlastp |
| 1987 | LNU675 | *cynodon*\|10v1\|ES305579_P1 | 4635 | 615 | 94.1 | globlastp |
| 1988 | LNU675 | rice\|11v1\|AU029831_P1 | 4636 | 615 | 90.1 | globlastp |
| 1989 | LNU675 | rice\|gb170\|OS02G02960 | 4636 | 615 | 90.1 | globlastp |
| 1990 | LNU675 | barley\|12v1\|BE420758_P1 | 4637 | 615 | 89.5 | globlastp |
| 1991 | LNU675 | barley\|10v2\|BE420758 | 4637 | 615 | 89.5 | globlastp |
| 1992 | LNU675 | *brachypodium*\|09v1\|DV473831 | 4638 | 615 | 89.5 | globlastp |
| 1993 | LNU675 | *brachypodium*\|12v1\|BRADI3G02150_P1 | 4638 | 615 | 89.5 | globlastp |
| 1994 | LNU675 | wheat\|10v2\|BE418796 | 4639 | 615 | 89.5 | globlastp |
| 1995 | LNU675 | wheat\|12v3\|BE418796_P1 | 4639 | 615 | 89.5 | globlastp |
| 1996 | LNU675 | wheat\|10v2\|BE420316 | 4639 | 615 | 89.5 | globlastp |
| 1997 | LNU675 | oat\|11v1\|CN819460_P1 | 4640 | 615 | 88.2 | globlastp |
| 1998 | LNU675 | oat\|10v2\|CN819460 | 4640 | 615 | 88.2 | globlastp |
| 1999 | LNU675 | rye\|12v1\|DRR001012.101453_P1 | 4641 | 615 | 87.5 | globlastp |
| 2000 | LNU675 | rye\|12v1\|DRR001012.164863_P1 | 4641 | 615 | 87.5 | globlastp |
| 2001 | LNU675 | rye\|12v1\|DRR001012.235492_P1 | 4641 | 615 | 87.5 | globlastp |
| 2002 | LNU675 | rye\|12v1\|DRR001015.933735_P1 | 4641 | 615 | 87.5 | globlastp |
| 2003 | LNU676 | switchgrass\|gb167\|FL715661 | 4642 | 616 | 95.6 | glotblastn |
| 2004 | LNU676 | maize\|10v1\|BE344891_P1 | 4643 | 616 | 93.3 | globlastp |
| 2005 | LNU676 | millet\|10v1\|EVO454PM014837_P1 | 4644 | 616 | 92.2 | globlastp |
| 2006 | LNU676 | foxtail_millet\|11v3\|PHY7SI017477M_P1 | 4645 | 616 | 92 | globlastp |
| 2007 | LNU676 | foxtail_millet\|10v2\|FXTRMSLX00684936D2 | 4646 | 616 | 92 | globlastp |
| 2008 | LNU676 | maize\|10v1\|BM079687_P1 | 4647 | 616 | 92 | globlastp |
| 2009 | LNU676 | rice\|11v1\|AU062744_P1 | 4648 | 616 | 89.3 | globlastp |
| 2010 | LNU676 | rice\|gb170\|OS02G07880 | 4648 | 616 | 89.3 | globlastp |
| 2011 | LNU676 | *brachypodium*\|09v1\|SRR031798S0375913 | 4649 | 616 | 87.5 | globlastp |
| 2012 | LNU676 | *brachypodium*\|12v1\|BRADI3G05600_P1 | 4649 | 616 | 87.5 | globlastp |
| 2013 | LNU676 | barley\|12v1\|BE412404_T1 | 4650 | 616 | 81.4 | glotblastn |
| 2014 | LNU676 | rye\|12v1\|DRR001012.13476_T1 | 4651 | 616 | 81.4 | glotblastn |
| 2015 | LNU676 | barley\|10v2\|BE412404 | 4650 | 616 | 81.4 | glotblastn |
| 2016 | LNU676 | rye\|12v1\|DRR001012.112534_P1 | 4652 | 616 | 81.3 | globlastp |
| 2017 | LNU676 | wheat\|12v3\|CA614931_P1 | 4653 | 616 | 81.1 | globlastp |
| 2018 | LNU676 | rice\|11v1\|BM418852_P1 | 4654 | 616 | 81 | globlastp |
| 2019 | LNU676 | rice\|gb170\|OS06G45110 | 4654 | 616 | 81 | globlastp |
| 2020 | LNU676 | barley\|10v2\|AV833548 | 4655 | 616 | 80.8 | globlastp |
| 2021 | LNU676 | barley\|12v1\|AV833548_P1 | 4655 | 616 | 80.8 | globlastp |
| 2022 | LNU676 | wheat\|10v2\|BE443529XX2 | 4656 | 616 | 80.8 | globlastp |
| 2023 | LNU676 | wheat\|10v2\|BF201318 | 4657 | 616 | 80.72 | glotblastn |
| 2024 | LNU676 | wheat\|12v3\|BF201318_T1 | 4657 | 616 | 80.72 | glotblastn |
| 2025 | LNU676 | rye\|12v1\|DRR001012.165574_T1 | 4658 | 616 | 80.36 | glotblastn |
| 2026 | LNU676 | maize\|10v1\|AI600791_T1 | 4659 | 616 | 80.36 | glotblastn |
| 2027 | LNU676 | foxtail_millet\|11v3\|PHY7SI006666M_P1 | 4660 | 616 | 80.3 | globlastp |
| 2028 | LNU676 | millet\|10v1\|EVO454PM002663_P1 | 4661 | 616 | 80.3 | globlastp |
| 2029 | LNU676 | *brachypodium*\|09v1\|DV485740 | 4662 | 616 | 80.21 | glotblastn |
| 2030 | LNU676 | *brachypodium*\|12v1\|BRADI1G31680T2_T1 | 4662 | 616 | 80.21 | glotblastn |
| 2031 | LNU676 | *sorghum*\|09v1\|SB10G026430 | 4663 | 616 | 80.1 | glotblastn |
| 2032 | LNU676 | *sorghum*\|12v1\|SB10G026430_T1 | 4663 | 616 | 80.1 | glotblastn |
| 2033 | LNU677 | foxtail_millet\|11v3\|PHY7SI019744M_P1 | 617 | 617 | 100 | globlastp |
| 2034 | LNU677 | foxtail_millet\|10v2\|SICRP031805 | 617 | 617 | 100 | globlastp |
| 2035 | LNU677 | millet\|10v1\|EVO454PM511564_P1 | 617 | 617 | 100 | globlastp |
| 2036 | LNU677 | wheat\|10v2\|CD491071 | 617 | 617 | 100 | globlastp |
| 2037 | LNU677 | switchgrass\|gb167\|FE601503 | 4664 | 617 | 98.6 | globlastp |
| 2038 | LNU677 | maize\|10v1\|AI677230_P1 | 4665 | 617 | 97.1 | globlastp |
| 2039 | LNU677 | rice\|11v1\|AA751198_P1 | 4666 | 617 | 91.3 | globlastp |
| 2040 | LNU677 | rice\|gb170\|OS02G30600 | 4666 | 617 | 91.3 | globlastp |
| 2041 | LNU677 | rye\|12v1\|DRR001012.342485_P1 | 4667 | 617 | 89.9 | globlastp |
| 2042 | LNU677 | wheat\|10v2\|CA605408 | 4668 | 617 | 88.41 | glotblastn |
| 2043 | LNU677 | rye\|12v1\|DRR001012.62188_P1 | 4669 | 617 | 88.4 | globlastp |

TABLE 2-continued

Homologues of the identified genes/polypeptides for increasing nitrogen use
efficiency, fertilizer use efficiency, yield, seed yield, growth rate, vigor, biomass, oil
content, fiber yield, fiber quality, fiber length, abiotic stress tolerance and/or water
use efficiency of a plant

| Polyn. SEQ ID NO: | Hom. to Gene Name | cluster name | Polyp. SEQ ID NO: | Hom. to Polyp. SEQ ID NO: | % global identity | Algor. |
|---|---|---|---|---|---|---|
| 2044 | LNU677 | fescue\|gb161\|DT702797_P1 | 4670 | 617 | 88.4 | globlastp |
| 2045 | LNU677 | wheat\|10v2\|BE414858 | 4669 | 617 | 88.4 | globlastp |
| 2046 | LNU677 | wheat\|10v2\|CA706208 | 4669 | 617 | 88.4 | globlastp |
| 2047 | LNU677 | wheat\|12v3\|BE414858_P1 | 4669 | 617 | 88.4 | globlastp |
| 2048 | LNU677 | brachypodium\|09v1\|GT784377 | 4671 | 617 | 85.5 | globlastp |
| 2049 | LNU677 | brachypodium\|12v1\|BRADI3G44080_P1 | 4671 | 617 | 85.5 | globlastp |
| 2050 | LNU677 | oil_palm\|11v1\|EY409787_P1 | 4672 | 617 | 84.1 | globlastp |
| 2051 | LNU677 | wheat\|10v2\|BM135679 | 4673 | 617 | 84.1 | globlastp |
| 2052 | LNU677 | barley\|10v2\|BE601933 | 4674 | 617 | 82.6 | globlastp |
| 2053 | LNU677 | barley\|12v1\|BE601933_P1 | 4674 | 617 | 82.6 | globlastp |
| 2054 | LNU677 | oil_palm\|gb166\|EY409787 | 4675 | 617 | 81.2 | globlastp |
| 2055 | LNU679 | maize\|10v1\|BE050297_P1 | 4676 | 618 | 95.7 | globlastp |
| 2056 | LNU679 | maize\|10v1\|DR790092_P1 | 4677 | 618 | 94.6 | globlastp |
| 2057 | LNU679 | maize\|10v1\|EC878926_T1 | 4678 | 618 | 94.58 | glotblastn |
| 2058 | LNU679 | foxtail_millet\|11v3\|PHY7SI017541M_P1 | 4679 | 618 | 94.2 | globlastp |
| 2059 | LNU679 | foxtail_millet\|10v2\|SICRP009366 | 4680 | 618 | 94.05 | glotblastn |
| 2060 | LNU679 | switchgrass\|gb167\|DN146488 | 4681 | 618 | 92.8 | globlastp |
| 2061 | LNU679 | oat\|11v1\|GR335224_T1 | 4682 | 618 | 85.83 | glotblastn |
| 2062 | LNU679 | brachypodium\|09v1\|DV469559 | 4683 | 618 | 85.8 | globlastp |
| 2063 | LNU679 | brachypodium\|12v1\|BRADI3G59760_P1 | 4683 | 618 | 85.8 | globlastp |
| 2064 | LNU679 | wheat\|12v3\|CA613288_P1 | 4684 | 618 | 85.4 | globlastp |
| 2065 | LNU679 | rye\|12v1\|DRR001012.184756_P1 | 4685 | 618 | 84.2 | globlastp |
| 2066 | LNU679 | rice\|11v1\|BI804850_P1 | 4686 | 618 | 83.5 | globlastp |
| 2067 | LNU679 | rice\|gb170\|OS02G50600 | 4686 | 618 | 83.5 | globlastp |
| 2068 | LNU679 | wheat\|12v3\|CA497662_P1 | 4687 | 618 | 83.2 | globlastp |
| 2069 | LNU679 | rice\|11v1\|C91669_P1 | 4688 | 618 | 83.2 | globlastp |
| 2070 | LNU679 | sorghum\|12v1\|SB10G0088301_P1 | 4689 | 618 | 82.5 | globlastp |
| 2071 | LNU679 | sorghum\|09v1\|SB10G008830 | 4689 | 618 | 82.5 | globlastp |
| 2072 | LNU679 | rye\|12v1\|DRR001012.159088_P1 | 4690 | 618 | 82.3 | globlastp |
| 2073 | LNU679 | foxtail_millet\|11v3\|PHY7SI006389M_P1 | 4691 | 618 | 82.2 | globlastp |
| 2074 | LNU679 | barley\|10v2\|AJ465622 | 4692 | 618 | 82.1 | globlastp |
| 2075 | LNU679 | barley\|12v1\|AJ465622_P1 | 4692 | 618 | 82.1 | globlastp |
| 2076 | LNU679 | maize\|10v1\|CF647382_P1 | 4693 | 618 | 82.1 | globlastp |
| 2077 | LNU679 | rice\|11v1\|OSCRP123945_P1 | 4694 | 618 | 81.8 | globlastp |
| 2078 | LNU679 | brachypodium\|09v1\|DV485262 | 4695 | 618 | 81.6 | globlastp |
| 2079 | LNU679 | brachypodium\|12v1\|BRADI1G44470_P1 | 4695 | 618 | 81.6 | globlastp |
| 2080 | LNU679 | barley\|12v1\|BQ768296_P1 | 4696 | 618 | 81.4 | globlastp |
| 2081 | LNU679 | oat\|11v1\|GR344438_P1 | 4697 | 618 | 80.5 | globlastp |
| 2082 | LNU679 | rye\|12v1\|DRR001012.103042_P1 | 4698 | 618 | 80.5 | globlastp |
| 2083 | LNU679 | oat\|10v2\|GR344438 | 4697 | 618 | 80.5 | globlastp |
| 2084 | LNU679 | wheat\|10v2\|CA597601 | 4699 | 618 | 80.5 | globlastp |
| 2085 | LNU679 | rice\|11v1\|AU091322_P1 | 4700 | 618 | 80.3 | globlastp |
| 2086 | LNU679 | foxtail_millet\|10v2\|SICRP019759 | 4701 | 618 | 80 | globlastp |
| 2087 | LNU680 | sugarcane\|10v1\|BQ537061 | 4702 | 619 | 97.9 | globlastp |
| 2088 | LNU680 | maize\|10v1\|BG873788_P1 | 4703 | 619 | 91.6 | globlastp |
| 2089 | LNU680 | foxtail_millet\|11v3\|PHY7SI018383M_P1 | 4704 | 619 | 89.7 | globlastp |
| 2090 | LNU680 | foxtail_millet\|11v3\|SICRP074661_P1 | 4704 | 619 | 89.7 | globlastp |
| 2091 | LNU680 | switchgrass\|gb167\|DN145253 | 4705 | 619 | 88.9 | globlastp |
| 2092 | LNU680 | switchgrass\|gb167\|DN146790 | 4706 | 619 | 87.7 | globlastp |
| 2093 | LNU680 | millet\|10v1\|EVO454PM476897_P1 | 4707 | 619 | 86.9 | globlastp |
| 2094 | LNU680 | brachypodium\|09v1\|DV474465 | 4708 | 619 | 80.7 | globlastp |
| 2095 | LNU680 | brachypodium\|12v1\|BRADI3G53320_P1 | 4708 | 619 | 80.7 | globlastp |
| 2096 | LNU682 | foxtail_millet\|11v3\|PHY7SI026475M_P1 | 4709 | 620 | 81.8 | globlastp |
| 2097 | LNU683 | maize\|10v1\|AW289086_P1 | 4710 | 621 | 95.7 | globlastp |
| 2098 | LNU683 | sugarcane\|10v1\|CA167727 | 4711 | 621 | 95.7 | globlastp |
| 2099 | LNU683 | foxtail_millet\|11v3\|PHY7SI012404M_P1 | 4712 | 621 | 82.1 | globlastp |
| 2100 | LNU683 | switchgrass\|gb167\|FL930075 | 4713 | 621 | 80 | globlastp |
| 2101 | LNU683 | switchgrass\|gb167\|GD045383 | 4714 | 621 | 80 | globlastp |
| 2102 | LNU684 | maize\|10v1\|AA979828_P1 | 4715 | 622 | 92.1 | globlastp |
| 2103 | LNU684 | sugarcane\|10v1\|BQ533418 | 4716 | 622 | 89.7 | globlastp |
| 2104 | LNU684 | maize\|10v1\|AI438422_P1 | 4717 | 622 | 87 | globlastp |
| 2105 | LNU684 | foxtail_millet\|11v3\|PHY7SI030559M_P1 | 4718 | 622 | 84.9 | globlastp |
| 2106 | LNU684 | switchgrass\|gb167\|DN145647 | 4719 | 622 | 80.3 | globlastp |
| 2107 | LNU685 | sugarcane\|10v1\|CA066199 | 4720 | 623 | 95.5 | globlastp |
| 2108 | LNU685 | foxtail_millet\|11v3\|PHY7SI011400M_P1 | 4721 | 623 | 86.6 | globlastp |
| 2109 | LNU685 | switchgrass\|gb167\|FL842241 | 4722 | 623 | 85.7 | globlastp |
| 2110 | LNU685 | switchgrass\|gb167\|FL703548 | 4723 | 623 | 83.9 | globlastp |
| 2111 | LNU686 | maize\|10v1\|AI977804_P1 | 4724 | 624 | 95.3 | globlastp |
| 2112 | LNU686 | foxtail_millet\|11v3\|PHY7SI009773M_P1 | 4725 | 624 | 92.7 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 2113 | LNU686 | foxtail_millet\|10v2\|FXTRMSLX01880196D2 | 4726 | 624 | 89.53 | glotblastn |
| 2114 | LNU686 | rice\|11v1\|BF430476_P1 | 4727 | 624 | 84.8 | globlastp |
| 2115 | LNU686 | switchgrass\|gb167\|FE623178 | 4728 | 624 | 84.5 | globlastp |
| 2116 | LNU686 | oat\|11v1\|GO594732_P1 | 4729 | 624 | 84 | globlastp |
| 2117 | LNU686 | wheat\|12v3\|BE418704_P1 | 4730 | 624 | 84 | globlastp |
| 2118 | LNU686 | wheat\|10v2\|CA625283 | 4731 | 624 | 83.7 | globlastp |
| 2119 | LNU686 | wheat\|10v2\|BE418704 | 4732 | 624 | 83.1 | globlastp |
| 2120 | LNU686 | rice\|gb170\|OS04G52100 | 4733 | 624 | 83 | globlastp |
| 2121 | LNU686 | brachypodium\|12v1\|BRADI5G21260_P1 | 4734 | 624 | 82.7 | globlastp |
| 2122 | LNU686 | oat\|10v2\|GO594732 | 4735 | 624 | 82.3 | globlastp |
| 2123 | LNU686 | barley\|12v1\|AV833520_P1 | 4736 | 624 | 82.2 | globlastp |
| 2124 | LNU686 | barley\|10v2\|AV833520 | 4737 | 624 | 81.9 | globlastp |
| 2125 | LNU686 | brachypodium\|09v1\|GT796005 | 4738 | 624 | 81.3 | globlastp |
| 2126 | LNU687 | sugarcane\|10v1\|CA102820 | 4739 | 625 | 97.1 | globlastp |
| 2127 | LNU687 | foxtail_millet\|11v3\|PHY7SI023597M_P1 | 4740 | 625 | 91.3 | globlastp |
| 2128 | LNU687 | foxtail_millet\|10v2\|SICRP031887 | 4741 | 625 | 90.58 | glotblastn |
| 2129 | LNU687 | millet\|10v1\|PMSLX0009759D1_P1 | 4742 | 625 | 89.1 | globlastp |
| 2130 | LNU687 | maize\|10v1\|BE345449_P1 | 4743 | 625 | 88.1 | globlastp |
| 2131 | LNU687 | switchgrass\|gb167\|FL691233 | 4744 | 625 | 87.7 | globlastp |
| 2132 | LNU688 | maize\|10v1\|DR817844_P1 | 4745 | 626 | 87.2 | globlastp |
| 2133 | LNU688 | foxtail_millet\|11v3\|PHY7SI013903M_T1 | 4746 | 626 | 87.19 | glotblastn |
| 2134 | LNU688 | foxtail_millet\|10v2\|SICRP038639 | 4747 | 626 | 85.56 | glotblastn |
| 2135 | LNU689 | maize\|10v1\|AI586867_P1 | 4748 | 627 | 94.4 | globlastp |
| 2136 | LNU689 | maize\|10v1\|AW000148_P1 | 4749 | 627 | 93.5 | globlastp |
| 2137 | LNU689 | foxtail_millet\|11v3\|PHY7SI014440M_P1 | 4750 | 627 | 92.1 | globlastp |
| 2138 | LNU689 | millet\|10v1\|EVO454PM024824_P1 | 4751 | 627 | 91.2 | globlastp |
| 2139 | LNU689 | rice\|11v1\|AA749683_P1 | 4752 | 627 | 84.8 | globlastp |
| 2140 | LNU689 | rice\|gb170\|OS08G34190 | 4752 | 627 | 84.8 | globlastp |
| 2141 | LNU689 | switchgrass\|gb167\|FL762097 | 4753 | 627 | 84.3 | globlastp |
| 2142 | LNU689 | wheat\|10v2\|BG274015 | 4754 | 627 | 82.9 | globlastp |
| 2143 | LNU689 | wheat\|12v3\|CA736481_P1 | 4754 | 627 | 82.9 | globlastp |
| 2144 | LNU689 | barley\|12v1\|BI955611_P1 | 4755 | 627 | 82.5 | globlastp |
| 2145 | LNU689 | oat\|11v1\|GR332556_P1 | 4756 | 627 | 82.5 | globlastp |
| 2146 | LNU689 | rye\|12v1\|BE637203_P1 | 4757 | 627 | 82.5 | globlastp |
| 2147 | LNU689 | rye\|12v1\|CD453252_P1 | 4757 | 627 | 82.5 | globlastp |
| 2148 | LNU689 | rye\|12v1\|DRR001012.600523_P1 | 4757 | 627 | 82.5 | globlastp |
| 2149 | LNU689 | brachypodium\|09v1\|SRR031795S0032358 | 4758 | 627 | 82.5 | globlastp |
| 2150 | LNU689 | brachypodium\|12v1\|BRADI3G36940_P1 | 4758 | 627 | 82.5 | globlastp |
| 2151 | LNU689 | oat\|10v2\|GR332556 | 4756 | 627 | 82.5 | globlastp |
| 2152 | LNU690 | barley\|12v1\|BQ465898_P1 | 4759 | 628 | 81.6 | globlastp |
| 2153 | LNU690 | rye\|12v1\|DRR001012.353248_P1 | 4760 | 628 | 81.6 | globlastp |
| 2154 | LNU691 | sugarcane\|10v1\|BQ529786 | 4761 | 629 | 87.8 | globlastp |
| 2155 | LNU691 | sugarcane\|10v1\|BQ532190 | 4762 | 629 | 87.3 | globlastp |
| 2156 | LNU691 | maize\|10v1\|T70633_P1 | 4763 | 629 | 83.5 | globlastp |
| 2157 | LNU692 | maize\|10v1\|BM350388_P1 | 4764 | 630 | 90.3 | globlastp |
| 2158 | LNU692 | foxtail_millet\|11v3\|PHY7SI021276M_P1 | 4765 | 630 | 88.8 | globlastp |
| 2159 | LNU694 | sugarcane\|10v1\|CA118208 | 4766 | 632 | 81.1 | globlastp |
| 2160 | LNU695 | sugarcane\|10v1\|CA170657 | 4767 | 633 | 84.2 | globlastp |
| 2161 | LNU696 | millet\|10v1\|CD726100_P1 | 4768 | 634 | 92.8 | globlastp |
| 2162 | LNU696 | foxtail_millet\|11v3\|PHY7SI022016M_P1 | 4769 | 634 | 92.5 | globlastp |
| 2163 | LNU696 | foxtail_millet\|10v2\|FXTRMSLX00462197D1 | 4770 | 634 | 92.5 | globlastp |
| 2164 | LNU696 | rice\|11v1\|BI811614_P1 | 4771 | 634 | 90.9 | globlastp |
| 2165 | LNU696 | rice\|gb170\|OS05G36190 | 4771 | 634 | 90.9 | globlastp |
| 2166 | LNU696 | brachypodium\|09v1\|DV470158 | 4772 | 634 | 89.8 | globlastp |
| 2167 | LNU696 | brachypodium\|12v1\|BRADI2G24110_P1 | 4772 | 634 | 89.8 | globlastp |
| 2168 | LNU696 | barley\|10v2\|BE216026 | 4773 | 634 | 87.4 | globlastp |
| 2169 | LNU696 | barley\|12v1\|BE216026_P1 | 4773 | 634 | 87.4 | globlastp |
| 2170 | LNU696 | wheat\|10v2\|BE213561XX1 | 4774 | 634 | 87 | globlastp |
| 2171 | LNU696 | rye\|12v1\|DRR001012.244010_T1 | 4775 | 634 | 86.59 | glotblastn |
| 2172 | LNU696 | rye\|12v1\|DRR001012.131444_P1 | 4776 | 634 | 86.2 | globlastp |
| 2173 | LNU696 | rye\|12v1\|DRR001012.101595_T1 | 4777 | 634 | 85.93 | glotblastn |
| 2174 | LNU696 | oil_palm\|11v1\|EL684172_P1 | 4778 | 634 | 81.6 | globlastp |
| 2175 | LNU696 | sugarcane\|10v1\|CA069715 | 4779 | 634 | 81.6 | globlastp |
| 2176 | LNU696 | banana\|12v1\|BBS24T7_P1 | 4780 | 634 | 81.1 | globlastp |
| 2177 | LNU696 | oil_palm\|11v1\|SRR190698.126403_P1 | 4781 | 634 | 80.7 | globlastp |
| 2178 | LNU698 | sugarcane\|10v1\|BQ536290 | 4782 | 636 | 92.1 | globlastp |
| 2179 | LNU698 | maize\|10v1\|BQ485669_P1 | 4783 | 636 | 89.8 | globlastp |
| 2180 | LNU698 | foxtail_millet\|11v3\|EC612008_T1 | 4784 | 636 | 88.46 | glotblastn |
| 2181 | LNU698 | switchgrass\|gb167\|FE608664 | 4785 | 636 | 87.8 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 2182 | LNU698 | maize\|10v1\|AW520250_P1 | 4786 | 636 | 86.8 | globlastp |
| 2183 | LNU698 | rice\|11v1\|BI807262_P1 | 4787 | 636 | 81 | globlastp |
| 2184 | LNU698 | rice\|gb170\|OS05G46460 | 4787 | 636 | 81 | globlastp |
| 2185 | LNU699 | maize\|10v1\|DR815886_P1 | 4788 | 637 | 89.5 | globlastp |
| 2186 | LNU699 | sugarcane\|10v1\|CA127961 | 4789 | 637 | 88.8 | globlastp |
| 2187 | LNU700 | maize\|10v1\|BG837217_P1 | 4790 | 638 | 91.6 | globlastp |
| 2188 | LNU700 | switchgrass\|gb167\|DN142701 | 4791 | 638 | 89.9 | globlastp |
| 2189 | LNU700 | foxtail_millet\|11v3\|PHY7SI006582M_P1 | 4792 | 638 | 89.4 | globlastp |
| 2190 | LNU700 | millet\|10v1\|EVO454PM037598_P1 | 4793 | 638 | 85.1 | globlastp |
| 2191 | LNU700 | foxtail_millet\|10v2\|SICRP002725 | 4794 | 638 | 84.41 | glotblastn |
| 2192 | LNU700 | rice\|11v1\|BI804418_P1 | 4795 | 638 | 81.8 | globlastp |
| 2193 | LNU700 | rice\|gb170\|OS06G04910 | 4795 | 638 | 81.8 | globlastp |
| 2194 | LNU700 | wheat\|12v3\|BE404043_P1 | 4796 | 638 | 81.6 | globlastp |
| 2195 | LNU701 | sugarcane\|10v1\|CA105493 | 4797 | 639 | 87.7 | globlastp |
| 2196 | LNU701 | foxtail_millet\|11v3\|PHY7SI006967M_T1 | 4798 | 639 | 85.66 | glotblastn |
| 2197 | LNU701 | millet\|10v1\|PMSLX0037146D1_P1 | 4799 | 639 | 85.6 | globlastp |
| 2198 | LNU701 | switchgrass\|gb167\|FE622017 | 4800 | 639 | 84.36 | glotblastn |
| 2199 | LNU703 | maize\|10v1\|AF045033_P1 | 4801 | 641 | 98.8 | globlastp |
| 2200 | LNU703 | wheat\|10v2\|CA626431 | 4802 | 641 | 98.75 | glotblastn |
| 2201 | LNU703 | maize\|10v1\|AI637192_P1 | 4803 | 641 | 97.5 | globlastp |
| 2202 | LNU703 | switchgrass\|gb167\|FE608051 | 4804 | 641 | 96.2 | globlastp |
| 2203 | LNU703 | switchgrass\|gb167\|FL739725 | 4805 | 641 | 96.2 | globlastp |
| 2204 | LNU703 | millet\|10v1\|EVO454PM014911_P1 | 4806 | 641 | 95 | globlastp |
| 2205 | LNU703 | foxtail_millet\|11v3\|PHY7SI008331M_P1 | 4807 | 641 | 93.8 | globlastp |
| 2206 | LNU703 | *cynodon*\|10v1\|ES293014_P1 | 4808 | 641 | 93.8 | globlastp |
| 2207 | LNU703 | foxtail_millet\|10v2\|SICRP042608 | 4807 | 641 | 93.8 | globlastp |
| 2208 | LNU703 | lovegrass\|gb167\|EH187144_P1 | 4809 | 641 | 92.5 | globlastp |
| 2209 | LNU703 | oat\|11v1\|GO586622_P1 | 4810 | 641 | 90 | globlastp |
| 2210 | LNU703 | oat\|11v1\|SRR020741.121411_P1 | 4810 | 641 | 90 | globlastp |
| 2211 | LNU703 | *brachypodium*\|09v1\|GT779345 | 4811 | 641 | 90 | globlastp |
| 2212 | LNU703 | *brachypodium*\|12v1\|BRADI1G43430_P1 | 4811 | 641 | 90 | globlastp |
| 2213 | LNU703 | *cenchrus*\|gb166\|EB652605_T1 | 4812 | 641 | 90 | glotblastn |
| 2214 | LNU703 | oat\|10v2\|CN817752 | 4810 | 641 | 90 | globlastp |
| 2215 | LNU703 | wheat\|10v2\|CA621671 | 4813 | 641 | 90 | glotblastn |
| 2216 | LNU703 | rye\|12v1\|DRR001012.12240_P1 | 4814 | 641 | 88.8 | globlastp |
| 2217 | LNU703 | rye\|12v1\|DRR001012.128407_P1 | 4814 | 641 | 88.8 | globlastp |
| 2218 | LNU703 | rye\|12v1\|DRR001012.13867_P1 | 4814 | 641 | 88.8 | globlastp |
| 2219 | LNU703 | rice\|11v1\|AA750818_P1 | 4815 | 641 | 88.8 | globlastp |
| 2220 | LNU703 | rice\|gb170\|OS06G17870 | 4815 | 641 | 88.8 | globlastp |
| 2221 | LNU703 | barley\|12v1\|BE412913_P1 | 4816 | 641 | 87.5 | globlastp |
| 2222 | LNU703 | rye\|12v1\|DRR001018.16861_P1 | 4817 | 641 | 87.5 | globlastp |
| 2223 | LNU703 | wheat\|12v3\|BE402497_P1 | 4816 | 641 | 87.5 | globlastp |
| 2224 | LNU703 | wheat\|12v3\|BE405338_P1 | 4817 | 641 | 87.5 | globlastp |
| 2225 | LNU703 | barley\|10v2\|BI948645 | 4816 | 641 | 87.5 | globlastp |
| 2226 | LNU703 | fescue\|gb161\|DT699334_P1 | 4816 | 641 | 87.5 | globlastp |
| 2227 | LNU703 | foxtail_millet\|10v2\|FXTSLX00328271 | 4816 | 641 | 87.5 | globlastp |
| 2228 | LNU703 | wheat\|10v2\|BF199796 | 4816 | 641 | 87.5 | globlastp |
| 2229 | LNU703 | *lolium*\|10v1\|AU245907_T1 | 4818 | 641 | 86.25 | glotblastn |
| 2230 | LNU703 | wheat\|10v2\|CA624841 | 4819 | 641 | 86.2 | globlastp |
| 2231 | LNU703 | wheat\|12v3\|BE426835_P1 | 4819 | 641 | 86.2 | globlastp |
| 2232 | LNU703 | rye\|12v1\|DRR001012.46409_T1 | 4820 | 641 | 85 | glotblastn |
| 2233 | LNU703 | rye\|12v1\|DRR001012.23200_T1 | — | 641 | 80 | glotblastn |
| 2234 | LNU705 | wheat\|10v2\|CA486495 | 643 | 643 | 100 | globlastp |
| 2235 | LNU705 | sugarcane\|10v1\|BQ532962 | 4821 | 643 | 97 | globlastp |
| 2236 | LNU705 | wheat\|12v3\|CA486495_P1 | 4822 | 643 | 96.9 | globlastp |
| 2237 | LNU705 | maize\|10v1\|AW331160_T1 | 4823 | 643 | 91.58 | glotblastn |
| 2238 | LNU705 | foxtail_millet\|11v3\|PHY7SI032749M_P1 | 4824 | 643 | 91.5 | globlastp |
| 2239 | LNU705 | switchgrass\|gb167\|DN141378 | 4825 | 643 | 91 | globlastp |
| 2240 | LNU705 | maize\|10v1\|W21735_P1 | 4826 | 643 | 90.7 | globlastp |
| 2241 | LNU705 | foxtail_millet\|10v2\|SICRP041260 | 4827 | 643 | 90.5 | globlastp |
| 2242 | LNU705 | oat\|11v1\|CN818596_P1 | 4828 | 643 | 89.8 | globlastp |
| 2243 | LNU705 | oat\|10v2\|CN816128 | 4828 | 643 | 89.8 | globlastp |
| 2244 | LNU705 | *cynodon*\|10v1\|ES292698_P1 | 4829 | 643 | 89.6 | globlastp |
| 2245 | LNU705 | oat\|11v1\|CN816128_P1 | 4830 | 643 | 89.3 | globlastp |
| 2246 | LNU705 | oat\|10v2\|GR315411 | 4830 | 643 | 89.3 | globlastp |
| 2247 | LNU705 | *cynodon*\|10v1\|ES296133_P1 | 4831 | 643 | 89.1 | globlastp |
| 2248 | LNU705 | switchgrass\|gb167\|FE618879 | 4832 | 643 | 88.6 | globlastp |
| 2249 | LNU705 | rye\|12v1\|BE705663_P1 | 4833 | 643 | 86.3 | globlastp |
| 2250 | LNU705 | rye\|12v1\|DRR001012.109055_P1 | 4833 | 643 | 86.3 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 2251 | LNU705 | rye\|12v1\|DRR001012.189014_P1 | 4833 | 643 | 86.3 | globlastp |
| 2252 | LNU705 | rye\|12v1\|DRR001012.199311_P1 | 4833 | 643 | 86.3 | globlastp |
| 2253 | LNU705 | rice\|11v1\|AA754517_P1 | 4834 | 643 | 86.3 | globlastp |
| 2254 | LNU705 | rice\|gb170\|OS07G48500 | 4834 | 643 | 86.3 | globlastp |
| 2255 | LNU705 | barley\|12v1\|BI955800_P1 | 4835 | 643 | 86.3 | globlastp |
| 2256 | LNU705 | wheat\|12v3\|HX059864_P1 | 4836 | 643 | 85.8 | globlastp |
| 2257 | LNU705 | fescue\|gb161\|DT679266_P1 | 4837 | 643 | 85.8 | globlastp |
| 2258 | LNU705 | fescue\|gb161\|DT681745_P1 | 4838 | 643 | 85.8 | globlastp |
| 2259 | LNU705 | *pseudoroegneria*\|gb167\|FF339988 | 4839 | 643 | 85.8 | globlastp |
| 2260 | LNU705 | wheat\|10v2\|CA634799 | 4840 | 643 | 85.8 | globlastp |
| 2261 | LNU705 | wheat\|12v3\|BE213253_P1 | 4840 | 643 | 85.8 | globlastp |
| 2262 | LNU705 | wheat\|12v3\|HX000458_P1 | 4836 | 643 | 85.8 | globlastp |
| 2263 | LNU705 | wheat\|10v2\|CA662880 | 4841 | 643 | 85.3 | globlastp |
| 2264 | LNU705 | wheat\|12v3\|BE604814_T1 | 4842 | 643 | 84.77 | glotblastn |
| 2265 | LNU705 | lovegrass\|gb167\|DN480780_P1 | 4843 | 643 | 84.3 | globlastp |
| 2266 | LNU705 | wheat\|10v2\|BF293615 | 4844 | 643 | 84.18 | glotblastn |
| 2267 | LNU705 | barley\|10v2\|BE214998 | 4845 | 643 | 83.7 | globlastp |
| 2268 | LNU705 | *brachypodium*\|09v1\|DV477733 | 4846 | 643 | 83 | globlastp |
| 2269 | LNU706 | maize\|10v1\|BE050393_P1 | 4847 | 644 | 81.1 | globlastp |
| 2270 | LNU707 | sugarcane\|10v1\|BU102568 | 4848 | 645 | 95.9 | globlastp |
| 2271 | LNU707 | maize\|10v1\|AW267228_P1 | 4849 | 645 | 91.1 | globlastp |
| 2272 | LNU707 | switchgrass\|gb167\|DN141564 | 4850 | 645 | 88.6 | globlastp |
| 2273 | LNU707 | switchgrass\|gb167\|FL727321 | 4850 | 645 | 88.6 | globlastp |
| 2274 | LNU707 | foxtail_millet\|11v3\|PHY7SI011182M_P1 | 4851 | 645 | 87.9 | globlastp |
| 2275 | LNU707 | maize\|10v1\|AI619400_P1 | 4852 | 645 | 87.3 | globlastp |
| 2276 | LNU707 | foxtail_millet\|10v2\|SICRP032733 | 4853 | 645 | 87.1 | glotblastn |
| 2277 | LNU707 | switchgrass\|gb167\|DN141524 | 4854 | 645 | 87 | globlastp |
| 2278 | LNU707 | switchgrass\|gb167\|FE603148 | 4854 | 645 | 87 | globlastp |
| 2279 | LNU707 | millet\|10v1\|CD725128_P1 | 4855 | 645 | 86.4 | globlastp |
| 2280 | LNU707 | foxtail_millet\|11v3\|SIPRD094724_P1 | 4856 | 645 | 86.3 | globlastp |
| 2281 | LNU707 | *brachypodium*\|09v1\|DV470281 | 4857 | 645 | 86.2 | globlastp |
| 2282 | LNU707 | *cenchrus*\|gb166\|BM084773_P1 | 4858 | 645 | 84.8 | globlastp |
| 2283 | LNU707 | wheat\|10v2\|BQ161944XX2 | 4859 | 645 | 83.1 | globlastp |
| 2284 | LNU707 | wheat\|12v3\|BE415353_P1 | 4860 | 645 | 83.1 | globlastp |
| 2285 | LNU707 | wheat\|12v3\|BE398458_P1 | 4861 | 645 | 82.3 | globlastp |
| 2286 | LNU707 | wheat\|10v2\|BE415353 | 4862 | 645 | 82.26 | glotblastn |
| 2287 | LNU707 | zostera\|10v1\|SRR057351S0085212 | 4863 | 645 | 82.1 | globlastp |
| 2288 | LNU707 | wheat\|10v2\|CA594354 | 4864 | 645 | 81.45 | glotblastn |
| 2289 | LNU707 | barley\|10v2\|BE413476 | 4865 | 645 | 80.8 | globlastp |
| 2290 | LNU707 | oat\|11v1\|CN815377_P1 | 4866 | 645 | 80 | globlastp |
| 2291 | LNU707 | oat\|11v1\|GO581295_P1 | 4867 | 645 | 80 | globlastp |
| 2292 | LNU707 | oat\|10v2\|CN815377 | 4867 | 645 | 80 | globlastp |
| 2293 | LNU709 | bean\|12v1\|SRR001334.122032_P1 | 4868 | 647 | 84.1 | globlastp |
| 2294 | LNU709 | bean\|gb167\|FE695408 | 4869 | 647 | 83.5 | globlastp |
| 2295 | LNU709 | pigeonpea\|10v1\|GW355441 | 4870 | 647 | 82.9 | globlastp |
| 2296 | LNU709 | pigeonpea\|11v1\|GW355441_P1 | 4870 | 647 | 82.9 | globlastp |
| 2297 | LNU709 | pigeonpea\|11v1\|CCPRD078357_P1 | 4871 | 647 | 81.8 | globlastp |
| 2298 | LNU709 | cowpea\|gb166\|FC458225 | 4872 | 647 | 81.18 | glotblastn |
| 2299 | LNU709 | cowpea\|12v1\|FC458225_P1 | 4873 | 647 | 80.6 | globlastp |
| 2300 | LNU710 | soybean\|11v1\|GLYMA06G46470 | 4874 | 648 | 93.2 | globlastp |
| 2301 | LNU710 | cowpea\|12v1\|FF553729_P1 | 4875 | 648 | 92.1 | globlastp |
| 2302 | LNU710 | cowpea\|gb166\|FF553729 | 4875 | 648 | 92.1 | globlastp |
| 2303 | LNU710 | bean\|12v1\|SRR001334.51192_P1 | 4876 | 648 | 91.1 | globlastp |
| 2304 | LNU710 | pigeonpea\|11v1\|SRR054580X101305_P1 | 4877 | 648 | 90.5 | globlastp |
| 2305 | LNU710 | bean\|gb167\|CV539993 | 4878 | 648 | 90.5 | globlastp |
| 2306 | LNU710 | lotus\|09v1\|LLBI417871_P1 | 4879 | 648 | 81.6 | globlastp |
| 2307 | LNU710 | chickpea\|11v1\|SRR133517.174579_P1 | 4880 | 648 | 80.8 | globlastp |
| 2308 | LNU710 | peanut\|10v1\|GO257534_T1 | 4881 | 648 | 80.41 | glotblastn |
| 2309 | LNU711 | soybean\|11v1\|GLYMA13G31430 | 4882 | 649 | 95.5 | globlastp |
| 2310 | LNU711 | pigeonpea\|11v1\|SRR054580X103447_P1 | 4883 | 649 | 87.3 | globlastp |
| 2311 | LNU711 | bean\|12v1\|CA900734_P1 | 4884 | 649 | 87.1 | globlastp |
| 2312 | LNU711 | bean\|gb167\|CA900734 | 4884 | 649 | 87.1 | globlastp |
| 2313 | LNU711 | cowpea\|12v1\|FC458413_P1 | 4885 | 649 | 86.7 | globlastp |
| 2314 | LNU711 | cowpea\|gb166\|FC458413 | 4885 | 649 | 86.7 | globlastp |
| 2315 | LNU711 | soybean\|11v1\|GLYMA13G31420 | 4886 | 649 | 85.4 | globlastp |
| 2316 | LNU711 | bean\|12v1\|CA900735_P1 | 4887 | 649 | 83.4 | globlastp |
| 2317 | LNU711 | lotus\|09v1\|BP070834_P1 | 4888 | 649 | 82.7 | globlastp |
| 2318 | LNU711 | *trigonella*\|11v1\|SRR066194X187874 | 4889 | 649 | 81.5 | globlastp |
| 2319 | LNU711 | peanut\|10v1\|ES723404_P1 | 4890 | 649 | 81.2 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 2320 | LNU711 | medicago\|09v1\|AW690239 | 4891 | 649 | 80.1 | globlastp |
| 2321 | LNU711 | medicago\|12v1\|AW690239_P1 | 4891 | 649 | 80.1 | globlastp |
| 2322 | LNU712 | solanum_phureja\|09v1\|SPHAA668032 | 4892 | 650 | 95.58 | glotblastn |
| 2323 | LNU712 | pepper\|12v1\|CA519602_P1 | 4893 | 650 | 85.4 | globlastp |
| 2324 | LNU712 | tobacco\|gb162\|EB444232 | 4894 | 650 | 84.8 | globlastp |
| 2325 | LNU713 | potato\|10v1\|BG598036_P1 | 4895 | 651 | 94.9 | globlastp |
| 2326 | LNU713 | solanum_phureja\|09v1\|SPHAW429253 | 4896 | 651 | 94.6 | globlastp |
| 2327 | LNU713 | nicotiana_benthamiana\|gb162\|CK281402_P1 | 4897 | 651 | 81.2 | globlastp |
| 2328 | LNU713 | nicotiana_benthamiana\|gb162\|CK282280_P1 | 4898 | 651 | 80.3 | globlastp |
| 2329 | LNU714 | solanum_phureja\|09v1\|SPHBI203878 | 4899 | 652 | 97.7 | globlastp |
| 2330 | LNU715 | potato\|10v1\|BG351641_P1 | 4900 | 653 | 99.4 | globlastp |
| 2331 | LNU715 | solanum_phureja\|09v1\|SPHBG131272 | 4900 | 653 | 99.4 | globlastp |
| 2332 | LNU715 | eggplant\|10v1\|FS001810_P1 | 4901 | 653 | 95.5 | globlastp |
| 2333 | LNU715 | pepper\|12v1\|BM066692_P1 | 4902 | 653 | 91.7 | globlastp |
| 2334 | LNU715 | pepper\|gb171\|BM066692 | 4902 | 653 | 91.7 | globlastp |
| 2335 | LNU715 | tobacco\|gb162\|DW001525 | 4903 | 653 | 87.2 | globlastp |
| 2336 | LNU715 | olea\|11v1\|SRR014463.20550_P1 | 4904 | 653 | 84.2 | globlastp |
| 2337 | LNU715 | petunia\|gb171\|CV298034_P1 | 4905 | 653 | 83.6 | globlastp |
| 2338 | LNU715 | tobacco\|gb162\|CV018786 | 4906 | 653 | 82.69 | glotblastn |
| 2339 | LNU715 | orobanche\|10v1\|SRR023189S0080893_P1 | 4907 | 653 | 82.5 | globlastp |
| 2340 | LNU715 | amsonia\|11v1\|SRR098688X102292_P1 | 4908 | 653 | 82.4 | globlastp |
| 2341 | LNU715 | sesame\|12v1\|BU667778_P1 | 4909 | 653 | 82.3 | globlastp |
| 2342 | LNU715 | triphysaria\|10v1\|EY173036 | 4910 | 653 | 81.1 | globlastp |
| 2343 | LNU715 | antirrhinum\|gb166\|AJ787344_T1 | 4911 | 653 | 80.5 | glotblastn |
| 2344 | LNU715 | phyla\|11v1\|SRR099037X210438 | 4912 | 653 | 80.4 | globlastp |
| 2345 | LNU715 | phyla\|11v2\|SRR099037X210438_P1 | 4912 | 653 | 80.4 | globlastp |
| 2346 | LNU716 | solanum_phureja\|09v1\|SPHAI485147 | 4913 | 654 | 95.9 | globlastp |
| 2347 | LNU716 | pepper\|gb171\|BM064072 | 4914 | 654 | 89.8 | globlastp |
| 2348 | LNU716 | petunia\|gb171\|FN007469_P1 | 4915 | 654 | 86.5 | globlastp |
| 2349 | LNU716 | tomato\|10v1\|BG627891 | 4916 | 654 | 84.1 | globlastp |
| 2350 | LNU716 | tomato\|11v1\|BG627891_P1 | 4916 | 654 | 84.1 | globlastp |
| 2351 | LNU716 | pepper\|12v1\|BM061122_T1 | 4917 | 654 | 83.79 | glotblastn |
| 2352 | LNU716 | pepper\|gb171\|BM061122 | 4917 | 654 | 83.79 | glotblastn |
| 2353 | LNU716 | ipomoea_nil\|10v1\|BJ558672_P1 | 4918 | 654 | 83.3 | globlastp |
| 2354 | LNU716 | tobacco\|gb162\|DV159900 | 4919 | 654 | 82.9 | globlastp |
| 2355 | LNU716 | solanum_phureja\|09v1\|SPHBG627891 | 4920 | 654 | 82.4 | globlastp |
| 2356 | LNU716 | tabernaemontana\|11v1\|SRR098689X102555 | 4921 | 654 | 82.4 | globlastp |
| 2357 | LNU716 | eggplant\|10v1\|FS095941_T1 | 4922 | 654 | 82.33 | glotblastn |
| 2358 | LNU716 | coffea\|10v1\|DV674215_T1 | 4923 | 654 | 81.57 | glotblastn |
| 2359 | LNU716 | phyla\|11v2\|SRR099035X103863_T1 | 4924 | 654 | 80.65 | glotblastn |
| 2360 | LNU716 | amsonia\|11v1\|SRR098688X104403_P1 | 4925 | 654 | 80.2 | globlastp |
| 2361 | LNU718 | solanum_phureja\|09v1\|SPHAI781238 | 4926 | 655 | 97.4 | globlastp |
| 2362 | LNU718 | eggplant\|10v1\|FS001984_P1 | 4927 | 655 | 95.2 | globlastp |
| 2363 | LNU718 | pepper\|12v1\|BM061409_P1 | 4928 | 655 | 93 | globlastp |
| 2364 | LNU718 | pepper\|gb171\|BM061409 | 4928 | 655 | 93 | globlastp |
| 2365 | LNU718 | coffea\|10v1\|DV679875_P1 | 4929 | 655 | 83.8 | globlastp |
| 2366 | LNU718 | phyla\|11v2\|SRR099035X27332_T1 | 4930 | 655 | 83.7 | glotblastn |
| 2367 | LNU718 | amsonia\|11v1\|SRR098688X101758_P1 | 4931 | 655 | 83.4 | globlastp |
| 2368 | LNU718 | monkeyflower\|10v1\|DV207240_P1 | 4932 | 655 | 83 | globlastp |
| 2369 | LNU718 | tabernaemontana\|11v1\|SRR098689X116925 | 4933 | 655 | 83 | globlastp |
| 2370 | LNU718 | sesame\|12v1\|SESI12V1265952_P1 | 4934 | 655 | 82.7 | globlastp |
| 2371 | LNU718 | blueberry\|12v1\|SRR353283X10176D1_T1 | 4935 | 655 | 82.66 | glotblastn |
| 2372 | LNU718 | kiwi\|gb166\|FG399901_P1 | 4936 | 655 | 82.3 | globlastp |
| 2373 | LNU718 | salvia\|10v1\|SRR014553S0004743 | 4937 | 655 | 82.1 | globlastp |
| 2374 | LNU718 | valeriana\|11v1\|SRR099039X12011_P1 | 4938 | 655 | 81.5 | globlastp |
| 2375 | LNU718 | catharanthus\|11v1\|SRR098691X113233_P1 | 4939 | 655 | 81.5 | globlastp |
| 2376 | LNU718 | ipomoea_nil\|10v1\|CJ754388_P1 | 4940 | 655 | 81.5 | globlastp |
| 2377 | LNU718 | vinca\|11v1\|SRR098690X103489 | 4941 | 655 | 81.2 | globlastp |
| 2378 | LNU718 | sarracenia\|11v1\|SRR192669.103707_P1 | 4942 | 655 | 80.8 | globlastp |
| 2379 | LNU718 | eucalyptus\|11v2\|CT981760_P1 | 4943 | 655 | 80.4 | globlastp |
| 2380 | LNU718 | plantago\|11v1\|SRR066373X104937 | 4944 | 655 | 80.4 | globlastp |
| 2381 | LNU718 | safflower\|gb162\|EL384411 | 4945 | 655 | 80.4 | globlastp |
| 2382 | LNU718 | cirsium\|11v1\|SRR346952.10106_P1 | 4946 | 655 | 80.1 | globlastp |
| 2383 | LNU718 | cirsium\|11v1\|SRR346952.103469_T1 | 4947 | 655 | 80 | glotblastn |
| 2384 | LNU718 | melon\|10v1\|DV631740_T1 | 4948 | 655 | 80 | glotblastn |
| 2385 | LNU718 | soybean\|11v1\|GLYMA01G01380 | 4949 | 655 | 80 | glotblastn |
| 2386 | LNU718 | soybean\|11v1\|GLYMA09G34400 | 4950 | 655 | 80 | glotblastn |
| 2387 | LNU719 | tomato\|10v1\|CRPSP019800 | 4951 | 656 | 91.4 | globlastp |
| 2388 | LNU719 | solanum_phureja\|09v1\|SPHAI896451 | 4952 | 656 | 82.3 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 2389 | LNU719 | potato\|10v1\|BF460038_P1 | 4953 | 656 | 82.1 | globlastp |
| 2390 | LNU721 | solanum_phureja\|09v1\|SPHAW094309 | 4954 | 658 | 98.6 | globlastp |
| 2391 | LNU721 | sesame\|12v1\|SESI12V1280118_P1 | 4955 | 658 | 82.2 | globlastp |
| 2392 | LNU722 | solanum_phureja\|09v1\|SPHAW622680 | 4956 | 659 | 96.7 | globlastp |
| 2393 | LNU722 | potato\|10v1\|BF053038_P1 | 4957 | 659 | 95.5 | globlastp |
| 2394 | LNU722 | pepper\|12v1\|EF566470_P1 | 4958 | 659 | 92.9 | globlastp |
| 2395 | LNU722 | petunia\|gb171\|DY395694_P1 | 4959 | 659 | 90 | globlastp |
| 2396 | LNU722 | aquilegia\|10v2\|DR912544_P1 | 4960 | 659 | 82.8 | globlastp |
| 2397 | LNU722 | catharanthus\|11v1\|EG557973_P1 | 4961 | 659 | 81.2 | globlastp |
| 2398 | LNU722 | tabernaemontana\|11v1\|SRR098689X106586 | 4962 | 659 | 81 | globlastp |
| 2399 | LNU722 | euonymus\|11v1\|SRR070038X174823_P1 | 4963 | 659 | 80.9 | globlastp |
| 2400 | LNU722 | poplar\|10v1\|BP925488_P1 | 4964 | 659 | 80.5 | globlastp |
| 2401 | LNU722 | poplar\|10v1\|CA931723_P1 | 4965 | 659 | 80.5 | globlastp |
| 2402 | LNU722 | poplar\|10v1\|BI122502_P1 | 4966 | 659 | 80.2 | globlastp |
| 2403 | LNU722 | pepper\|gb171\|GD060673 | 4967 | 659 | 80.1 | globlastp |
| 2404 | LNU723 | solanum_phureja\|09v1\|SPHBG123237 | 4968 | 660 | 98.4 | globlastp |
| 2405 | LNU723 | potato\|10v1\|BF459814_P1 | 4969 | 660 | 97.9 | globlastp |
| 2406 | LNU723 | eggplant\|10v1\|FS011727_P1 | 4970 | 660 | 92 | globlastp |
| 2407 | LNU723 | pepper\|12v1\|CA522667_P1 | 4971 | 660 | 89.4 | globlastp |
| 2408 | LNU723 | pepper\|gb171\|CA522667 | 4971 | 660 | 89.4 | globlastp |
| 2409 | LNU723 | tobacco\|gb162\|CV019606 | 4972 | 660 | 88.9 | globlastp |
| 2410 | LNU724 | solanum_phureja\|09v1\|SPHBG123504 | 4973 | 661 | 95.7 | globlastp |
| 2411 | LNU725 | solanum_phureja\|09v1\|SPHBG123834 | 4974 | 662 | 97.7 | globlastp |
| 2412 | LNU726 | solanum_phureja\|09v1\|SPHBG124017 | 4975 | 663 | 89.8 | globlastp |
| 2413 | LNU726 | tomato\|10v1\|SL1X00SC07184X408X1X1 | 4976 | 663 | 85.93 | glotblastn |
| 2414 | LNU726 | tomato\|11v1\|SRR027943S0093890_T1 | 4976 | 663 | 85.93 | glotblastn |
| 2415 | LNU727 | solanum_phureja\|09v1\|SPHBG124542 | 4977 | 664 | 97.2 | globlastp |
| 2416 | LNU727 | potato\|10v1\|BE920770_P1 | 4978 | 664 | 96.7 | globlastp |
| 2417 | LNU727 | pepper\|12v1\|BM064161_P1 | 4979 | 664 | 90.7 | globlastp |
| 2418 | LNU727 | pepper\|gb171\|BM064161 | 4979 | 664 | 90.7 | globlastp |
| 2419 | LNU727 | tobacco\|gb162\|DV159722 | 4980 | 664 | 88.2 | globlastp |
| 2420 | LNU727 | nicotiana_benthamiana\|gb162\|CN743035_P1 | 4981 | 664 | 86.6 | globlastp |
| 2421 | LNU728 | solanum_phureja\|09v1\|SPHBG124612 | 4982 | 665 | 93.06 | glotblastn |
| 2422 | LNU728 | potato\|10v1\|BE923740_P1 | 4983 | 665 | 85.1 | globlastp |
| 2423 | LNU729 | potato\|10v1\|BE920403_P1 | 4984 | 666 | 96.7 | globlastp |
| 2424 | LNU729 | solanum_phureja\|09v1\|SPHBG125266 | 4984 | 666 | 96.7 | globlastp |
| 2425 | LNU729 | tobacco\|gb162\|EB425557 | 4985 | 666 | 92 | globlastp |
| 2426 | LNU729 | ipomoea_nil\|10v1\|BJ554485_P1 | 4986 | 666 | 86.1 | globlastp |
| 2427 | LNU729 | blueberry\|12v1\|CV190114_T1 | 4987 | 666 | 85.04 | glotblastn |
| 2428 | LNU729 | kiwi\|gb166\|FG422413_P1 | 4988 | 666 | 84 | globlastp |
| 2429 | LNU729 | tabernaemontana\|11v1\|SRR098689X113509 | 4989 | 666 | 83.6 | globlastp |
| 2430 | LNU729 | fraxinus\|11v1\|SRR058827.106018_T1 | 4990 | 666 | 82.85 | glotblastn |
| 2431 | LNU729 | sesame\|12v1\|SESI12V1404155_P1 | 4991 | 666 | 82.8 | globlastp |
| 2432 | LNU729 | scabiosa\|11v1\|SRR063723X113391 | 4992 | 666 | 82.8 | globlastp |
| 2433 | LNU729 | phyla\|11v2\|SRR099035X121125_P1 | 4993 | 666 | 82.6 | globlastp |
| 2434 | LNU729 | antirrhinum\|gb166\|AJ792104_P1 | 4994 | 666 | 82.5 | globlastp |
| 2435 | LNU729 | soybean\|11v1\|GLYMA06G06700 | 4995 | 666 | 82.1 | globlastp |
| 2436 | LNU729 | beech\|11v1\|SRR006293.13565_P1 | 4996 | 666 | 81.8 | globlastp |
| 2437 | LNU729 | cowpea\|gb166\|ES884185 | 4997 | 666 | 81.8 | globlastp |
| 2438 | LNU729 | monkeyflower\|10v1\|SRR037227S0041797_P1 | 4998 | 666 | 81.8 | globlastp |
| 2439 | LNU729 | euphorbia\|11v1\|SRR098678X10426_P1 | 4999 | 666 | 81.5 | globlastp |
| 2440 | LNU729 | castorbean\|11v1\|XM_002515395_P1 | 5000 | 666 | 81.4 | globlastp |
| 2441 | LNU729 | bean\|gb167\|CA902555 | 5001 | 666 | 81.4 | globlastp |
| 2442 | LNU729 | cassava\|09v1\|DV456598_P1 | 5002 | 666 | 81.4 | globlastp |
| 2443 | LNU729 | castorbean\|09v1\|XM002515395 | 5000 | 666 | 81.4 | globlastp |
| 2444 | LNU729 | soybean\|11v1\|GLYMA04G06620 | 5003 | 666 | 81.4 | globlastp |
| 2445 | LNU729 | citrus\|gb166\|CX045122 | 5004 | 666 | 81.1 | globlastp |
| 2446 | LNU729 | clementine\|11v1\|CX045122_P1 | 5004 | 666 | 81.1 | globlastp |
| 2447 | LNU729 | orange\|11v1\|CX045122_P1 | 5004 | 666 | 81.1 | globlastp |
| 2448 | LNU729 | bean\|12v1\|CA902555_T1 | 5005 | 666 | 81.02 | glotblastn |
| 2449 | LNU729 | gossypium_raimondii\|12v1\|AI725525_P1 | 5006 | 666 | 81 | globlastp |
| 2450 | LNU729 | cacao\|10v1\|CU501607_P1 | 5007 | 666 | 81 | globlastp |
| 2451 | LNU729 | cassava\|09v1\|CK643540_P1 | 5008 | 666 | 81 | globlastp |
| 2452 | LNU729 | soybean\|11v1\|GLYMA07G02730 | 5009 | 666 | 80.9 | globlastp |
| 2453 | LNU729 | amsonia\|11v1\|SRR098688X128620_P1 | 5010 | 666 | 80.7 | globlastp |
| 2454 | LNU729 | castorbean\|09v1\|XM002527260 | 5011 | 666 | 80.7 | globlastp |
| 2455 | LNU729 | castorbean\|11v1\|XM_002527260_P1 | 5011 | 666 | 80.7 | globlastp |
| 2456 | LNU729 | primula\|11v1\|SRR098679X47571_P1 | 5012 | 666 | 80.7 | globlastp |
| 2457 | LNU729 | cotton\|11v1\|AI725525_P1 | 5013 | 666 | 80.7 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 2458 | LNU729 | papaya\|gb165\|EX250925_P1 | 5014 | 666 | 80.4 | globlastp |
| 2459 | LNU729 | amborella\|12v3\|FD426233_P1 | 5015 | 666 | 80.4 | globlastp |
| 2460 | LNU729 | cacao\|10v1\|CF973000_P1 | 5016 | 666 | 80.3 | globlastp |
| 2461 | LNU729 | catharanthus\|11v1\|EG557865_P1 | 5017 | 666 | 80.3 | globlastp |
| 2462 | LNU729 | cotton\|10v2\|SRR032367S0022378 | 5018 | 666 | 80.3 | globlastp |
| 2463 | LNU729 | peanut\|10v1\|EG030314_P1 | 5019 | 666 | 80.3 | globlastp |
| 2464 | LNU729 | cannabis\|12v1\|JK500114_T1 | 5020 | 666 | 80.29 | glotblastn |
| 2465 | LNU729 | amborella\|gb166\|CV460035 | 5021 | 666 | 80 | globlastp |
| 2466 | LNU729 | pigeonpea\|10v1\|SRR054580S0214368 | 5022 | 666 | 80 | glotblastn |
| 2467 | LNU729 | poplar\|10v1\|AI162463_P1 | 5023 | 666 | 80 | globlastp |
| 2468 | LNU729 | poplar\|10v1\|BI069920_P1 | 5024 | 666 | 80 | globlastp |
| 2469 | LNU729 | vinca\|11v1\|SRR098690X129448 | 5025 | 666 | 80 | globlastp |
| 2470 | LNU730 | solanum_phureja\|09v1\|SPHBG125581 | 5026 | 667 | 94.1 | globlastp |
| 2471 | LNU732 | potato\|10v1\|BQ515939_P1 | 5027 | 668 | 86 | globlastp |
| 2472 | LNU732 | solanum_phureja\|09v1\|SPHBG127018 | 5028 | 668 | 84.9 | globlastp |
| 2473 | LNU733 | basilicum\|10v1\|DY335203_P1 | 5029 | 669 | 99.1 | globlastp |
| 2474 | LNU733 | eggplant\|10v1\|FS008776_P1 | 5030 | 669 | 98.2 | globlastp |
| 2475 | LNU733 | potato\|10v1\|AW906873_P1 | 5031 | 669 | 97.3 | globlastp |
| 2476 | LNU733 | solanum_phureja\|09v1\|SPHBG127771 | 5031 | 669 | 97.3 | globlastp |
| 2477 | LNU733 | pepper\|12v1\|BM061688_P1 | 5032 | 669 | 96.4 | globlastp |
| 2478 | LNU733 | pepper\|gb171\|BM061688 | 5032 | 669 | 96.4 | globlastp |
| 2479 | LNU733 | antirrhinum\|gb166\|AJ559360_P1 | 5033 | 669 | 95.5 | globlastp |
| 2480 | LNU733 | oak\|10v1\|FP048735_P1 | 5034 | 669 | 95.5 | globlastp |
| 2481 | LNU733 | lovegrass\|gb167\|DN480872_P1 | 5035 | 669 | 94.7 | globlastp |
| 2482 | LNU733 | amorphophallus\|11v2\|SRR089351X167703_P1 | 5036 | 669 | 94.6 | globlastp |
| 2483 | LNU733 | petunia\|gb171\|DC244149_P1 | 5037 | 669 | 94.6 | globlastp |
| 2484 | LNU733 | phyla\|11v2\|SRR099035X10103_P1 | 5038 | 669 | 94.6 | globlastp |
| 2485 | LNU733 | solanum_phureja\|09v1\|SPHBG138459 | 5039 | 669 | 94.6 | globlastp |
| 2486 | LNU733 | amorphophallus\|11v2\|SRR089351X113183_P1 | 5040 | 669 | 93.8 | globlastp |
| 2487 | LNU733 | foxtail_millet\|11v3\|PHY7SI003115M_P1 | 5041 | 669 | 93.8 | globlastp |
| 2488 | LNU733 | cucurbita\|11v1\|SRR091276X100126_P1 | 5042 | 669 | 93.8 | globlastp |
| 2489 | LNU733 | millet\|10v1\|EVO454PM007204_P1 | 5043 | 669 | 93.8 | globlastp |
| 2490 | LNU733 | monkeyflower\|10v1\|DV207102_P1 | 5044 | 669 | 93.8 | globlastp |
| 2491 | LNU733 | radish\|gb164\|EV526825 | 5045 | 669 | 93.8 | globlastp |
| 2492 | LNU733 | radish\|gb164\|EV528948 | 5045 | 669 | 93.8 | globlastp |
| 2493 | LNU733 | radish\|gb164\|EW716440 | 5045 | 669 | 93.8 | globlastp |
| 2494 | LNU733 | rice\|11v1\|GFXRICCYTCX1_P1 | 5046 | 669 | 93.8 | globlastp |
| 2495 | LNU733 | rice\|gb170\|OS05G34770 | 5046 | 669 | 93.8 | globlastp |
| 2496 | LNU733 | sesame\|10v1\|BU669505 | 5047 | 669 | 93.8 | globlastp |
| 2497 | LNU733 | sesame\|12v1\|BU669505_P1 | 5047 | 669 | 93.8 | globlastp |
| 2498 | LNU733 | sorghum\|09v1\|SB09G020710 | 5048 | 669 | 93.8 | globlastp |
| 2499 | LNU733 | sorghum\|12v1\|SB09G020710_P1 | 5048 | 669 | 93.8 | globlastp |
| 2500 | LNU733 | tomato\|10v1\|BG138459 | 5049 | 669 | 93.8 | globlastp |
| 2501 | LNU733 | tomato\|11v1\|BG138459_P1 | 5049 | 669 | 93.8 | globlastp |
| 2502 | LNU733 | banana\|12v1\|DN239550_P1 | 5050 | 669 | 92.9 | globlastp |
| 2503 | LNU733 | castorbean\|11v1\|RCCRP004955_P1 | 5051 | 669 | 92.9 | globlastp |
| 2504 | LNU733 | cotton\|11v1\|BE055669_P1 | 5052 | 669 | 92.9 | globlastp |
| 2505 | LNU733 | eschscholzia\|11v1\|SRR014116.127507_P1 | 5053 | 669 | 92.9 | globlastp |
| 2506 | LNU733 | foxtail_millet\|11v3\|PHY7SI023691M_P1 | 5054 | 669 | 92.9 | globlastp |
| 2507 | LNU733 | thellungiella_parvulum\|11v1\|BQ060340_P1 | 5055 | 669 | 92.9 | globlastp |
| 2508 | LNU733 | aquilegia\|10v2\|JGIAC003870_P1 | 5056 | 669 | 92.9 | globlastp |
| 2509 | LNU733 | banana\|10v1\|DN239550 | 5057 | 669 | 92.9 | globlastp |
| 2510 | LNU733 | castorbean\|09v1\|XM002512383 | 5051 | 669 | 92.9 | globlastp |
| 2511 | LNU733 | catharanthus\|11v1\|SRR098691X154637_P1 | 5058 | 669 | 92.9 | globlastp |
| 2512 | LNU733 | cleome_spinosa\|10v1\|SRR015531S0007272_P1 | 5059 | 669 | 92.9 | globlastp |
| 2513 | LNU733 | cotton\|10v2\|AI730609 | 5060 | 669 | 92.9 | globlastp |
| 2514 | LNU733 | cotton\|10v2\|BG442170 | 5052 | 669 | 92.9 | globlastp |
| 2515 | LNU733 | cotton\|10v2\|CF075617 | 5061 | 669 | 92.9 | globlastp |
| 2516 | LNU733 | cynodon\|10v1\|ES301356_P1 | 5062 | 669 | 92.9 | globlastp |
| 2517 | LNU733 | eschscholzia\|10v1\|SRR014116S0006498 | 5053 | 669 | 92.9 | globlastp |
| 2518 | LNU733 | eschscholzia\|11v1\|SRR014116.101755_P1 | 5053 | 669 | 92.9 | globlastp |
| 2519 | LNU733 | euphorbia\|11v1\|BP962279_P1 | 5063 | 669 | 92.9 | globlastp |
| 2520 | LNU733 | foxtail_millet\|10v2\|OXFXTSLX00009073T1 | 5054 | 669 | 92.9 | globlastp |
| 2521 | LNU733 | maize\|10v1\|AI491216_P1 | 5064 | 669 | 92.9 | globlastp |
| 2522 | LNU733 | maize\|10v1\|AW017949_P1 | 5065 | 669 | 92.9 | globlastp |
| 2523 | LNU733 | maize\|10v1\|BM348613_P1 | 5066 | 669 | 92.9 | globlastp |
| 2524 | LNU733 | petunia\|gb171\|CV292695_P1 | 5067 | 669 | 92.9 | globlastp |
| 2525 | LNU733 | plantago\|11v1\|SRR066373X101985 | 5068 | 669 | 92.9 | globlastp |
| 2526 | LNU733 | plantago\|11v2\|SRR066373X101985_P1 | 5068 | 669 | 92.9 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 2527 | LNU733 | plantago\|11v1\|SRR066373X112515_P1 | 5069 | 669 | 92.9 | globlastp |
| 2528 | LNU733 | plantago\|11v2\|SRR066373X112515_P1 | 5069 | 669 | 92.9 | globlastp |
| 2529 | LNU733 | radish\|gb164\|EV536189 | 5055 | 669 | 92.9 | globlastp |
| 2530 | LNU733 | radish\|gb164\|EW726632 | 5055 | 669 | 92.9 | globlastp |
| 2531 | LNU733 | radish\|gb164\|EY902064 | 5055 | 669 | 92.9 | globlastp |
| 2532 | LNU733 | radish\|gb164\|EY911906 | 5055 | 669 | 92.9 | globlastp |
| 2533 | LNU733 | radish\|gb164\|EY919945 | 5070 | 669 | 92.9 | globlastp |
| 2534 | LNU733 | sorghum\|09v1\|SB03G042000 | 5071 | 669 | 92.9 | globlastp |
| 2535 | LNU733 | sorghum\|12v1\|SB03G042000_P1 | 5071 | 669 | 92.9 | globlastp |
| 2536 | LNU733 | sugarcane\|10v1\|CA103672 | 5072 | 669 | 92.9 | globlastp |
| 2537 | LNU733 | switchgrass\|gb167\|DN144956 | 5054 | 669 | 92.9 | globlastp |
| 2538 | LNU733 | switchgrass\|gb167\|FE628199 | 5054 | 669 | 92.9 | globlastp |
| 2539 | LNU733 | wheat\|12v3\|BE498524_P1 | 5073 | 669 | 92.9 | globlastp |
| 2540 | LNU733 | cotton\|11v1\|AI730609_P1 | 5060 | 669 | 92.9 | globlastp |
| 2541 | LNU733 | cotton\|11v1\|DW505205_P1 | 5052 | 669 | 92.9 | globlastp |
| 2542 | LNU733 | gossypium_raimondii\|12v1\|AI730609_T1 | 5074 | 669 | 92.86 | glotblastn |
| 2543 | LNU733 | castorbean\|11v1\|EV523042_T1 | 5075 | 669 | 92.86 | glotblastn |
| 2544 | LNU733 | sugarcane\|10v1\|BQ533167 | 5076 | 669 | 92.86 | glotblastn |
| 2545 | LNU733 | aristolochia\|10v1\|SRR039370S0016326_P1 | 5077 | 669 | 92.1 | globlastp |
| 2546 | LNU733 | b_juncea\|12v1\|E6ANDIZ01AJL7W_P1 | 5078 | 669 | 92 | globlastp |
| 2547 | LNU733 | b_rapa\|11v1\|CN733762_P1 | 5078 | 669 | 92 | globlastp |
| 2548 | LNU733 | b_rapa\|11v1\|L47957_P1 | 5079 | 669 | 92 | globlastp |
| 2549 | LNU733 | banana\|12v1\|MAGEN2012006723_P1 | 5080 | 669 | 92 | globlastp |
| 2550 | LNU733 | beech\|11v1\|SRR006293.29937_P1 | 5081 | 669 | 92 | globlastp |
| 2551 | LNU733 | flax\|11v1\|GW866554_P1 | 5082 | 669 | 92 | globlastp |
| 2552 | LNU733 | gossypium_raimondii\|12v1\|BE055669_P1 | 5083 | 669 | 92 | globlastp |
| 2553 | LNU733 | hornbeam\|12v1\|SRR364455.124932_P1 | 5084 | 669 | 92 | globlastp |
| 2554 | LNU733 | hornbeam\|12v1\|SRR364455.128949_P1 | 5084 | 669 | 92 | globlastp |
| 2555 | LNU733 | oil_palm\|11v1\|ES414408_P1 | 5085 | 669 | 92 | globlastp |
| 2556 | LNU733 | poppy\|11v1\|SRR096789.226725_P1 | 5086 | 669 | 92 | globlastp |
| 2557 | LNU733 | rye\|12v1\|DRR001012.156330_P1 | 5087 | 669 | 92 | globlastp |
| 2558 | LNU733 | rye\|12v1\|DRR001012.73350_P1 | 5087 | 669 | 92 | globlastp |
| 2559 | LNU733 | rye\|12v1\|DRR001014.100733_P1 | 5087 | 669 | 92 | globlastp |
| 2560 | LNU733 | rye\|12v1\|DRR001014.111217_P1 | 5087 | 669 | 92 | globlastp |
| 2561 | LNU733 | rye\|12v1\|DRR001014.248254_P1 | 5087 | 669 | 92 | globlastp |
| 2562 | LNU733 | thellungiella_halophilum\|11v1\|EC599963_P1 | 5078 | 669 | 92 | globlastp |
| 2563 | LNU733 | watermelon\|11v1\|DV634609_P1 | 5088 | 669 | 92 | globlastp |
| 2564 | LNU733 | b_oleracea\|gb161\|DY025905_P1 | 5079 | 669 | 92 | globlastp |
| 2565 | LNU733 | b_rapa\|gb162\|DN961460 | 5078 | 669 | 92 | globlastp |
| 2566 | LNU733 | bean\|12v1\|CA896756_P1 | 5089 | 669 | 92 | globlastp |
| 2567 | LNU733 | bean\|gb167\|CA896756 | 5089 | 669 | 92 | globlastp |
| 2568 | LNU733 | cacao\|10v1\|CU472794_P1 | 5090 | 669 | 92 | globlastp |
| 2569 | LNU733 | canola\|10v1\|CN733762 | 5078 | 669 | 92 | globlastp |
| 2570 | LNU733 | canola\|11v1\|CN733762_P1 | 5078 | 669 | 92 | globlastp |
| 2571 | LNU733 | canola\|10v1\|CN736563 | 5079 | 669 | 92 | globlastp |
| 2572 | LNU733 | canola\|10v1\|CX193066 | 5079 | 669 | 92 | globlastp |
| 2573 | LNU733 | canola\|11v1\|DW997868XX1_P1 | 5079 | 669 | 92 | globlastp |
| 2574 | LNU733 | castorbean\|09v1\|EE254638 | 5091 | 669 | 92 | globlastp |
| 2575 | LNU733 | castorbean\|11v1\|EE254638_P1 | 5091 | 669 | 92 | globlastp |
| 2576 | LNU733 | cleome_spinosa\|10v1\|SRR015531S0037051_P1 | 5092 | 669 | 92 | globlastp |
| 2577 | LNU733 | cucurbita\|11v1\|SRR091276X126996_P1 | 5088 | 669 | 92 | globlastp |
| 2578 | LNU733 | cynodon\|10v1\|ES295877_P1 | 5093 | 669 | 92 | globlastp |
| 2579 | LNU733 | euonymus\|11v1\|SRR070038X110460_P1 | 5094 | 669 | 92 | globlastp |
| 2580 | LNU733 | euonymus\|11v1\|SRR070038X112483_P1 | 5094 | 669 | 92 | globlastp |
| 2581 | LNU733 | flax\|09v1\|CV478579 | 5082 | 669 | 92 | globlastp |
| 2582 | LNU733 | flax\|11v1\|CV478579_P1 | 5082 | 669 | 92 | globlastp |
| 2583 | LNU733 | grape\|11v1\|GSVIVT01036385001_P1 | 5095 | 669 | 92 | globlastp |
| 2584 | LNU733 | grape\|gb160\|BQ796761 | 5095 | 669 | 92 | globlastp |
| 2585 | LNU733 | ipomoea_nil\|10v1\|BJ555371_P1 | 5096 | 669 | 92 | globlastp |
| 2586 | LNU733 | jatropha\|09v1\|FM895684_P1 | 5097 | 669 | 92 | globlastp |
| 2587 | LNU733 | lettuce\|10v1\|DW045333 | 5098 | 669 | 92 | globlastp |
| 2588 | LNU733 | lotus\|09v1\|BI419535_P1 | 5099 | 669 | 92 | globlastp |
| 2589 | LNU733 | melon\|10v1\|DV634609_P1 | 5100 | 669 | 92 | globlastp |
| 2590 | LNU733 | papaya\|gb165\|EX239654_P1 | 5101 | 669 | 92 | globlastp |
| 2591 | LNU733 | phyla\|11v1\|SRR099035X140732 | 5102 | 669 | 92 | globlastp |
| 2592 | LNU733 | phyla\|11v2\|SRR099035X140732_P1 | 5102 | 669 | 92 | globlastp |
| 2593 | LNU733 | pigeonpea\|10v1\|SRR054580S0198695 | 5103 | 669 | 92 | globlastp |
| 2594 | LNU733 | pigeonpea\|11v1\|SRR054580X174845_P1 | 5103 | 669 | 92 | globlastp |
| 2595 | LNU733 | pineapple\|10v1\|DT338094_P1 | 5104 | 669 | 92 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to Polyp. SEQ ID NO: | % global identity | Algor. |
|---|---|---|---|---|---|---|
| 2596 | LNU733 | primula|11v1|SRR098679X108149_P1 | 5105 | 669 | 92 | globlastp |
| 2597 | LNU733 | radish|gb164|EV528294 | 5106 | 669 | 92 | globlastp |
| 2598 | LNU733 | radish|gb164|EY917377 | 5078 | 669 | 92 | globlastp |
| 2599 | LNU733 | rhizophora|10v1|SRR005793S0061256 | 5107 | 669 | 92 | globlastp |
| 2600 | LNU733 | salvia|10v1|CV166758 | 5108 | 669 | 92 | globlastp |
| 2601 | LNU733 | soybean|11v1|GLYMA09G38230 | 5109 | 669 | 92 | globlastp |
| 2602 | LNU733 | soybean|11v1|GLYMA18G48160 | 5110 | 669 | 92 | globlastp |
| 2603 | LNU733 | switchgrass|gb167|FE617632 | 5111 | 669 | 92 | globlastp |
| 2604 | LNU733 | tabernaemontana|11v1|SRR098689X114972 | 5112 | 669 | 92 | globlastp |
| 2605 | LNU733 | thellungiella|gb167|EC599963 | 5078 | 669 | 92 | globlastp |
| 2606 | LNU733 | tobacco|gb162|EB677971 | 5113 | 669 | 92 | globlastp |
| 2607 | LNU733 | tobacco|gb162|EB683454 | 5114 | 669 | 92 | globlastp |
| 2608 | LNU733 | rose|12v1|BI977309_P1 | 5115 | 669 | 92 | globlastp |
| 2609 | LNU733 | phalaenopsis|11v1|CK855859_T1 | 5116 | 669 | 91.96 | glotblastn |
| 2610 | LNU733 | b_juncea|10v2|OXBJ1SLX00004899D1T1 | 5117 | 669 | 91.96 | glotblastn |
| 2611 | LNU733 | canola|10v1|EE481984 | 5118 | 669 | 91.96 | glotblastn |
| 2612 | LNU733 | radish|gb164|EY904989 | 5119 | 669 | 91.96 | glotblastn |
| 2613 | LNU733 | blueberry|12v1|CV190367_P1 | 5120 | 669 | 91.2 | globlastp |
| 2614 | LNU733 | oil_palm|11v1|SRR190698.117282_P1 | 5121 | 669 | 91.2 | globlastp |
| 2615 | LNU733 | oil_palm|11v1|SRR190698.269301_P1 | 5122 | 669 | 91.2 | globlastp |
| 2616 | LNU733 | avocado|10v1|CK753824_P1 | 5123 | 669 | 91.2 | globlastp |
| 2617 | LNU733 | brachypodium|09v1|DV472439 | 5124 | 669 | 91.2 | globlastp |
| 2618 | LNU733 | brachypodium|12v1|BRADI2G25030_P1 | 5124 | 669 | 91.2 | globlastp |
| 2619 | LNU733 | coffea|10v1|DV673106_P1 | 5125 | 669 | 91.2 | globlastp |
| 2620 | LNU733 | cotton|10v2|SRR032799S0021477 | 5126 | 669 | 91.2 | globlastp |
| 2621 | LNU733 | cotton|11v1|SRR032799.21476_P1 | 5126 | 669 | 91.2 | globlastp |
| 2622 | LNU733 | eucalyptus|11v2|CD669512_P1 | 5127 | 669 | 91.2 | globlastp |
| 2623 | LNU733 | oil_palm|gb166|ES414408 | 5128 | 669 | 91.2 | globlastp |
| 2624 | LNU733 | phyla|11v2|SRR099035X102982_P1 | 5129 | 669 | 91.2 | globlastp |
| 2625 | LNU733 | b_juncea|12v1|E6ANDIZ01B5YRY_P1 | 5130 | 669 | 91.1 | globlastp |
| 2626 | LNU733 | b_rapa|11v1|CD811768_P1 | 5130 | 669 | 91.1 | globlastp |
| 2627 | LNU733 | cannabis|12v1|SOLX00019212_P1 | 5131 | 669 | 91.1 | globlastp |
| 2628 | LNU733 | cannabis|12v1|SOLX00025052_P1 | 5131 | 669 | 91.1 | globlastp |
| 2629 | LNU733 | cannabis|12v1|SOLX00057848_P1 | 5131 | 669 | 91.1 | globlastp |
| 2630 | LNU733 | cirsium|11v1|SRR346952.1032920_P1 | 5132 | 669 | 91.1 | globlastp |
| 2631 | LNU733 | cotton|11v1|CO126579_P1 | 5133 | 669 | 91.1 | globlastp |
| 2632 | LNU733 | flaveria|11v1|SRR149232.122740_P1 | 5134 | 669 | 91.1 | globlastp |
| 2633 | LNU733 | fraxinus|11v1|SRR058827.130406_P1 | 5135 | 669 | 91.1 | globlastp |
| 2634 | LNU733 | arabidopsis_lyrata|09v1|JGIAL022941_P1 | 5136 | 669 | 91.1 | globlastp |
| 2635 | LNU733 | arabidopsis|10v1|AT4G10040_P1 | 5136 | 669 | 91.1 | globlastp |
| 2636 | LNU733 | b_juncea|10v2|E6ANDIZ01B5YRY | 5130 | 669 | 91.1 | globlastp |
| 2637 | LNU733 | b_juncea|10v2|E6ANDIZ01BSGWN | 5130 | 669 | 91.1 | globlastp |
| 2638 | LNU733 | b_juncea|10v2|E6ANDIZ02I357A | 5130 | 669 | 91.1 | globlastp |
| 2639 | LNU733 | b_rapa|gb162|CV432141 | 5130 | 669 | 91.1 | globlastp |
| 2640 | LNU733 | barley|10v2|BM442091 | 5137 | 669 | 91.1 | globlastp |
| 2641 | LNU733 | barley|12v1|BM442091_P1 | 5137 | 669 | 91.1 | globlastp |
| 2642 | LNU733 | cacao|10v1|CU469779_P1 | 5138 | 669 | 91.1 | globlastp |
| 2643 | LNU733 | canola|10v1|CD811768 | 5130 | 669 | 91.1 | globlastp |
| 2644 | LNU733 | canola|10v1|CD813209 | 5130 | 669 | 91.1 | globlastp |
| 2645 | LNU733 | canola|10v1|DY006791 | 5139 | 669 | 91.1 | globlastp |
| 2646 | LNU733 | canola|11v1|DY006791_P1 | 5139 | 669 | 91.1 | globlastp |
| 2647 | LNU733 | catharanthus|11v1|SRR098691X106122_P1 | 5140 | 669 | 91.1 | globlastp |
| 2648 | LNU733 | centaurea|gb166|EH722676_P1 | 5132 | 669 | 91.1 | globlastp |
| 2649 | LNU733 | chelidonium|11v1|SRR084752X110032XX2_P1 | 5141 | 669 | 91.1 | globlastp |
| 2650 | LNU733 | cichorium|gb171|EH707440_P1 | 5142 | 669 | 91.1 | globlastp |
| 2651 | LNU733 | citrus|gb166|BE208873 | 5143 | 669 | 91.1 | globlastp |
| 2652 | LNU733 | clementine|11v1|BE208873_P1 | 5143 | 669 | 91.1 | globlastp |
| 2653 | LNU733 | clementine|11v1|CB292436_P1 | 5144 | 669 | 91.1 | globlastp |
| 2654 | LNU733 | cleome_gynandra|10v1|SRR015532S0026058_P1 | 5145 | 669 | 91.1 | globlastp |
| 2655 | LNU733 | cotton|10v2|SRR032368S0263373 | 5133 | 669 | 91.1 | globlastp |
| 2656 | LNU733 | curcuma|10v1|DY389112_P1 | 5146 | 669 | 91.1 | globlastp |
| 2657 | LNU733 | grape|11v1|GSVIVT01023218001_P1 | 5147 | 669 | 91.1 | globlastp |
| 2658 | LNU733 | grape|gb160|CB910601 | 5147 | 669 | 91.1 | globlastp |
| 2659 | LNU733 | ipomoea_batatas|10v1|BU690360_P1 | 5148 | 669 | 91.1 | globlastp |
| 2660 | LNU733 | ipomoea_nil|10v1|BJ553575_P1 | 5149 | 669 | 91.1 | globlastp |
| 2661 | LNU733 | monkeyflower|10v1|GO979466_P1 | 5150 | 669 | 91.1 | globlastp |
| 2662 | LNU733 | nasturtium|10v1|SRR032558S0251892 | 5151 | 669 | 91.1 | globlastp |
| 2663 | LNU733 | orange|11v1|BE208873_P1 | 5143 | 669 | 91.1 | globlastp |
| 2664 | LNU733 | orange|11v1|CB292436_P1 | 5144 | 669 | 91.1 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 2665 | LNU733 | primula\|11v1\|SRR098679X119203_P1 | 5152 | 669 | 91.1 | globlastp |
| 2666 | LNU733 | prunus\|10v1\|CB818531 | 5153 | 669 | 91.1 | globlastp |
| 2667 | LNU733 | tobacco\|gb162\|EB427039 | 5154 | 669 | 91.1 | globlastp |
| 2668 | LNU733 | wheat\|10v2\|BE498524 | 5155 | 669 | 91.1 | globlastp |
| 2669 | LNU733 | canola\|11v1\|CN736563XX1_P1 | 5130 | 669 | 91.1 | globlastp |
| 2670 | LNU733 | b_rapa\|11v1\|EE481984_T1 | 5156 | 669 | 91.07 | glotblastn |
| 2671 | LNU733 | canola\|11v1\|EG019749_T1 | 5157 | 669 | 91.07 | glotblastn |
| 2672 | LNU733 | rye\|12v1\|DRR001014.145840_T1 | 5158 | 669 | 91.07 | glotblastn |
| 2673 | LNU733 | b_juncea\|10v2\|OXBJ1SLX00009511T1 | 5159 | 669 | 91.07 | glotblastn |
| 2674 | LNU733 | tabernaemontana\|11v1\|SRR098689X101391 | 5160 | 669 | 91.07 | glotblastn |
| 2675 | LNU733 | b_juncea\|12v1\|E6ANDIZ01B3CMH_T1 | 5161 | 669 | 91.07 | glotblastn |
| 2676 | LNU733 | rye\|12v1\|DRR001012.296348_T1 | — | 669 | 91.07 | glotblastn |
| 2677 | LNU733 | momordica\|10v1\|SRR071315S0033419_P1 | 5162 | 669 | 90.4 | globlastp |
| 2678 | LNU733 | banana\|12v1\|ES432266_P1 | 5163 | 669 | 90.3 | globlastp |
| 2679 | LNU733 | phalaenopsis\|11v1\|CB034302_P1 | 5164 | 669 | 90.3 | globlastp |
| 2680 | LNU733 | sesame\|12v1\|JK046625_P1 | 5165 | 669 | 90.3 | globlastp |
| 2681 | LNU733 | banana\|10v1\|ES432266 | 5163 | 669 | 90.3 | globlastp |
| 2682 | LNU733 | bruguiera\|gb166\|BP941889_P1 | 5166 | 669 | 90.3 | globlastp |
| 2683 | LNU733 | liriodendron\|gb166\|CO995265_P1 | 5167 | 669 | 90.3 | globlastp |
| 2684 | LNU733 | nuphar\|gb166\|FD383256_P1 | 5168 | 669 | 90.3 | globlastp |
| 2685 | LNU733 | olea\|11v1\|SRR014463.460_P1 | 5169 | 669 | 90.3 | globlastp |
| 2686 | LNU733 | poplar\|10v1\|AI166005_P1 | 5170 | 669 | 90.3 | globlastp |
| 2687 | LNU733 | poplar\|10v1\|BI128790_P1 | 5171 | 669 | 90.3 | globlastp |
| 2688 | LNU733 | rose\|10v1\|BI978873 | 5172 | 669 | 90.3 | globlastp |
| 2689 | LNU733 | thalictrum\|11v1\|SRR096787X128835 | 5173 | 669 | 90.3 | globlastp |
| 2690 | LNU733 | banana\|12v1\|MAGEN2012020850_P1 | 5174 | 669 | 90.2 | globlastp |
| 2691 | LNU733 | cirsium\|11v1\|SRR346952.108336_P1 | 5175 | 669 | 90.2 | globlastp |
| 2692 | LNU733 | flaveria\|11v1\|SRR149232.218415_P1 | 5176 | 669 | 90.2 | globlastp |
| 2693 | LNU733 | flaveria\|11v1\|SRR149238.113035_P1 | 5177 | 669 | 90.2 | globlastp |
| 2694 | LNU733 | flaveria\|11v1\|SRR149244.218061_P1 | 5178 | 669 | 90.2 | globlastp |
| 2695 | LNU733 | poppy\|11v1\|SRR030259.102733_P1 | 5179 | 669 | 90.2 | globlastp |
| 2696 | LNU733 | utricularia\|11v1\|SRR094438.111962_P1 | 5180 | 669 | 90.2 | globlastp |
| 2697 | LNU733 | abies\|11v2\|SRR098676X122621_P1 | 5181 | 669 | 90.2 | globlastp |
| 2698 | LNU733 | apple\|11v1\|CN490378_P1 | 5182 | 669 | 90.2 | globlastp |
| 2699 | LNU733 | cassava\|09v1\|DB923877_P1 | 5183 | 669 | 90.2 | globlastp |
| 2700 | LNU733 | cephalotaxus\|11v1\|SRR064395X143145_P1 | 5184 | 669 | 90.2 | globlastp |
| 2701 | LNU733 | cichorium\|gb171\|AF101422_P1 | 5185 | 669 | 90.2 | globlastp |
| 2702 | LNU733 | citrus\|gb166\|CB292436 | 5186 | 669 | 90.2 | globlastp |
| 2703 | LNU733 | dandelion\|10v1\|DR401125_P1 | 5187 | 669 | 90.2 | globlastp |
| 2704 | LNU733 | ginger\|gb164\|DY361440_P1 | 5188 | 669 | 90.2 | globlastp |
| 2705 | LNU733 | ginger\|gb164\|DY368698_P1 | 5189 | 669 | 90.2 | globlastp |
| 2706 | LNU733 | guizotia\|10v1\|GE574648_P1 | 5190 | 669 | 90.2 | globlastp |
| 2707 | LNU733 | hevea\|10v1\|EC600970_P1 | 5191 | 669 | 90.2 | globlastp |
| 2708 | LNU733 | nasturtium\|10v1\|SRR032558S0113758 | 5192 | 669 | 90.2 | globlastp |
| 2709 | LNU733 | nasturtium\|11v1\|SRR032558.113859_P1 | 5192 | 669 | 90.2 | globlastp |
| 2710 | LNU733 | olea\|11v1\|SRR014466.38596_P1 | 5193 | 669 | 90.2 | globlastp |
| 2711 | LNU733 | orobanche\|10v1\|SRR023189S0020829_P1 | 5194 | 669 | 90.2 | globlastp |
| 2712 | LNU733 | phyla\|11v1\|SRR099037X103484 | 5195 | 669 | 90.2 | globlastp |
| 2713 | LNU733 | phyla\|11v2\|SRR099037X103484_P1 | 5195 | 669 | 90.2 | globlastp |
| 2714 | LNU733 | silene\|11v1\|SRR096785X111697 | 5196 | 669 | 90.2 | globlastp |
| 2715 | LNU733 | sunflower\|10v1\|HNNCYTC | 5197 | 669 | 90.2 | globlastp |
| 2716 | LNU733 | sunflower\|12v1\|HNNCYTC_P1 | 5197 | 669 | 90.2 | globlastp |
| 2717 | LNU733 | tragopogon\|10v1\|SRR020205S0007404 | 5198 | 669 | 90.2 | globlastp |
| 2718 | LNU733 | sarracenia\|11v1\|SRR192669.111993_T1 | 5199 | 669 | 90.18 | glotblastn |
| 2719 | LNU733 | foxtail_millet\|10v2\|SICRP034192 | 5200 | 669 | 90.18 | glotblastn |
| 2720 | LNU733 | triphysaria\|10v1\|SRR023501S0006369 | 5201 | 669 | 90.18 | glotblastn |
| 2721 | LNU733 | medicago\|12v1\|AW685121_T1 | 5202 | 669 | 90.18 | glotblastn |
| 2722 | LNU733 | chickpea\|11v1\|GR392621XX1_P1 | 5203 | 669 | 89.5 | globlastp |
| 2723 | LNU733 | spruce\|11v1\|EX429749_P1 | 5204 | 669 | 89.5 | globlastp |
| 2724 | LNU733 | pine\|10v2\|AA556604_P1 | 5205 | 669 | 89.5 | globlastp |
| 2725 | LNU733 | spruce\|11v1\|ES250198_P1 | 5204 | 669 | 89.5 | globlastp |
| 2726 | LNU733 | spruce\|gb162\|CO217325 | 5204 | 669 | 89.5 | globlastp |
| 2727 | LNU733 | gossypium_raimondii\|12v1\|DW498670_P1 | 5206 | 669 | 89.4 | globlastp |
| 2728 | LNU733 | gossypium_raimondii\|12v1\|SRR032877.444816_P1 | 5206 | 669 | 89.4 | globlastp |
| 2729 | LNU733 | oil_palm\|11v1\|EY397939_P1 | 5207 | 669 | 89.4 | globlastp |
| 2730 | LNU733 | aristolochia\|10v1\|SRR039082S0295988_P1 | 5208 | 669 | 89.4 | globlastp |
| 2731 | LNU733 | chestnut\|gb170\|SRR006295S0005068_P1 | 5209 | 669 | 89.4 | globlastp |
| 2732 | LNU733 | cotton\|10v2\|DW498670 | 5206 | 669 | 89.4 | globlastp |
| 2733 | LNU733 | cotton\|11v1\|DW498670_P1 | 5206 | 669 | 89.4 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to Polyp. SEQ ID NO: | % global identity | Algor. |
|---|---|---|---|---|---|---|
| 2734 | LNU733 | fescue\|gb161\|DT693470_P1 | 5210 | 669 | 89.4 | globlastp |
| 2735 | LNU733 | liquorice\|gb171\|FS256866_P1 | 5211 | 669 | 89.4 | globlastp |
| 2736 | LNU733 | medicago\|09v1\|AW685367 | 5212 | 669 | 89.4 | globlastp |
| 2737 | LNU733 | medicago\|12v1\|AW685367_P1 | 5212 | 669 | 89.4 | globlastp |
| 2738 | LNU733 | oak\|10v1\|DN949765_P1 | 5213 | 669 | 89.4 | globlastp |
| 2739 | LNU733 | peanut\|10v1\|EE124463_P1 | 5214 | 669 | 89.4 | globlastp |
| 2740 | LNU733 | trigonella\|11v1\|SRR066194X323585 | 5215 | 669 | 89.4 | globlastp |
| 2741 | LNU733 | cirsium\|11v1\|SRR346952.1002752XX1_P1 | 5216 | 669 | 89.3 | globlastp |
| 2742 | LNU733 | poppy\|11v1\|FG611734_P1 | 5217 | 669 | 89.3 | globlastp |
| 2743 | LNU733 | thellungiella_parvulum\|11v1\|EC599963_P1 | 5218 | 669 | 89.3 | globlastp |
| 2744 | LNU733 | arnica\|11v1\|SRR099034X158543_P1 | 5219 | 669 | 89.3 | globlastp |
| 2745 | LNU733 | brachypodium\|09v1\|SRR031798S0243963 | 5220 | 669 | 89.3 | globlastp |
| 2746 | LNU733 | brachypodium\|12v1\|BRADI2G57160_P1 | 5220 | 669 | 89.3 | globlastp |
| 2747 | LNU733 | cynara\|gb167\|GE587359_P1 | 5221 | 669 | 89.3 | globlastp |
| 2748 | LNU733 | euphorbia\|11v1\|DV120780_P1 | 5222 | 669 | 89.3 | globlastp |
| 2749 | LNU733 | fagopyrum\|11v1\|SRR063703X103487_P1 | 5223 | 669 | 89.3 | globlastp |
| 2750 | LNU733 | gerbera\|09v1\|AJ760700_P1 | 5224 | 669 | 89.3 | globlastp |
| 2751 | LNU733 | nasturtium\|10v1\|GH171575 | 5225 | 669 | 89.3 | globlastp |
| 2752 | LNU733 | nasturtium\|11v1\|GH171575_P1 | 5225 | 669 | 89.3 | globlastp |
| 2753 | LNU733 | pea\|11v1\|CD859351_P1 | 5226 | 669 | 89.3 | globlastp |
| 2754 | LNU733 | phyla\|11v1\|SRR099037X105094 | 5227 | 669 | 89.3 | globlastp |
| 2755 | LNU733 | phyla\|11v2\|SRR099037X105094_P1 | 5227 | 669 | 89.3 | globlastp |
| 2756 | LNU733 | poppy\|gb166\|FG611734 | 5217 | 669 | 89.3 | globlastp |
| 2757 | LNU733 | silene\|11v1\|GH292001 | 5228 | 669 | 89.3 | globlastp |
| 2758 | LNU733 | spurge\|gb161\|DV120780 | 5222 | 669 | 89.3 | globlastp |
| 2759 | LNU733 | strawberry\|11v1\|CO378574 | 5229 | 669 | 89.3 | globlastp |
| 2760 | LNU733 | taxus\|10v1\|SRR032523S0045171 | 5230 | 669 | 89.3 | globlastp |
| 2761 | LNU733 | flaveria\|11v1\|SRR149241.159906_T1 | 5231 | 669 | 89.29 | glotblastn |
| 2762 | LNU733 | rye\|12v1\|DRR001014.273781_T1 | 5232 | 669 | 89.29 | glotblastn |
| 2763 | LNU733 | vinca\|11v1\|SRR098690X131187XX2 | 5233 | 669 | 89.29 | glotblastn |
| 2764 | LNU733 | silene\|11v1\|SRR096785X100127 | — | 669 | 89.29 | glotblastn |
| 2765 | LNU733 | foxtail_millet\|11v3\|SIPRD089064_T1 | 5234 | 669 | 88.7 | glotblastn |
| 2766 | LNU733 | valeriana\|11v1\|SRR099039X120416_P1 | 5235 | 669 | 88.6 | globlastp |
| 2767 | LNU733 | cucumber\|09v1\|DV634609_P1 | 5236 | 669 | 88.6 | globlastp |
| 2768 | LNU733 | medicago\|09v1\|AW685121 | 5237 | 669 | 88.6 | globlastp |
| 2769 | LNU733 | beech\|11v1\|FR604946_P1 | 5238 | 669 | 88.5 | globlastp |
| 2770 | LNU733 | cotton\|11v1\|DW498962_P1 | 5239 | 669 | 88.5 | globlastp |
| 2771 | LNU733 | oat\|11v1\|GO592322_P1 | 5240 | 669 | 88.5 | globlastp |
| 2772 | LNU733 | oat\|11v1\|GR359449_P1 | 5241 | 669 | 88.5 | globlastp |
| 2773 | LNU733 | phalaenopsis\|11v1\|SRR125771.1412611_P1 | 5242 | 669 | 88.5 | globlastp |
| 2774 | LNU733 | rye\|12v1\|BE704674_P1 | 5243 | 669 | 88.5 | globlastp |
| 2775 | LNU733 | rye\|12v1\|DRR001012.102624_P1 | 5243 | 669 | 88.5 | globlastp |
| 2776 | LNU733 | rye\|12v1\|DRR001012.176075_P1 | 5243 | 669 | 88.5 | globlastp |
| 2777 | LNU733 | acacia\|10v1\|FS586573_P1 | 5244 | 669 | 88.5 | globlastp |
| 2778 | LNU733 | amsonia\|11v1\|SRR098688X107290_P1 | 5245 | 669 | 88.5 | globlastp |
| 2779 | LNU733 | barley\|10v2\|BF624713 | 5243 | 669 | 88.5 | globlastp |
| 2780 | LNU733 | barley\|12v1\|BF624713_P1 | 5243 | 669 | 88.5 | globlastp |
| 2781 | LNU733 | rye\|gb164\|BE637245 | 5243 | 669 | 88.5 | globlastp |
| 2782 | LNU733 | wheat\|10v2\|BE428203 | 5243 | 669 | 88.5 | globlastp |
| 2783 | LNU733 | wheat\|12v3\|BE429313_P1 | 5243 | 669 | 88.5 | globlastp |
| 2784 | LNU733 | chickpea\|11v1\|FE668526_P1 | 5246 | 669 | 88.4 | globlastp |
| 2785 | LNU733 | flaveria\|11v1\|SRR149244.327440_P1 | 5247 | 669 | 88.4 | globlastp |
| 2786 | LNU733 | onion\|12v1\|BI095587_P1 | 5248 | 669 | 88.4 | globlastp |
| 2787 | LNU733 | onion\|12v1\|SRR073446X100381D1_P1 | 5249 | 669 | 88.4 | globlastp |
| 2788 | LNU733 | onion\|12v1\|SRR073446X107618D1_P1 | 5248 | 669 | 88.4 | globlastp |
| 2789 | LNU733 | onion\|12v1\|SRR073446X109132D1_P1 | 5249 | 669 | 88.4 | globlastp |
| 2790 | LNU733 | onion\|12v1\|SRR073446X134919D1_P1 | 5248 | 669 | 88.4 | globlastp |
| 2791 | LNU733 | thellungiella_halophilum\|11v1\|BQ060340_P1 | 5250 | 669 | 88.4 | globlastp |
| 2792 | LNU733 | arnica\|11v1\|SRR099034X113202_P1 | 5251 | 669 | 88.4 | globlastp |
| 2793 | LNU733 | basilicum\|10v1\|DY330998_P1 | 5252 | 669 | 88.4 | globlastp |
| 2794 | LNU733 | bruguiera\|gb166\|BP941658_P1 | 5253 | 669 | 88.4 | globlastp |
| 2795 | LNU733 | chickpea\|09v2\|FE668526 | 5246 | 669 | 88.4 | globlastp |
| 2796 | LNU733 | cryptomeria\|gb166\|BY892617_P1 | 5254 | 669 | 88.4 | globlastp |
| 2797 | LNU733 | dandelion\|10v1\|GO664295_P1 | 5255 | 669 | 88.4 | globlastp |
| 2798 | LNU733 | fagopyrum\|11v1\|SRR063689X106681_P1 | 5256 | 669 | 88.4 | globlastp |
| 2799 | LNU733 | lettuce\|10v1\|DW099276 | 5257 | 669 | 88.4 | globlastp |
| 2800 | LNU733 | lettuce\|12v1\|DW099276_P1 | 5257 | 669 | 88.4 | globlastp |
| 2801 | LNU733 | sciadopitys\|10v1\|SRR065035S0010282 | 5258 | 669 | 88.4 | globlastp |
| 2802 | LNU733 | tea\|10v1\|GE651416 | 5259 | 669 | 88.4 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to Polyp. SEQ ID NO: | % global identity | Algor. |
|---|---|---|---|---|---|---|
| 2803 | LNU733 | onion\|12v1\|SRR073446X121268D1_T1 | 5260 | 669 | 88.39 | glotblastn |
| 2804 | LNU733 | sequoia\|10v1\|SRR065044S0395354 | 5261 | 669 | 88.39 | glotblastn |
| 2805 | LNU733 | wheat\|10v2\|CA617965 | 5262 | 669 | 88.39 | glotblastn |
| 2806 | LNU733 | wheat\|12v3\|CA617965_T1 | 5262 | 669 | 88.39 | glotblastn |
| 2807 | LNU733 | amsonia\|11v1\|SRR098688X147490_T1 | — | 669 | 88.39 | glotblastn |
| 2808 | LNU733 | cycas\|gb166\|EX923851_P1 | 5263 | 669 | 87.7 | globlastp |
| 2809 | LNU733 | maritime_pine\|10v1\|BX249123_P1 | 5264 | 669 | 87.7 | globlastp |
| 2810 | LNU733 | thellungiella_parvulum\|11v1\|EPPRD115535_T1 | 5265 | 669 | 87.61 | glotblastn |
| 2811 | LNU733 | amborella\|12v3\|SRR038635.54188_P1 | 5266 | 669 | 87.6 | globlastp |
| 2812 | LNU733 | gossypium_raimondii\|12v1\|DW498962_P1 | 5267 | 669 | 87.6 | globlastp |
| 2813 | LNU733 | oat\|11v1\|GO586043_P1 | 5268 | 669 | 87.6 | globlastp |
| 2814 | LNU733 | clover\|gb162\|BB915890_P1 | 5269 | 669 | 87.6 | globlastp |
| 2815 | LNU733 | cotton\|10v2\|DW498962 | 5267 | 669 | 87.6 | globlastp |
| 2816 | LNU733 | cotton\|11v1\|SRR032799.198997_P1 | 5267 | 669 | 87.6 | globlastp |
| 2817 | LNU733 | lolium\|10v1\|AU248285_P1 | 5270 | 669 | 87.6 | globlastp |
| 2818 | LNU733 | lotus\|09v1\|CRPLJ017238_P1 | 5271 | 669 | 87.6 | globlastp |
| 2819 | LNU733 | oat\|10v2\|GO586043 | 5272 | 669 | 87.6 | globlastp |
| 2820 | LNU733 | peanut\|10v1\|EG030578_P1 | 5273 | 669 | 87.6 | globlastp |
| 2821 | LNU733 | pigeonpea\|10v1\|GR466120 | 5274 | 669 | 87.6 | globlastp |
| 2822 | LNU733 | pigeonpea\|11v1\|GR466120_P1 | 5274 | 669 | 87.6 | globlastp |
| 2823 | LNU733 | platanus\|11v1\|SRR096786X104_P1 | 5275 | 669 | 87.6 | globlastp |
| 2824 | LNU733 | poplar\|10v1\|CA825037_P1 | 5276 | 669 | 87.6 | globlastp |
| 2825 | LNU733 | thalictrum\|11v1\|SRR096787X107032 | 5277 | 669 | 87.6 | globlastp |
| 2826 | LNU733 | tripterygium\|11v1\|SRR098677X105432 | 5278 | 669 | 87.6 | globlastp |
| 2827 | LNU733 | walnuts\|gb166\|CV195967 | 5279 | 669 | 87.6 | globlastp |
| 2828 | LNU733 | walnuts\|gb166\|CV196903 | 5280 | 669 | 87.6 | globlastp |
| 2829 | LNU733 | onion\|12v1\|SRR073446X143092D1_T1 | 5281 | 669 | 87.5 | globlastp |
| 2830 | LNU733 | rye\|12v1\|DRR001014.15180_P1 | 5282 | 669 | 87.5 | globlastp |
| 2831 | LNU733 | artemisia\|10v1\|EY034554_T1 | 5283 | 669 | 87.5 | glotblastn |
| 2832 | LNU733 | chestnut\|gb170\|SRR006295S0011232_T1 | 5284 | 669 | 87.5 | globlastp |
| 2833 | LNU733 | fagopyrum\|11v1\|SRR063689X107837_T1 | 5285 | 669 | 87.5 | globlastp |
| 2834 | LNU733 | ginger\|gb164\|DY351328_P1 | 5286 | 669 | 87.5 | globlastp |
| 2835 | LNU733 | kiwi\|gb166\|FG397383_P1 | 5287 | 669 | 87.5 | globlastp |
| 2836 | LNU733 | kiwi\|gb166\|FG439611_P1 | 5287 | 669 | 87.5 | globlastp |
| 2837 | LNU733 | sunflower\|10v1\|CD850741 | 5288 | 669 | 87.5 | globlastp |
| 2838 | LNU733 | thellungiella\|gb167\|BQ060340 | 5289 | 669 | 87.5 | glotblastn |
| 2839 | LNU733 | pea\|11v1\|EX569930_P1 | 5290 | 669 | 87 | globlastp |
| 2840 | LNU733 | arabidopsis_lyrata\|09v1\|JGIAL002445_P1 | 5291 | 669 | 86.8 | globlastp |
| 2841 | LNU733 | arabidopsis\|10v1\|AT1G22840_P1 | 5292 | 669 | 86.8 | globlastp |
| 2842 | LNU733 | pseudotsuga\|10v1\|SRR065119S0015686 | 5293 | 669 | 86.8 | globlastp |
| 2843 | LNU733 | antirrhinum\|gb166\|AJ801202_P1 | 5294 | 669 | 86.7 | globlastp |
| 2844 | LNU733 | avocado\|10v1\|FD504973_P1 | 5295 | 669 | 86.7 | globlastp |
| 2845 | LNU733 | gnetum\|10v1\|OXCB081697T1_P1 | 5296 | 669 | 86.7 | globlastp |
| 2846 | LNU733 | lotus\|09v1\|LLAW719444_P1 | 5297 | 669 | 86.7 | globlastp |
| 2847 | LNU733 | soybean\|11v1\|GLYMA01G441200 | 5298 | 669 | 86.7 | globlastp |
| 2848 | LNU733 | triphysaria\|10v1\|DR172934 | 5299 | 669 | 86.7 | globlastp |
| 2849 | LNU733 | rose\|12v1\|EC586921_T1 | 5300 | 669 | 86.61 | glotblastn |
| 2850 | LNU733 | safflower\|gb162\|EL403569 | 5301 | 669 | 86.61 | glotblastn |
| 2851 | LNU733 | ambrosia\|11v1\|SRR346935.486939_P1 | 5302 | 669 | 86.6 | globlastp |
| 2852 | LNU733 | ambrosia\|11v1\|SRR346935.579170_P1 | 5303 | 669 | 86.6 | globlastp |
| 2853 | LNU733 | sunflower\|12v1\|CD850741_P1 | 5304 | 669 | 86.6 | globlastp |
| 2854 | LNU733 | arnica\|11v1\|SRR099034X226920_P1 | 5305 | 669 | 86.6 | globlastp |
| 2855 | LNU733 | cassava\|09v1\|DR087714_P1 | 5306 | 669 | 86.6 | globlastp |
| 2856 | LNU733 | cowpea\|12v1\|FF391777_P1 | 5307 | 669 | 86.6 | globlastp |
| 2857 | LNU733 | cowpea\|gb166\|FF391777 | 5307 | 669 | 86.6 | globlastp |
| 2858 | LNU733 | cryptomeria\|gb166\|BY881378_P1 | 5308 | 669 | 86.6 | globlastp |
| 2859 | LNU733 | sequoia\|10v1\|SRR065044S0161067 | 5309 | 669 | 86.6 | globlastp |
| 2860 | LNU733 | utricularia\|11v1\|SRR094438.102714_P1 | 5310 | 669 | 86.3 | globlastp |
| 2861 | LNU733 | soybean\|11v1\|GLYMA11G01620 | 5311 | 669 | 85.8 | globlastp |
| 2862 | LNU733 | cephalotaxus\|11v1\|SRR064395X110530_P1 | 5312 | 669 | 85.7 | globlastp |
| 2863 | LNU733 | euphorbia\|11v1\|DV134024_P1 | 5313 | 669 | 85.7 | globlastp |
| 2863 | LNU733 | spurge\|gb161\|DV134024 | 5313 | 669 | 85.7 | globlastp |
| 2864 | LNU733 | sequoia\|10v1\|SRR065044S0002089 | 5314 | 669 | 85.7 | globlastp |
| 2865 | LNU733 | maritime_pine\|10v1\|AL750642XX1_P1 | 5315 | 669 | 85.1 | globlastp |
| 2866 | LNU733 | pine\|10v2\|AL750642_P1 | 5316 | 669 | 85.1 | globlastp |
| 2867 | LNU733 | fern\|gb171\|DK952347_P1 | 5317 | 669 | 85 | globlastp |
| 2868 | LNU733 | marchantia\|gb166\|BJ841215_P1 | 5318 | 669 | 85 | globlastp |
| 2869 | LNU733 | bean\|12v1\|CA901348_P1 | 5319 | 669 | 85 | globlastp |
| 2870 | LNU733 | bupleurum\|11v1\|SRR301254.108445XX1_P1 | 5320 | 669 | 84.8 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 2871 | LNU733 | euphorbia\|11v1\|SRR098678X128736_P1 | 5321 | 669 | 84.8 | globlastp |
| 2872 | LNU733 | wheat\|10v2\|BJ245684 | 5322 | 669 | 84.8 | globlastp |
| 2873 | LNU733 | wheat\|12v3\|BJ245684_P1 | 5322 | 669 | 84.8 | globlastp |
| 2874 | LNU733 | utricularia\|11v1\|SRR094438.321800_P1 | 5323 | 669 | 84.6 | globlastp |
| 2875 | LNU733 | cedrus\|11v1\|SRR065007X105221_P1 | 5324 | 669 | 84.2 | globlastp |
| 2876 | LNU733 | podocarpus\|10v1\|SRR065014S0047767_P1 | 5325 | 669 | 84.2 | globlastp |
| 2877 | LNU733 | spruce\|11v1\|ES248062XX1_P1 | 5326 | 669 | 84.1 | globlastp |
| 2878 | LNU733 | abies\|11v2\|SRR098676X264553_P1 | 5327 | 669 | 84.1 | globlastp |
| 2879 | LNU733 | bean\|gb167\|CA901348 | 5328 | 669 | 84.1 | globlastp |
| 2880 | LNU733 | spruce\|11v1\|ES248062XX2_P1 | 5329 | 669 | 84.1 | globlastp |
| 2881 | LNU733 | spruce\|gb162\|CO219805 | 5329 | 669 | 84.1 | globlastp |
| 2882 | LNU733 | lettuce\|10v1\|DW087237 | 5330 | 669 | 84.07 | glotblastn |
| 2883 | LNU733 | barley\|12v1\|AK375317_P1 | 5331 | 669 | 83.9 | globlastp |
| 2884 | LNU733 | euphorbia\|11v1\|SRR098678X408289_P1 | 5332 | 669 | 83.9 | globlastp |
| 2885 | LNU733 | podocarpus\|10v1\|SRR065014S0018543_P1 | 5333 | 669 | 83.5 | globlastp |
| 2886 | LNU733 | foxtail_millet\|11v3\|PHY7SI023695M_P1 | 5334 | 669 | 83 | globlastp |
| 2887 | LNU733 | beet\|12v1\|BE590275_P1 | 5335 | 669 | 83 | globlastp |
| 2888 | LNU733 | beet\|gb162\|BE590275 | 5335 | 669 | 83 | globlastp |
| 2889 | LNU733 | foxtail_millet\|10v2\|SICRP038967 | 5334 | 669 | 83 | globlastp |
| 2890 | LNU733 | liquorice\|gb171\|FS247996_P1 | 5336 | 669 | 83 | globlastp |
| 2891 | LNU733 | marchantia\|gb166\|BJ855482_P1 | 5337 | 669 | 83 | globlastp |
| 2892 | LNU733 | physcomitrella\|10v1\|FC394355_P1 | 5338 | 669 | 82.3 | globlastp |
| 2893 | LNU733 | pteridium\|11v1\|SRR043594X137968 | 5339 | 669 | 82.3 | globlastp |
| 2894 | LNU733 | zostera\|10v1\|AM408838 | 5340 | 669 | 82.3 | globlastp |
| 2895 | LNU733 | pteridium\|11v1\|SRR043594X277919 | 5341 | 669 | 82.14 | glotblastn |
| 2896 | LNU733 | flaveria\|11v1\|SRR149232.188797_P1 | 5342 | 669 | 82.1 | globlastp |
| 2897 | LNU733 | rye\|12v1\|DRR001014.121682_P1 | 5343 | 669 | 82.1 | globlastp |
| 2898 | LNU733 | rye\|12v1\|DRR001014.173333_P1 | 5343 | 669 | 82.1 | globlastp |
| 2899 | LNU733 | ceratodon\|10v1\|SRR074890S0002441_P1 | 5344 | 669 | 81.4 | globlastp |
| 2900 | LNU733 | physcomitrella\|10v1\|BI437534_P1 | 5345 | 669 | 81.4 | globlastp |
| 2901 | LNU733 | epimedium\|11v1\|SRR013504.33606_T1 | 5346 | 669 | 81.25 | glotblastn |
| 2902 | LNU733 | distylium\|11v1\|SRR065077X152025_T1 | 5347 | 669 | 81.25 | glotblastn |
| 2903 | LNU733 | eschscholzia\|11v1\|SRR014117.52074_T1 | — | 669 | 81.25 | glotblastn |
| 2904 | LNU733 | rice\|11v1\|AU172652_P1 | 5348 | 669 | 81.2 | globlastp |
| 2905 | LNU733 | rye\|12v1\|DRR001014.142785_T1 | 5349 | 669 | 80.53 | glotblastn |
| 2906 | LNU733 | spruce\|11v1\|EX310243_P1 | 5350 | 669 | 80.5 | globlastp |
| 2907 | LNU733 | millet\|10v1\|PMSLX0020605D2_P1 | 5351 | 669 | 80.5 | globlastp |
| 2908 | LNU733 | physcomitrella\|10v1\|AW126638_P1 | 5352 | 669 | 80.5 | globlastp |
| 2909 | LNU733 | vinca\|11v1\|SRR098690X224252 | 5353 | 669 | 80.4 | globlastp |
| 2910 | LNU733 | spruce\|11v1\|ES666191_T1 | 5354 | 669 | 80.36 | glotblastn |
| 2911 | LNU734 | solanum_phureja\|09v1\|SPHBG128324 | 5355 | 670 | 97.1 | globlastp |
| 2912 | LNU734 | potato\|10v1\|BG597165_P1 | 5356 | 670 | 87.2 | globlastp |
| 2913 | LNU734 | pepper\|12v1\|BM060448_P1 | 5357 | 670 | 84.9 | globlastp |
| 2914 | LNU734 | pepper\|gb171\|BM060448 | 5357 | 670 | 84.9 | globlastp |
| 2915 | LNU735 | solanum_phureja\|09v1\|SPHBG627239 | 5358 | 671 | 88.44 | glotblastn |
| 2916 | LNU735 | solanum_phureja\|09v1\|SPHBG130581 | 5359 | 671 | 84.4 | globlastp |
| 2917 | LNU735 | potato\|10v1\|CV504658_P1 | 5360 | 671 | 80.3 | globlastp |
| 2918 | LNU736 | solanum_phureja\|09v1\|SPHBG134404 | 5361 | 672 | 98.2 | globlastp |
| 2919 | LNU736 | eggplant\|10v1\|FS012479_P1 | 5362 | 672 | 93.4 | globlastp |
| 2920 | LNU736 | petunia\|gb171\|CV296046_P1 | 5363 | 672 | 91.9 | globlastp |
| 2921 | LNU736 | gerbera\|09v1\|AJ763342_T1 | 5364 | 672 | 87.35 | glotblastn |
| 2922 | LNU736 | coffea\|10v1\|DV664968_P1 | 5365 | 672 | 86.5 | globlastp |
| 2923 | LNU736 | tomato\|10v1\|BG631590 | 5366 | 672 | 86.5 | globlastp |
| 2924 | LNU736 | tomato\|11v1\|BG631590_P1 | 5366 | 672 | 86.5 | globlastp |
| 2925 | LNU736 | eggplant\|10v1\|FS026082_P1 | 5367 | 672 | 86 | globlastp |
| 2926 | LNU736 | tabernaemontana\|11v1\|SRR098689X114796 | 5368 | 672 | 86 | globlastp |
| 2927 | LNU736 | potato\|10v1\|BG594161_P1 | 5369 | 672 | 85.9 | globlastp |
| 2928 | LNU736 | solanum_phureja\|09v1\|SPHBG631590 | 5369 | 672 | 85.9 | globlastp |
| 2929 | LNU736 | vinca\|11v1\|SRR098690X101332 | 5370 | 672 | 85.54 | glotblastn |
| 2930 | LNU736 | amsonia\|11v1\|SRR098688X10336_P1 | 5371 | 672 | 85.5 | globlastp |
| 2931 | LNU736 | catharanthus\|11v1\|SRR098691X135789XX1_P1 | 5372 | 672 | 84.9 | globlastp |
| 2932 | LNU736 | lettuce\|10v1\|DW056048 | 5373 | 672 | 84.9 | globlastp |
| 2933 | LNU736 | lettuce\|10v1\|DW095146 | 5374 | 672 | 84.9 | globlastp |
| 2934 | LNU736 | sunflower\|10v1\|CD848757 | 5375 | 672 | 84.9 | globlastp |
| 2935 | LNU736 | artemisia\|10v1\|EY100040_P1 | 5376 | 672 | 84.3 | globlastp |
| 2936 | LNU736 | cichorium\|gb171\|EH675015_P1 | 5377 | 672 | 84.3 | globlastp |
| 2937 | LNU736 | cynara\|gb167\|GE591751_P1 | 5378 | 672 | 84.3 | globlastp |
| 2938 | LNU736 | dandelion\|10v1\|DY836636_P1 | 5379 | 672 | 84.3 | globlastp |
| 2939 | LNU736 | senecio\|gb170\|DY657645 | 5377 | 672 | 84.3 | globlastp |

TABLE 2-continued

Homologues of the identified genes/polypeptides for increasing nitrogen use
efficiency, fertilizer use efficiency, yield, seed yield, growth rate, vigor, biomass, oil
content, fiber yield, fiber quality, fiber length, abiotic stress tolerance and/or water
use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 2940 | LNU736 | tragopogon\|10v1\|SRR020205S0004093 | 5377 | 672 | 84.3 | globlastp |
| 2941 | LNU736 | sesame\|12v1\|SESI12V1394443_P1 | 5380 | 672 | 83.7 | globlastp |
| 2942 | LNU736 | cynara\|gb167\|GE593080_P1 | 5381 | 672 | 83.7 | globlastp |
| 2943 | LNU736 | lettuce\|12v1\|DW056048_P1 | 5382 | 672 | 83.5 | globlastp |
| 2944 | LNU736 | parthenium\|10v1\|GW780090_P1 | 5383 | 672 | 83.5 | globlastp |
| 2945 | LNU736 | tobacco\|gb162\|EB446453 | 5384 | 672 | 83.5 | globlastp |
| 2946 | LNU736 | arnica\|11v1\|SRR099034X1156_T1 | 5385 | 672 | 83.33 | glotblastn |
| 2947 | LNU736 | centaurea\|gb166\|EH711208_T1 | 5386 | 672 | 83.23 | glotblastn |
| 2948 | LNU736 | ipomoea_nil\|10v1\|BJ554530_P1 | 5387 | 672 | 83.2 | globlastp |
| 2949 | LNU736 | ambrosia\|11v1\|SRR346935.19253_P1 | 5388 | 672 | 83.1 | globlastp |
| 2950 | LNU736 | ambrosia\|11v1\|SRR346943.109595_P1 | 5388 | 672 | 83.1 | globlastp |
| 2951 | LNU736 | cirsium\|11v1\|SRR346952.128342_P1 | 5389 | 672 | 83.1 | globlastp |
| 2952 | LNU736 | cirsium\|11v1\|SRR346952.1004635XX1_P1 | 5390 | 672 | 83 | globlastp |
| 2953 | LNU736 | centaurea\|gb166\|EH766675_P1 | 5390 | 672 | 83 | globlastp |
| 2954 | LNU736 | dandelion\|10v1\|DY832140_P1 | 5391 | 672 | 83 | globlastp |
| 2955 | LNU736 | parthenium\|10v1\|GW781075_P1 | 5392 | 672 | 83 | globlastp |
| 2956 | LNU736 | petunia\|gb171\|FN000401_P1 | 5393 | 672 | 83 | globlastp |
| 2957 | LNU736 | valeriana\|11v1\|SRR099039X11380_P1 | 5394 | 672 | 82.7 | globlastp |
| 2958 | LNU736 | bupleurum\|11v1\|SRR301254.111323_P1 | 5395 | 672 | 82.6 | globlastp |
| 2959 | LNU736 | safflower\|gb162\|EL410946 | 5396 | 672 | 82.6 | globlastp |
| 2960 | LNU736 | tea\|10v1\|GO255067 | 5397 | 672 | 82.53 | glotblastn |
| 2961 | LNU736 | flaveria\|11v1\|SRR149232.102871_P1 | 5398 | 672 | 82.5 | globlastp |
| 2962 | LNU736 | flaveria\|11v1\|SRR149232.234285XX1_P1 | 5398 | 672 | 82.5 | globlastp |
| 2963 | LNU736 | sunflower\|10v1\|DY936212 | 5399 | 672 | 82.5 | globlastp |
| 2964 | LNU736 | ambrosia\|11v1\|SRR346935.141807_P1 | 5400 | 672 | 82.4 | globlastp |
| 2965 | LNU736 | gerbera\|09v1\|AJ760828_P1 | 5401 | 672 | 82 | globlastp |
| 2966 | LNU736 | pepper\|12v1\|GD092530_P1 | 5402 | 672 | 82 | globlastp |
| 2967 | LNU736 | pepper\|gb171\|GD092530 | 5402 | 672 | 82 | globlastp |
| 2968 | LNU736 | phyla\|11v2\|SRR099035X100467XX1_P1 | 5403 | 672 | 82 | globlastp |
| 2969 | LNU736 | sarracenia\|11v1\|SRR192669.100016_T1 | 5404 | 672 | 81.93 | glotblastn |
| 2970 | LNU736 | ginseng\|10v1\|GR874523_T1 | 5405 | 672 | 81.93 | glotblastn |
| 2971 | LNU736 | cirsium\|11v1\|SRR346952.101157XX2_P1 | 5406 | 672 | 81.9 | globlastp |
| 2972 | LNU736 | flaveria\|11v1\|SRR149229.155637_P1 | 5407 | 672 | 81.9 | globlastp |
| 2973 | LNU736 | flaveria\|11v1\|SRR149229.340473_P1 | 5407 | 672 | 81.9 | globlastp |
| 2974 | LNU736 | flaveria\|11v1\|SRR149232.210743_P1 | 5408 | 672 | 81.9 | globlastp |
| 2975 | LNU736 | flaveria\|11v1\|SRR149239.40155_P1 | 5407 | 672 | 81.9 | globlastp |
| 2976 | LNU736 | lettuce\|10v1\|DW050417 | 5409 | 672 | 81.9 | globlastp |
| 2977 | LNU736 | sunflower\|12v1\|EL424334_P1 | 5410 | 672 | 81.7 | globlastp |
| 2978 | LNU736 | sunflower\|12v1\|DY936212_P1 | 5411 | 672 | 81.7 | globlastp |
| 2979 | LNU736 | centaurea\|gb166\|EH720001_P1 | 5412 | 672 | 81.6 | globlastp |
| 2980 | LNU736 | safflower\|gb162\|EL392580 | 5413 | 672 | 81.6 | globlastp |
| 2981 | LNU736 | centaurea\|gb166\|EH735252_P1 | 5414 | 672 | 81.5 | globlastp |
| 2982 | LNU736 | arnica\|11v1\|SRR099034X103604_P1 | 5415 | 672 | 81.4 | globlastp |
| 2983 | LNU736 | antirrhinum\|gb166\|AJ801615_T1 | 5416 | 672 | 81.33 | glotblastn |
| 2984 | LNU736 | phyla\|11v1\|SRR099037X125972 | 5417 | 672 | 81.3 | globlastp |
| 2985 | LNU736 | phyla\|11v2\|SRR099037X125972_P1 | 5417 | 672 | 81.3 | globlastp |
| 2986 | LNU736 | scabiosa\|11v1\|SRR063723X100110 | 5418 | 672 | 81.3 | globlastp |
| 2987 | LNU736 | sarracenia\|11v1\|SRR192669.105186_T1 | 5419 | 672 | 81.29 | glotblastn |
| 2988 | LNU736 | sunflower\|12v1\|CD848757_P1 | 5420 | 672 | 81.2 | globlastp |
| 2989 | LNU736 | sunflower\|12v1\|DY924447_P1 | 5420 | 672 | 81.2 | globlastp |
| 2990 | LNU736 | sunflower\|10v1\|DY917142 | 5421 | 672 | 81.2 | globlastp |
| 2991 | LNU736 | sunflower\|12v1\|DY917142_P1 | 5421 | 672 | 81.2 | globlastp |
| 2992 | LNU736 | phyla\|11v1\|SRR099037X145001 | 5422 | 672 | 81.1 | globlastp |
| 2993 | LNU736 | cichorium\|gb171\|EH686846_P1 | 5423 | 672 | 81 | globlastp |
| 2994 | LNU736 | tragopogon\|10v1\|SRR020205S0008461 | 5424 | 672 | 81 | globlastp |
| 2995 | LNU736 | sunflower\|12v1\|DY942269_P1 | 5425 | 672 | 80.8 | globlastp |
| 2996 | LNU736 | sunflower\|12v1\|DY951389_P1 | 5426 | 672 | 80.8 | globlastp |
| 2997 | LNU736 | sunflower\|12v1\|DY942669_P1 | 5427 | 672 | 80.7 | globlastp |
| 2998 | LNU736 | monkeyflower\|10v1\|DV209207_P1 | 5428 | 672 | 80.7 | globlastp |
| 2999 | LNU736 | utricularia\|11v1\|SRR094438.104889_T1 | 5429 | 672 | 80.47 | glotblastn |
| 3000 | LNU736 | ginseng\|10v1\|DV555145_T1 | 5430 | 672 | 80.47 | glotblastn |
| 3001 | LNU736 | orobanche\|10v1\|SRR023189S0020622_T1 | 5431 | 672 | 80.47 | glotblastn |
| 3002 | LNU736 | triphysaria\|10v1\|EY129282 | 5432 | 672 | 80.47 | glotblastn |
| 3003 | LNU736 | flaveria\|11v1\|SRR149229.309895_T1 | 5433 | 672 | 80.36 | glotblastn |
| 3004 | LNU736 | centaurea\|gb166\|EH761860_P1 | 5434 | 672 | 80.2 | globlastp |
| 3005 | LNU736 | guizotia\|10v1\|GE562555_P1 | 5435 | 672 | 80.2 | globlastp |
| 3006 | LNU736 | flaveria\|11v1\|SRR149232.127065_T1 | 5436 | 672 | 80.12 | glotblastn |
| 3007 | LNU736 | vinca\|11v1\|SRR098690X100779 | 5437 | 672 | 80.1 | globlastp |
| 3008 | LNU736 | cirsium\|11v1\|SRR346952.1001050_P1 | 5438 | 672 | 80 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to Polyp. SEQ ID NO: | % global identity | Algor. |
|---|---|---|---|---|---|---|
| 3009 | LNU738 | solanum_phureja\|09v1\|SPHBG642771 | 5439 | 673 | 97.6 | globlastp |
| 3010 | LNU738 | potato\|10v1\|BG098160_T1 | 5440 | 673 | 96.46 | glotblastn |
| 3011 | LNU738 | pepper\|12v1\|BM061794_P1 | 5441 | 673 | 92.6 | globlastp |
| 3012 | LNU738 | pepper\|gb171\|BM061794 | 5441 | 673 | 92.6 | globlastp |
| 3013 | LNU738 | solanum_phureja\|09v1\|SPHBI432156 | 5442 | 673 | 89.1 | globlastp |
| 3014 | LNU738 | tomato\|11v1\|CA514722_P1 | 5443 | 673 | 88.5 | globlastp |
| 3015 | LNU738 | tomato\|10v1\|CA514722 | 5444 | 673 | 88.2 | globlastp |
| 3016 | LNU738 | pepper\|12v1\|CA514722_P1 | 5445 | 673 | 87 | globlastp |
| 3017 | LNU738 | prunus\|10v1\|CB823519 | 5446 | 673 | 85.3 | globlastp |
| 3018 | LNU738 | chickpea\|11v1\|SRR133517.137921_T1 | 5447 | 673 | 84.75 | glotblastn |
| 3019 | LNU738 | amsonia\|11v1\|SRR098688X101566_P1 | 5448 | 673 | 84.7 | globlastp |
| 3020 | LNU738 | cacao\|10v1\|CA794447_P1 | 5449 | 673 | 84.7 | globlastp |
| 3021 | LNU738 | citrus\|gb166\|CF504494 | 5450 | 673 | 84.5 | globlastp |
| 3022 | LNU738 | grape\|11v1\|GSVIVT01037261001_P1 | 5451 | 673 | 84.5 | globlastp |
| 3023 | LNU738 | grape\|gb160\|BQ795840 | 5451 | 673 | 84.5 | globlastp |
| 3024 | LNU738 | lotus\|09v1\|LLCB826659_P1 | 5452 | 673 | 84.5 | globlastp |
| 3025 | LNU738 | orange\|11v1\|CF504494_P1 | 5453 | 673 | 84.5 | globlastp |
| 3026 | LNU738 | beech\|11v1\|SRR006294.12230_P1 | 5454 | 673 | 84.2 | globlastp |
| 3027 | LNU738 | cotton\|11v1\|ES810553_P1 | 5455 | 673 | 84.2 | globlastp |
| 3028 | LNU738 | cotton\|10v2\|DT456816 | 5455 | 673 | 84.2 | globlastp |
| 3029 | LNU738 | ambrosia\|11v1\|SRR346935.4350_P1 | 5456 | 673 | 84.1 | globlastp |
| 3030 | LNU738 | cannabis\|12v1\|JK494726_P1 | 5457 | 673 | 84.1 | globlastp |
| 3031 | LNU738 | gossypium_raimondii\|12v1\|ES817229_P1 | 5458 | 673 | 84.1 | globlastp |
| 3032 | LNU738 | cotton\|11v1\|CO089769_P1 | 5459 | 673 | 84.1 | globlastp |
| 3033 | LNU738 | catharanthus\|11v1\|SRR098691X103709_T1 | 5460 | 673 | 84.07 | glotblastn |
| 3034 | LNU738 | ambrosia\|11v1\|SRR346935.130074_P1 | 5461 | 673 | 83.9 | globlastp |
| 3035 | LNU738 | gossypium_raimondii\|12v1\|DT458430_P1 | 5462 | 673 | 83.9 | globlastp |
| 3036 | LNU738 | castorbean\|09v1\|EE254693 | 5463 | 673 | 83.9 | globlastp |
| 3037 | LNU738 | castorbean\|11v1\|EE254693_P1 | 5463 | 673 | 83.9 | globlastp |
| 3038 | LNU738 | cotton\|10v2\|BF274881 | 5462 | 673 | 83.9 | globlastp |
| 3039 | LNU738 | trigonella\|11v1\|SRR066194X101931 | 5464 | 673 | 83.9 | globlastp |
| 3040 | LNU738 | platanus\|11v1\|SRR096786X144202_T1 | 5465 | 673 | 83.86 | glotblastn |
| 3041 | LNU738 | cotton\|10v2\|CO108990 | 5466 | 673 | 83.8 | globlastp |
| 3042 | LNU738 | cotton\|11v1\|CO078105_P1 | 5467 | 673 | 83.6 | globlastp |
| 3043 | LNU738 | flaveria\|11v1\|SRR149229.131882_P1 | 5468 | 673 | 83.6 | globlastp |
| 3044 | LNU738 | gossypium_raimondii\|12v1\|AI727447_P1 | 5469 | 673 | 83.6 | globlastp |
| 3045 | LNU738 | sunflower\|12v1\|DY940306_P1 | 5470 | 673 | 83.6 | globlastp |
| 3046 | LNU738 | valeriana\|11v1\|SRR099039X100291_P1 | 5471 | 673 | 83.6 | globlastp |
| 3047 | LNU738 | apple\|11v1\|CN444610_P1 | 5472 | 673 | 83.6 | globlastp |
| 3048 | LNU738 | poplar\|10v1\|BU873525_P1 | 5473 | 673 | 83.6 | globlastp |
| 3049 | LNU738 | strawberry\|11v1\|DY671659 | 5474 | 673 | 83.6 | globlastp |
| 3050 | LNU738 | sunflower\|10v1\|AJ827773 | 5470 | 673 | 83.6 | globlastp |
| 3051 | LNU738 | ambrosia\|11v1\|SRR346935.116210_T1 | 5475 | 673 | 83.58 | glotblastn |
| 3052 | LNU738 | ambrosia\|11v1\|SRR346935.175607_T1 | 5476 | 673 | 83.58 | glotblastn |
| 3053 | LNU738 | eucalyptus\|11v2\|ES591030_P1 | 5477 | 673 | 83.5 | globlastp |
| 3054 | LNU738 | flaveria\|11v1\|SRR149232.105380_P1 | 5478 | 673 | 83.3 | globlastp |
| 3055 | LNU738 | sunflower\|12v1\|AJ827773_P1 | 5479 | 673 | 83.3 | globlastp |
| 3056 | LNU738 | cassava\|09v1\|DV444530_P1 | 5480 | 673 | 83.3 | globlastp |
| 3057 | LNU738 | cotton\|10v2\|AI727447 | 5481 | 673 | 83.3 | globlastp |
| 3058 | LNU738 | cotton\|11v1\|AI727447_P1 | 5482 | 673 | 83.3 | globlastp |
| 3059 | LNU738 | cucumber\|09v1\|AM717103_P1 | 5483 | 673 | 83.3 | globlastp |
| 3060 | LNU738 | soybean\|11v1\|GLYMA04G08510 | 5484 | 673 | 83.3 | globlastp |
| 3061 | LNU738 | chickpea\|11v1\|FE670315XX2_T1 | 5485 | 673 | 83.24 | glotblastn |
| 3062 | LNU738 | cirsium\|11v1\|SRR346952.1007905_P1 | 5486 | 673 | 83.2 | globlastp |
| 3063 | LNU738 | bean\|12v1\|CA911550_P1 | 5487 | 673 | 83.2 | globlastp |
| 3064 | LNU738 | bean\|gb167\|CA911550 | 5487 | 673 | 83.2 | globlastp |
| 3065 | LNU738 | dandelion\|10v1\|DY812485_P1 | 5488 | 673 | 83.2 | globlastp |
| 3066 | LNU738 | nasturtium\|10v1\|SRR032558S0023606 | 5489 | 673 | 83.04 | glotblastn |
| 3067 | LNU738 | medicago\|09v1\|LLAW684659 | 5490 | 673 | 83 | globlastp |
| 3068 | LNU738 | melon\|10v1\|AM717103_P1 | 5491 | 673 | 83 | globlastp |
| 3069 | LNU738 | poplar\|10v1\|BU829200_P1 | 5492 | 673 | 83 | globlastp |
| 3070 | LNU738 | soybean\|11v1\|GLYMA14G21190 | 5493 | 673 | 83 | globlastp |
| 3071 | LNU738 | trigonella\|11v1\|SRR066194X11085 | 5494 | 673 | 82.99 | glotblastn |
| 3072 | LNU738 | cirsium\|11v1\|SRR346952.1006103_P1 | 5495 | 673 | 82.9 | globlastp |
| 3073 | LNU738 | orobanche\|10v1\|SRR023189S0009621_P1 | 5496 | 673 | 82.9 | globlastp |
| 3074 | LNU738 | phyla\|11v1\|SRR099035X105505 | 5497 | 673 | 82.9 | globlastp |
| 3075 | LNU738 | phyla\|11v2\|SRR0P99035X105505_P1 | 5497 | 673 | 82.9 | globlastp |
| 3076 | LNU738 | primula\|11v1\|SRR098679X115440_P1 | 5498 | 673 | 82.9 | globlastp |
| 3077 | LNU738 | vinca\|11v1\|SRR098690X10208 | 5499 | 673 | 82.89 | glotblastn |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 3078 | LNU738 | flaveria\|11v1\|SRR149232.305364_P1 | 5500 | 673 | 82.7 | globlastp |
| 3079 | LNU738 | flaveria\|11v1\|SRR149232.75632_T1 | 5501 | 673 | 82.7 | glotblastn |
| 3080 | LNU738 | lettuce\|12v1\|DW047264_P1 | 5502 | 673 | 82.7 | globlastp |
| 3081 | LNU738 | watermelon\|11v1\|AM717103_P1 | 5503 | 673 | 82.7 | globlastp |
| 3082 | LNU738 | soybean\|11v1\|GLYMA06G08620 | 5504 | 673 | 82.7 | globlastp |
| 3083 | LNU738 | cirsium\|11v1\|SRR346952.115755_P1 | 5505 | 673 | 82.6 | globlastp |
| 3084 | LNU738 | pigeonpea\|11v1\|SRR054580X10205_P1 | 5506 | 673 | 82.6 | globlastp |
| 3085 | LNU738 | cephalotaxus\|11v1\|SRR064395X100674_T1 | 5507 | 673 | 82.6 | glotblastn |
| 3086 | LNU738 | primula\|11v1\|SRR098679X124526_T1 | 5508 | 673 | 82.6 | glotblastn |
| 3087 | LNU738 | chestnut\|gb170\|SRR006295S0060720_P1 | 5509 | 673 | 82.5 | globlastp |
| 3088 | LNU738 | monkeyflower\|10v1\|DV209585_P1 | 5510 | 673 | 82.5 | globlastp |
| 3089 | LNU738 | peanut\|10v1\|ES721511_P1 | 5511 | 673 | 82.5 | globlastp |
| 3090 | LNU738 | medicago\|12v1\|AW686046_T1 | 5512 | 673 | 82.46 | glotblastn |
| 3091 | LNU738 | flaveria\|11v1\|SRR149229.196451_P1 | 5513 | 673 | 82.4 | globlastp |
| 3092 | LNU738 | cassava\|09v1\|DV448148_P1 | 5514 | 673 | 82.4 | globlastp |
| 3093 | LNU738 | artemisia\|10v1\|EY034244_P1 | 5515 | 673 | 82.3 | globlastp |
| 3094 | LNU738 | cowpea\|12v1\|FC458328_P1 | 5516 | 673 | 82.3 | globlastp |
| 3095 | LNU738 | cowpea\|gb166\|FC458328 | 5516 | 673 | 82.3 | globlastp |
| 3096 | LNU738 | olea\|11v1\|SRR014463.19750_T1 | 5517 | 673 | 82.3 | glotblastn |
| 3097 | LNU738 | vinca\|11v1\|SRR098690X133342 | 5518 | 673 | 82.3 | glotblastn |
| 3098 | LNU738 | clementine\|11v1\|CF504494_P1 | 5519 | 673 | 82.2 | globlastp |
| 3099 | LNU738 | euonymus\|11v1\|SRR070038X105844_P1 | 5520 | 673 | 82.1 | globlastp |
| 3100 | LNU738 | centaurea\|gb166\|EH720700_T1 | 5521 | 673 | 82.01 | glotblastn |
| 3101 | LNU738 | cucurbita\|11v1\|SRR091276X100444_T1 | 5522 | 673 | 81.82 | glotblastn |
| 3102 | LNU738 | pigeonpea\|10v1\|SRR054580S0013008 | 5523 | 673 | 81.8 | globlastp |
| 3103 | LNU738 | tripterygium\|11v1\|SRR098677X100199 | 5524 | 673 | 81.8 | globlastp |
| 3104 | LNU738 | triphysaria\|10v1\|EX988682 | 5525 | 673 | 81.71 | glotblastn |
| 3105 | LNU738 | artemisia\|10v1\|EY061864_P1 | 5526 | 673 | 81.7 | globlastp |
| 3106 | LNU738 | eschscholzia\|11v1\|SRR014116.101955_P1 | 5527 | 673 | 81.6 | globlastp |
| 3107 | LNU738 | cichorium\|gb171\|DT212362_T1 | 5528 | 673 | 81.52 | glotblastn |
| 3108 | LNU738 | momordica\|10v1\|SRR071315S0002982_P1 | 5529 | 673 | 81.5 | globlastp |
| 3109 | LNU738 | ambrosia\|11v1\|SRR346935.102104_P1 | 5530 | 673 | 81.4 | globlastp |
| 3110 | LNU738 | flaveria\|11v1\|SRR149232.302100_P1 | 5531 | 673 | 81.4 | globlastp |
| 3111 | LNU738 | euphorbia\|11v1\|DV126225_P1 | 5532 | 673 | 81.4 | globlastp |
| 3112 | LNU738 | monkeyflower\|10v1\|GR139246_P1 | 5533 | 673 | 81.4 | globlastp |
| 3113 | LNU738 | plantago\|11v1\|SRR066373X100461 | 5534 | 673 | 81.4 | globlastp |
| 3114 | LNU738 | plantago\|11v2\|SRR066373X100461_P1 | 5535 | 673 | 81.4 | globlastp |
| 3115 | LNU738 | sunflower\|10v1\|CD857780 | 5536 | 673 | 81.4 | globlastp |
| 3116 | LNU738 | sunflower\|12v1\|CD857780_P1 | 5536 | 673 | 81.4 | globlastp |
| 3117 | LNU738 | tripterygium\|11v1\|SRR098677X121227 | 5537 | 673 | 81.27 | glotblastn |
| 3118 | LNU738 | tragopogon\|10v1\|SRR020205S0002342 | 5538 | 673 | 81.2 | globlastp |
| 3119 | LNU738 | maritime_pine\|10v1\|SRR073317S0018220_T1 | 5539 | 673 | 81.12 | glotblastn |
| 3120 | LNU738 | ambrosia\|11v1\|SRR346935.85083_P1 | 5540 | 673 | 81.1 | globlastp |
| 3121 | LNU738 | cirsium\|11v1\|SRR346952.102224_P1 | 5541 | 673 | 81.1 | globlastp |
| 3122 | LNU738 | flaveria\|11v1\|SRR149229.104105_P1 | 5542 | 673 | 81.1 | globlastp |
| 3123 | LNU738 | flaveria\|11v1\|SRR149229.141340_P1 | 5543 | 673 | 81.1 | globlastp |
| 3124 | LNU738 | phyla\|11v2\|SRR099035X52491_P1 | 5544 | 673 | 81.1 | globlastp |
| 3125 | LNU738 | euonymus\|11v1\|SRR070038X120250_P1 | 5545 | 673 | 81 | globlastp |
| 3126 | LNU738 | aquilegia\|10v2\|DR918976_P1 | 5546 | 673 | 80.9 | globlastp |
| 3127 | LNU738 | abies\|11v2\|SRR098676X100308_T1 | 5547 | 673 | 80.83 | glotblastn |
| 3128 | LNU738 | sciadopitys\|10v1\|OXSRR065035S0033693T1 | 5548 | 673 | 80.83 | glotblastn |
| 3129 | LNU738 | ambrosia\|11v1\|SRR346935.12730_P1 | 5549 | 673 | 80.8 | globlastp |
| 3130 | LNU738 | oak\|10v1\|DN949684_P1 | 5550 | 673 | 80.8 | globlastp |
| 3131 | LNU738 | pepper\|gb171\|CA514722 | 5551 | 673 | 80.8 | globlastp |
| 3132 | LNU738 | thellungiella_halophilum\|11v1\|DN773583_T1 | 5552 | 673 | 80.53 | glotblastn |
| 3133 | LNU738 | flaveria\|11v1\|SRR149229.105043_P1 | 5553 | 673 | 80.5 | globlastp |
| 3134 | LNU738 | arnica\|11v1\|SRR099034X102180_P1 | 5554 | 673 | 80.3 | globlastp |
| 3135 | LNU738 | b_rapa\|11v1\|CD816172_T1 | 5555 | 673 | 80.29 | glotblastn |
| 3136 | LNU738 | canola\|11v1\|EV072912_T1 | 5555 | 673 | 80.29 | glotblastn |
| 3137 | LNU738 | canola\|10v1\|CD816172 | 5556 | 673 | 80.29 | glotblastn |
| 3138 | LNU738 | chelidonium\|11v1\|SRR084752X104217XX1_T1 | 5557 | 673 | 80.29 | glotblastn |
| 3139 | LNU738 | b_rapa\|11v1\|CD813892_T1 | 5558 | 673 | 80.24 | glotblastn |
| 3140 | LNU738 | canola\|11v1\|DY006430_T1 | 5558 | 673 | 80.24 | glotblastn |
| 3141 | LNU738 | canola\|11v1\|EE401883_T1 | 5559 | 673 | 80.24 | glotblastn |
| 3142 | LNU738 | b_rapa\|gb162\|EE517664 | 5558 | 673 | 80.24 | glotblastn |
| 3143 | LNU738 | utricularia\|11v1\|SRR094438.130521_P1 | 5560 | 673 | 80.1 | globlastp |
| 3144 | LNU738 | arabidopsis_lyrata\|09v1\|BQ834053_P1 | 5561 | 673 | 80.1 | globlastp |
| 3145 | LNU738 | arabidopsis\|10v1\|AT2G03120_P1 | 5562 | 673 | 80.1 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 3146 | LNU738 | fagopyrum\|11v1\|SRR063689X108532_T1 | 5563 | 673 | 80.06 | glotblastn |
| 3147 | LNU738 | amorphophallus\|11v2\|SRR089351X102720_P1 | 5564 | 673 | 80 | globlastp |
| 3148 | LNU738 | canola\|11v1\|CN736601_P1 | 5565 | 673 | 80 | globlastp |
| 3149 | LNU738 | canola\|11v1\|EE508183_T1 | 5566 | 673 | 80 | glotblastn |
| 3150 | LNU739 | potato\|10v1\|BQ509246_P1 | 5567 | 674 | 94.5 | globlastp |
| 3151 | LNU739 | solanum_phureja\|09v1\|SPHBG643777 | 5568 | 674 | 94.1 | globlastp |
| 3152 | LNU740 | solanum_phureja\|09v1\|SPHBE342651 | 5569 | 675 | 95.8 | globlastp |
| 3153 | LNU740 | potato\|10v1\|BE342651_P1 | 5570 | 675 | 94.7 | globlastp |
| 3154 | LNU740 | pepper\|12v1\|CA519077_P1 | 5571 | 675 | 93.7 | globlastp |
| 3155 | LNU740 | pepper\|gb171\|CA519077 | 5572 | 675 | 92.63 | glotblastn |
| 3156 | LNU740 | eggplant\|10v1\|FS017651_P1 | 5573 | 675 | 92.6 | globlastp |
| 3157 | LNU740 | tobacco\|gb162\|BP135425 | 5574 | 675 | 84.2 | globlastp |
| 3158 | LNU740 | cacao\|10v1\|CU490861_P1 | 5575 | 675 | 83.2 | globlastp |
| 3159 | LNU740 | citrus\|gb166\|BQ624981 | 5576 | 675 | 83.2 | globlastp |
| 3160 | LNU740 | clementine\|11v1\|BQ624981_P1 | 5576 | 675 | 83.2 | globlastp |
| 3161 | LNU740 | orange\|11v1\|BQ624981_P1 | 5576 | 675 | 83.2 | globlastp |
| 3162 | LNU740 | phyla\|11v1\|SRR099036X30899 | 5577 | 675 | 82.5 | globlastp |
| 3163 | LNU740 | phyla\|11v2\|SRR099036X30899_P1 | 5577 | 675 | 82.5 | globlastp |
| 3164 | LNU740 | cotton\|10v2\|AW667787XX1 | 5578 | 675 | 82.29 | glotblastn |
| 3165 | LNU740 | cotton\|11v1\|BM358552_T1 | 5579 | 675 | 82.29 | glotblastn |
| 3166 | LNU740 | catharanthus\|11v1\|SRR098691X18500_T1 | 5580 | 675 | 82.11 | glotblastn |
| 3167 | LNU740 | cotton\|11v1\|DW233359_P1 | 5581 | 675 | 81.6 | globlastp |
| 3168 | LNU740 | gossypium_raimondii\|12v1\|BM358552_P1 | 5582 | 675 | 81.6 | globlastp |
| 3169 | LNU740 | peanut\|10v1\|ES711049_P1 | 5583 | 675 | 81.2 | globlastp |
| 3170 | LNU740 | sesame\|12v1\|SESI12V1377647_P1 | 5584 | 675 | 81.1 | globlastp |
| 3171 | LNU740 | amsonia\|11v1\|SRR098688X108357_P1 | 5585 | 675 | 81.1 | globlastp |
| 3172 | LNU740 | olea\|11v1\|SRR014464.25102_P1 | 5586 | 675 | 81.1 | globlastp |
| 3173 | LNU740 | vinca\|11v1\|SRR098690X152665 | 5587 | 675 | 81.05 | glotblastn |
| 3174 | LNU740 | ipomoea_nil\|10v1\|BJ563548_T1 | 5588 | 675 | 80.41 | glotblastn |
| 3175 | LNU740 | watermelon\|11v1\|AM715543_P1 | 5589 | 675 | 80.2 | globlastp |
| 3176 | LNU740 | melon\|10v1\|AM715543_P1 | 5590 | 675 | 80.2 | globlastp |
| 3177 | LNU740 | fraxinus\|11v1\|SRR058827.119463_T1 | 5591 | 675 | 80 | glotblastn |
| 3178 | LNU740 | sarracenia\|11v1\|SRR192669.190274_P1 | 5592 | 675 | 80 | globlastp |
| 3179 | LNU740 | cucumber\|09v1\|BI740239_P1 | 5593 | 675 | 80 | globlastp |
| 3180 | LNU740 | cucurbita\|11v1\|SRR091276X147187_P1 | 5594 | 675 | 80 | globlastp |
| 3181 | LNU740 | platanus\|11v1\|SRR096786X191257_T1 | 5595 | 675 | 80 | glotblastn |
| 3182 | LNU741 | potato\|10v1\|BG590592_P1 | 5596 | 676 | 98 | globlastp |
| 3183 | LNU741 | potato\|10v1\|BF154133_P1 | 5597 | 676 | 96.9 | globlastp |
| 3184 | LNU741 | solanum_phureja\|09v1\|SPHTOMRNAA | 5598 | 676 | 95.9 | globlastp |
| 3185 | LNU741 | eggplant\|10v1\|FS004973_P1 | 5599 | 676 | 89.8 | globlastp |
| 3186 | LNU741 | tobacco\|gb162\|CV016786 | 5600 | 676 | 86.7 | globlastp |
| 3187 | LNU741 | tobacco\|gb162\|CV020873 | 5601 | 676 | 85.7 | globlastp |
| 3188 | LNU741 | pepper\|12v1\|BM060885_P1 | 5602 | 676 | 84.7 | globlastp |
| 3189 | LNU741 | pepper\|gb171\|BM060885 | 5602 | 676 | 84.7 | globlastp |
| 3190 | LNU741 | pepper\|12v1\|SRR203275X1649D1_T1 | 5603 | 676 | 82.65 | glotblastn |
| 3191 | LNU742 | wheat\|10v2\|BE213529 | 5604 | 677 | 99.2 | globlastp |
| 3192 | LNU742 | pseudoroegneria\|gb167\|FF363542 | 5605 | 677 | 98.4 | globlastp |
| 3193 | LNU742 | rye\|gb164\|BE704686 | 5606 | 677 | 96.85 | glotblastn |
| 3194 | LNU742 | rye\|12v1\|BE704686_P1 | 5607 | 677 | 96.1 | globlastp |
| 3195 | LNU742 | rye\|12v1\|DRR001012.103121_P1 | 5608 | 677 | 96.1 | globlastp |
| 3196 | LNU742 | leymus\|gb166\|CD808895_P1 | 5609 | 677 | 96 | globlastp |
| 3197 | LNU742 | barley\|10v2\|BE422257 | 5610 | 677 | 95.3 | globlastp |
| 3198 | LNU742 | barley\|12v1\|BE422257_P1 | 5610 | 677 | 95.3 | globlastp |
| 3199 | LNU742 | oat\|11v1\|CN817795XX1_P1 | 5611 | 677 | 84.1 | globlastp |
| 3200 | LNU742 | lolium\|10v1\|AU246387_P1 | 5612 | 677 | 84.1 | globlastp |
| 3201 | LNU742 | oat\|10v2\|CN817795 | 5611 | 677 | 84.1 | globlastp |
| 3202 | LNU742 | wheat\|10v2\|DR734445 | 5613 | 677 | 80.95 | glotblastn |
| 3203 | LNU742 | wheat\|12v3\|DR734445_T1 | 5613 | 677 | 80.95 | glotblastn |
| 3204 | LNU742 | brachypodium\|09v1\|DV479686 | 5614 | 677 | 80.8 | globlastp |
| 3205 | LNU742 | brachypodium\|12v1\|BRADI2G11550_P1 | 5614 | 677 | 80.8 | globlastp |
| 3206 | LNU744 | wheat\|12v3\|BM136620_P1 | 5615 | 678 | 98.8 | globlastp |
| 3207 | LNU744 | wheat\|10v2\|BE445251 | 5616 | 678 | 98.6 | globlastp |
| 3208 | LNU744 | wheat\|12v3\|BE445251_P1 | 5616 | 678 | 98.6 | globlastp |
| 3209 | LNU744 | rye\|12v1\|DRR001012.106698_P1 | 5617 | 678 | 98.2 | globlastp |
| 3210 | LNU744 | rye\|12v1\|DRR001013.108359_P1 | 5618 | 678 | 98 | globlastp |
| 3211 | LNU744 | wheat\|12v3\|BE429732_P1 | 5619 | 678 | 98 | globlastp |
| 3212 | LNU744 | barley\|12v1\|BJ448972_P1 | 5620 | 678 | 97.1 | globlastp |
| 3213 | LNU744 | barley\|10v2\|BJ448972 | 5621 | 678 | 96.9 | globlastp |
| 3214 | LNU744 | rye\|12v1\|DRR001012.279754_T1 | 5622 | 678 | 96.53 | glotblastn |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 3215 | LNU744 | leymus\|gb166\|EG382163_P1 | 5623 | 678 | 96.3 | globlastp |
| 3216 | LNU744 | oat\|11v1\|GR316272_P1 | 5624 | 678 | 93.9 | globlastp |
| 3217 | LNU744 | oat\|10v2\|GR316272 | 5624 | 678 | 93.9 | globlastp |
| 3218 | LNU744 | rye\|12v1\|DRR001012.257096_P1 | 5625 | 678 | 91.4 | globlastp |
| 3219 | LNU744 | brachypodium\|09v1\|DV472732 | 5626 | 678 | 88.7 | globlastp |
| 3220 | LNU744 | brachypodium\|12v1\|BRADI5G25730_P1 | 5626 | 678 | 88.7 | globlastp |
| 3221 | LNU744 | rice\|11v1\|BI805791_P1 | 5627 | 678 | 84.7 | globlastp |
| 3222 | LNU744 | rice\|gb170\|OS04G57550 | 5627 | 678 | 84.7 | globlastp |
| 3223 | LNU744 | sorghum\|09v1\|SB06G032450 | 5628 | 678 | 84.5 | globlastp |
| 3224 | LNU744 | sorghum\|12v1\|SB06G032450_P1 | 5628 | 678 | 84.5 | globlastp |
| 3225 | LNU744 | sugarcane\|10v1\|BQ534173 | 5629 | 678 | 84.5 | globlastp |
| 3226 | LNU744 | switchgrass\|gb167\|FL701670 | 5630 | 678 | 84.3 | globlastp |
| 3227 | LNU744 | foxtail_millet\|11v3\|PHY7SI021886M_P1 | 5631 | 678 | 84.1 | globlastp |
| 3228 | LNU744 | millet\|10v1\|EVO454PM005587_P1 | 5632 | 678 | 83.9 | globlastp |
| 3229 | LNU744 | foxtail_millet\|10v2\|OXFXTSLX00035954D1T1 | 5633 | 678 | 83.7 | globlastp |
| 3230 | LNU744 | maize\|10v1\|AI491493_P1 | 5634 | 678 | 83.5 | globlastp |
| 3231 | LNU744 | cenchrus\|gb166\|EB654410_P1 | 5635 | 678 | 83.1 | globlastp |
| 3232 | LNU745 | rye\|12v1\|DRR001012.100796_P1 | 5636 | 679 | 97.5 | globlastp |
| 3233 | LNU745 | barley\|12v1\|BQ469491_P1 | 5637 | 679 | 96.8 | globlastp |
| 3234 | LNU745 | rice\|11v1\|CA766710_P1 | 5638 | 679 | 82.7 | globlastp |
| 3235 | LNU745 | rice\|gb170\|OS11G06440 | 5638 | 679 | 82.7 | globlastp |
| 3236 | LNU747 | rye\|12v1\|DRR001012.211989_P1 | 5639 | 681 | 98.8 | globlastp |
| 3237 | LNU747 | pseudoroegneria\|gb167\|FF349003 | 5640 | 681 | 98.2 | globlastp |
| 3238 | LNU747 | barley\|10v2\|BI958101 | 5641 | 681 | 95.3 | globlastp |
| 3239 | LNU747 | barley\|12v1\|BI958101_P1 | 5641 | 681 | 95.3 | globlastp |
| 3240 | LNU748 | wheat\|10v2\|BE497353 | 5642 | 682 | 97.9 | globlastp |
| 3241 | LNU748 | wheat\|12v3\|BE497353_P1 | 5642 | 682 | 97.9 | globlastp |
| 3242 | LNU527 | radish\|gb164\|EV544434 | 5643 | 684 | 84.5 | globlastp |
| 3243 | LNU546 | wheat\|12v3\|SRR400820X1001389D1_T1 | 5644 | 686 | 88.92 | glotblastn |
| 3244 | LNU546 | wheat\|12v3\|SRR073322X3089D1_T1 | 5645 | 686 | 88.92 | glotblastn |
| 3245 | LNU546 | wheat\|12v3\|SRR400820X1015539D1_T1 | 5646 | 686 | 88.13 | glotblastn |
| 3246 | LNU546 | rye\|12v1\|DRR001012.203453_T1 | 5647 | 686 | 87.97 | glotblastn |
| 3247 | LNU546 | wheat\|12v3\|CA722948_T1 | 5648 | 686 | 87.97 | glotblastn |
| 3248 | LNU546 | wheat\|10v2\|CA501776 | 5649 | 686 | 83.7 | globlastp |
| 3249 | LNU546 | wheat\|12v3\|SRR073321X114920D1_T1 | 5650 | 686 | 82.91 | glotblastn |
| 3250 | LNU561 | rye\|12v1\|DRR001012.273932_P1 | 5651 | 687 | 90.8 | globlastp |
| 3251 | LNU561 | rye\|12v1\|DRR001012.15024_T1 | 5652 | 687 | 87.71 | glotblastn |
| 3252 | LNU578 | wheat\|12v3\|CJ608347_T1 | 5653 | 690 | 92.39 | glotblastn |
| 3253 | LNU578 | wheat\|10v2\|CJ608347 | 5654 | 690 | 91.85 | glotblastn |
| 3254 | LNU578 | wheat\|12v3\|CA650627_T1 | 5655 | 690 | 89.67 | glotblastn |
| 3255 | LNU578 | wheat\|10v2\|CK212688XX1 | 5656 | 690 | 88.59 | glotblastn |
| 3256 | LNU578 | leymus\|gb166\|EG382386_T1 | 5657 | 690 | 86.96 | glotblastn |
| 3257 | LNU578 | wheat\|12v3\|ERR125562X21086D1_T1 | 5658 | 690 | 84.24 | glotblastn |
| 3258 | LNU578 | wheat\|12v3\|SRR400820X25379D1_P1 | 5659 | 690 | 83.7 | globlastp |
| 3259 | LNU578 | wheat\|10v2\|CD930657 | 5660 | 690 | 80.98 | glotblastn |
| 3260 | LNU588 | maize\|10v1\|AI622141_T1 | 5661 | 692 | 82.41 | glotblastn |
| 3261 | LNU601 | sorghum\|12v1\|SB04G012650_T1 | 5662 | 693 | 85.3 | glotblastn |
| 3262 | LNU601 | sorghum\|09v1\|SB04G012650 | 5663 | 693 | 84.4 | globlastp |
| 3263 | LNU618 | sugarcane\|10v1\|CA076655 | 5664 | 695 | 92.54 | glotblastn |
| 3264 | LNU618 | switchgrass\|gb167\|FL705901 | 5665 | 695 | 89.15 | glotblastn |
| 3265 | LNU618 | brachypodium\|12v1\|BRADI1G14940_P1 | 5666 | 695 | 86.1 | globlastp |
| 3266 | LNU618 | oat\|10v2\|GO597658 | 5667 | 695 | 83.84 | glotblastn |
| 3267 | LNU618 | sugarcane\|10v1\|CA070698 | 5668 | 695 | 80.33 | glotblastn |
| 3268 | LNU654 | sugarcane\|10v1\|CA066320 | 5669 | 697 | 83.23 | glotblastn |
| 3269 | LNU659 | sugarcane\|10v1\|CA080093 | 5670 | 698 | 94.6 | globlastp |
| 3270 | LNU659 | maize\|10v1\|AI691561_P1 | 5671 | 698 | 92.9 | globlastp |
| 3271 | LNU659 | foxtail_millet\|11v3\|PHY7SI031319M_P1 | 5672 | 698 | 86.8 | globlastp |
| 3272 | LNU659 | foxtail_millet\|10v2\|SICRP037760 | 5672 | 698 | 86.8 | globlastp |
| 3273 | LNU672 | maize\|10v1\|AW061677_P1 | 5673 | 699 | 86.7 | globlastp |
| 3274 | LNU693 | maize\|10v1\|DV513105_P1 | 5674 | 701 | 81.4 | globlastp |
| 3275 | LNU746 | rye\|12v1\|DRR001012.128800_P1 | 5675 | 702 | 98.6 | globlastp |
| 3276 | LNU746 | barley\|12v1\|BU983807_P1 | 5676 | 702 | 98.2 | globlastp |
| 3277 | LNU746 | oat\|11v1\|GO582834_P1 | 5677 | 702 | 91.9 | globlastp |
| 3278 | LNU746 | oat\|10v2\|GO582834 | 5677 | 702 | 91.9 | globlastp |
| 3279 | LNU746 | foxtail_millet\|11v3\|EC613191_P1 | 5678 | 702 | 88.3 | globlastp |
| 3280 | LNU746 | maize\|10v1\|CA402477_P1 | 5679 | 702 | 85.6 | globlastp |
| 3281 | LNU746 | sorghum\|09v1\|SB06G033160 | 5680 | 702 | 85.6 | globlastp |
| 3282 | LNU746 | sorghum\|12v1\|SB06G033160_P1 | 5681 | 702 | 85.4 | globlastp |
| 3283 | LNU746 | millet\|10v1\|EVO454PM009610_P1 | 5682 | 702 | 84.6 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 3284 | LNU748 | barley\|10v2\|BE437722 | 5683 | 703 | 97.4 | globlastp |
| 3285 | LNU748 | wheat\|12v3\|AL821983_P1 | 5684 | 703 | 91 | globlastp |
| 3286 | LNU748 | oak\|10v1\|FP046076_T1 | 5685 | 703 | 84.73 | glotblastn |
| 3287 | LNU748 | amorphophallus\|11v2\|SRR089351X140331_T1 | 5686 | 703 | 84.55 | glotblastn |
| 3288 | LNU748 | poppy\|11v1\|SRR030259.101974_T1 | 5687 | 703 | 84.52 | glotblastn |
| 3289 | LNU748 | apple\|11v1\|CN864834_T1 | 5688 | 703 | 84.52 | glotblastn |
| 3290 | LNU748 | castorbean\|09v1\|EG665200 | 5689 | 703 | 84.35 | glotblastn |
| 3291 | LNU748 | castorbean\|11v1\|EG665200_T1 | 5689 | 703 | 84.35 | glotblastn |
| 3292 | LNU748 | wheat\|12v3\|SRR043323X31045D1_P1 | 5690 | 703 | 84.3 | globlastp |
| 3293 | LNU748 | prunus\|10v1\|BU041671 | 5691 | 703 | 83.91 | glotblastn |
| 3294 | LNU748 | cacao\|10v1\|CU584556_T1 | 5692 | 703 | 83.81 | glotblastn |
| 3295 | LNU748 | cotton\|11v1\|AI728479_T1 | 5693 | 703 | 83.74 | glotblastn |
| 3296 | LNU748 | gossypium_raimondii\|12v1\|AI054785_T1 | 5694 | 703 | 83.74 | glotblastn |
| 3297 | LNU748 | cannabis\|12v1\|JK494099_T1 | 5695 | 703 | 83.71 | glotblastn |
| 3298 | LNU748 | cassava\|09v1\|DR083944_T1 | 5696 | 703 | 83.71 | glotblastn |
| 3299 | LNU748 | monkeyflower\|10v1\|DV212519_T1 | 5697 | 703 | 83.71 | glotblastn |
| 3300 | LNU748 | apple\|11v1\|CN579503_T1 | 5698 | 703 | 83.5 | glotblastn |
| 3301 | LNU748 | aquilegia\|10v2\|DR916235_T1 | 5699 | 703 | 83.5 | glotblastn |
| 3302 | LNU748 | grape\|11v1\|GSVIVT01007278001_T1 | 5700 | 703 | 83.4 | glotblastn |
| 3303 | LNU748 | aquilegia\|10v2\|DR919321_T1 | 5701 | 703 | 83.4 | glotblastn |
| 3304 | LNU748 | cotton\|10v2\|AI054785 | 5702 | 703 | 83.33 | glotblastn |
| 3305 | LNU748 | beech\|11v1\|SRR006293.17667_T1 | 5703 | 703 | 83.3 | glotblastn |
| 3306 | LNU748 | poppy\|11v1\|SRR030263.241945_P1 | 5704 | 703 | 83.3 | globlastp |
| 3307 | LNU748 | watermelon\|11v1\|CK760349_T1 | 5705 | 703 | 83.3 | glotblastn |
| 3308 | LNU748 | cotton\|11v1\|AI054785_T1 | 5706 | 703 | 83.3 | glotblastn |
| 3309 | LNU748 | soybean\|11v1\|GLYMA07G30440 | 5707 | 703 | 83.3 | glotblastn |
| 3310 | LNU748 | tobacco\|gb162\|AF316320 | 5708 | 703 | 83.3 | glotblastn |
| 3311 | LNU748 | vinca\|11v1\|SRR098690X120640 | 5709 | 703 | 83.3 | glotblastn |
| 3312 | LNU748 | eschscholzia\|11v1\|SRR014116.100729_T1 | 5710 | 703 | 83.27 | glotblastn |
| 3313 | LNU748 | chelidonium\|11v1\|SRR084752X112624_T1 | 5711 | 703 | 83.2 | glotblastn |
| 3314 | LNU748 | strawberry\|11v1\|CO379096 | 5712 | 703 | 83.16 | glotblastn |
| 3315 | LNU748 | cacao\|10v1\|CF974442_T1 | 5713 | 703 | 83.13 | glotblastn |
| 3316 | LNU748 | potato\|10v1\|BF153244_T1 | 5714 | 703 | 83.1 | glotblastn |
| 3317 | LNU748 | solanum_phureja\|09v1\|SPHBG123494 | 5715 | 703 | 83.1 | glotblastn |
| 3318 | LNU748 | tomato\|10v1\|BG123494 | 5716 | 703 | 82.96 | glotblastn |
| 3319 | LNU748 | pigeonpea\|11v1\|SRR054581X5032_T1 | 5717 | 703 | 82.89 | glotblastn |
| 3320 | LNU748 | amsonia\|11v1\|SRR098688X125185_T1 | 5718 | 703 | 82.89 | glotblastn |
| 3321 | LNU748 | aquilegia\|10v2\|DR920358_T1 | 5719 | 703 | 82.89 | glotblastn |
| 3322 | LNU748 | cucumber\|09v1\|CK760349_T1 | 5720 | 703 | 82.89 | glotblastn |
| 3323 | LNU748 | eschscholzia\|11v1\|CK750088_T1 | 5721 | 703 | 82.86 | glotblastn |
| 3324 | LNU748 | cannabis\|12v1\|SOLX00007646_T1 | 5722 | 703 | 82.83 | glotblastn |
| 3325 | LNU748 | grape\|11v1\|GSVIVT01006926001_T1 | 5723 | 703 | 82.79 | glotblastn |
| 3326 | LNU748 | tomato\|11v1\|BG123494_T1 | 5724 | 703 | 82.76 | glotblastn |
| 3327 | LNU748 | cassava\|09v1\|DB922043_T1 | 5725 | 703 | 82.7 | glotblastn |
| 3328 | LNU748 | cacao\|10v1\|CU473342_T1 | 5726 | 703 | 82.59 | glotblastn |
| 3329 | LNU748 | amborella\|12v3\|FD429133_T1 | 5727 | 703 | 82.56 | glotblastn |
| 3330 | LNU748 | euphorbia\|11v1\|DV129972_T1 | 5728 | 703 | 82.52 | glotblastn |
| 3331 | LNU748 | chelidonium\|11v1\|SRR084752X101962_P1 | 5729 | 703 | 82.4 | globlastp |
| 3332 | LNU748 | soybean\|11v1\|GLYMA08G06810 | 5730 | 703 | 82.35 | glotblastn |
| 3333 | LNU748 | grape\|11v1\|GSVIVT01036971001_T1 | 5731 | 703 | 82.35 | glotblastn |
| 3334 | LNU748 | pepper\|12v1\|CA514031_T1 | 5732 | 703 | 82.32 | glotblastn |
| 3335 | LNU748 | bean\|12v1\|FG230324_T1 | 5733 | 703 | 82.28 | glotblastn |
| 3336 | LNU748 | cotton\|10v2\|CO124090 | 5734 | 703 | 82.28 | glotblastn |
| 3337 | LNU748 | banana\|12v1\|FF560760_T1 | 5735 | 703 | 82.27 | glotblastn |
| 3338 | LNU748 | grape\|gb160\|CB978671 | 5736 | 703 | 82.24 | glotblastn |
| 3339 | LNU748 | grape\|gb160\|CB340165 | 5737 | 703 | 82.15 | glotblastn |
| 3340 | LNU748 | gossypium_raimondii\|12v1\|DT561204_T1 | 5738 | 703 | 82.08 | glotblastn |
| 3341 | LNU748 | orange\|11v1\|CF419782_T1 | 5739 | 703 | 82.08 | glotblastn |
| 3342 | LNU748 | poplar\|10v1\|DB885410_T1 | 5740 | 703 | 82.08 | glotblastn |
| 3343 | LNU748 | watermelon\|11v1\|DV633916_T1 | 5741 | 703 | 82.06 | glotblastn |
| 3344 | LNU748 | grape\|11v1\|GSVIVT01009287001_T1 | 5742 | 703 | 82.04 | glotblastn |
| 3345 | LNU748 | castorbean\|09v1\|T15019 | 5743 | 703 | 81.95 | glotblastn |
| 3346 | LNU748 | castorbean\|11v1\|T15019_T1 | 5743 | 703 | 81.95 | glotblastn |
| 3347 | LNU748 | pigeonpea\|11v1\|GW350102_T1 | 5744 | 703 | 81.87 | glotblastn |
| 3348 | LNU748 | eucalyptus\|11v2\|CT980290_T1 | 5745 | 703 | 81.84 | glotblastn |
| 3349 | LNU748 | poplar\|10v1\|BI122045_T1 | 5746 | 703 | 81.82 | glotblastn |
| 3350 | LNU748 | cotton\|10v2\|DW480444 | 5747 | 703 | 81.78 | glotblastn |
| 3351 | LNU748 | cotton\|11v1\|DR461674_T1 | 5748 | 703 | 81.78 | glotblastn |
| 3352 | LNU748 | onion\|12v1\|CF435713_T1 | 5749 | 703 | 81.76 | glotblastn |

TABLE 2-continued

Homologues of the identified genes/polypeptides for increasing nitrogen use
efficiency, fertilizer use efficiency, yield, seed yield, growth rate, vigor, biomass, oil
content, fiber yield, fiber quality, fiber length, abiotic stress tolerance and/or water
use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 3353 | LNU748 | oak\|10v1\|FN737658_T1 | 5750 | 703 | 81.76 | glotblastn |
| 3354 | LNU748 | pepper\|gb171\|CA514031 | 5751 | 703 | 81.71 | glotblastn |
| 3355 | LNU748 | citrus\|gb166\|CF419782 | 5752 | 703 | 81.67 | glotblastn |
| 3356 | LNU748 | clementine\|11v1\|CF419782_T1 | 5752 | 703 | 81.67 | glotblastn |
| 3357 | LNU748 | eucalyptus\|11v2\|DRR000893X1177843_T1 | 5753 | 703 | 81.67 | glotblastn |
| 3358 | LNU748 | soybean\|11v1\|GLYMA14G10290 | 5754 | 703 | 81.67 | glotblastn |
| 3359 | LNU748 | cucumber\|09v1\|DV633916_T1 | 5755 | 703 | 81.62 | glotblastn |
| 3360 | LNU748 | banana\|12v1\|FF558401_P1 | 5756 | 703 | 81.6 | globlastp |
| 3361 | LNU748 | blueberry\|12v1\|SRR353282X46033D1_T1 | 5757 | 703 | 81.58 | glotblastn |
| 3362 | LNU748 | gossypium_raimondii\|12v1\|DR461674_T1 | 5758 | 703 | 81.58 | glotblastn |
| 3363 | LNU748 | cotton\|10v2\|CO130208 | 5759 | 703 | 81.58 | glotblastn |
| 3364 | LNU748 | monkeyflower\|10v1\|CV515070_T1 | 5760 | 703 | 81.58 | glotblastn |
| 3365 | LNU748 | trigonella\|11v1\|SRR066194X111207 | 5761 | 703 | 81.58 | glotblastn |
| 3366 | LNU748 | cotton\|11v1\|CO124090_T1 | 5762 | 703 | 81.56 | glotblastn |
| 3367 | LNU748 | nasturtium\|10v1\|SRR032558S0068953 | 5763 | 703 | 81.49 | glotblastn |
| 3368 | LNU748 | nasturtium\|11v1\|SRR032558.136529_T1 | 5763 | 703 | 81.49 | glotblastn |
| 3369 | LNU748 | cannabis\|12v1\|SOLX00064756_T1 | 5764 | 703 | 81.47 | glotblastn |
| 3370 | LNU748 | gossypium_raimondii\|12v1\|GRV1CRP094305_T1 | 5765 | 703 | 81.47 | glotblastn |
| 3371 | LNU748 | tabernaemontana\|11v1\|SRR098689X104399 | 5766 | 703 | 81.47 | glotblastn |
| 3372 | LNU748 | phalaenopsis\|11v1\|CB031755_T1 | 5767 | 703 | 81.45 | glotblastn |
| 3373 | LNU748 | phalaenopsis\|11v1\|CB032710XX1_T1 | 5767 | 703 | 81.45 | glotblastn |
| 3374 | LNU748 | gossypium_raimondii\|12v1\|DT456071_T1 | 5768 | 703 | 81.38 | glotblastn |
| 3375 | LNU748 | cotton\|11v1\|CO130208_T1 | 5769 | 703 | 81.38 | glotblastn |
| 3376 | LNU748 | medicago\|09v1\|AW257219 | 5770 | 703 | 81.38 | glotblastn |
| 3377 | LNU748 | medicago\|12v1\|AW257425_T1 | 5770 | 703 | 81.38 | glotblastn |
| 3378 | LNU748 | amsonia\|11v1\|SRR098688X10208_T1 | 5771 | 703 | 81.33 | glotblastn |
| 3379 | LNU748 | cassava\|09v1\|DV458081_T1 | 5772 | 703 | 81.26 | glotblastn |
| 3380 | LNU748 | pigeonpea\|11v1\|SRR054580X17132_T1 | 5773 | 703 | 81.26 | glotblastn |
| 3381 | LNU748 | melon\|10v1\|DV633916_T1 | 5774 | 703 | 81.25 | glotblastn |
| 3382 | LNU748 | poppy\|11v1\|SRR030259.108730_T1 | 5775 | 703 | 81.21 | glotblastn |
| 3383 | LNU748 | sesame\|12v1\|SESI12V1410369_T1 | 5776 | 703 | 81.21 | glotblastn |
| 3384 | LNU748 | cotton\|11v1\|DT456071_T1 | 5777 | 703 | 81.17 | glotblastn |
| 3385 | LNU748 | lotus\|09v1\|AW719373_T1 | 5778 | 703 | 81.14 | glotblastn |
| 3386 | LNU748 | cotton\|11v1\|DR456436_P1 | 5779 | 703 | 81.1 | globlastp |
| 3387 | LNU748 | cassava\|09v1\|DB923009_T1 | 5780 | 703 | 81.06 | glotblastn |
| 3388 | LNU748 | medicago\|12v1\|AL372329_T1 | 5781 | 703 | 81.06 | glotblastn |
| 3389 | LNU748 | ginseng\|10v1\|AB003516_T1 | 5782 | 703 | 80.97 | glotblastn |
| 3390 | LNU748 | strawberry\|11v1\|EX658741 | 5783 | 703 | 80.97 | glotblastn |
| 3391 | LNU748 | bean\|12v1\|CA916052_T1 | 5784 | 703 | 80.86 | glotblastn |
| 3392 | LNU748 | euonymus\|11v1\|SRR070038X129889_T1 | 5785 | 703 | 80.86 | glotblastn |
| 3393 | LNU748 | tabernaemontana\|11v1\|SRR098689X100511 | 5786 | 703 | 80.86 | glotblastn |
| 3394 | LNU748 | ginseng\|10v1\|CN847080_T1 | 5787 | 703 | 80.69 | glotblastn |
| 3395 | LNU748 | spurge\|gb161\|DV119874 | 5788 | 703 | 80.69 | glotblastn |
| 3396 | LNU748 | sarracenia\|11v1\|SRR192669.133403_T1 | 5789 | 703 | 80.65 | glotblastn |
| 3397 | LNU748 | amsonia\|11v1\|SRR098688X10146_T1 | 5790 | 703 | 80.65 | glotblastn |
| 3398 | LNU748 | aristolochia\|10v1\|FD760115_T1 | 5791 | 703 | 80.65 | glotblastn |
| 3399 | LNU748 | trigonella\|11v1\|SRR066198X1140063 | 5792 | 703 | 80.65 | glotblastn |
| 3400 | LNU748 | catharanthus\|11v1\|FD661000_T1 | 5793 | 703 | 80.45 | glotblastn |
| 3401 | LNU748 | coffea\|10v1\|DV674899_T1 | 5794 | 703 | 80.45 | glotblastn |
| 3402 | LNU748 | medicago\|09v1\|AA660711 | 5795 | 703 | 80.43 | glotblastn |
| 3403 | LNU748 | medicago\|12v1\|AA660711_T1 | 5795 | 703 | 80.43 | glotblastn |
| 3404 | LNU748 | apple\|11v1\|CN896118_T1 | 5796 | 703 | 80.28 | glotblastn |
| 3405 | LNU748 | soybean\|11v1\|GLYMA06G05200 | 5797 | 703 | 80.24 | glotblastn |
| 3406 | LNU748 | triphysaria\|10v1\|EX991063 | 5798 | 703 | 80.24 | glotblastn |
| 3407 | LNU748 | pigeonpea\|10v1\|SRR054580S0017133 | 5799 | 703 | 80.2 | globlastp |
| 3408 | LNU748 | soybean\|11v1\|GLYMA0041S00260 | 5800 | 703 | 80.12 | glotblastn |
| 3409 | LNU748 | flaveria\|11v1\|SRR149232.389083XX1_T1 | 5801 | 703 | 80.08 | glotblastn |
| 3410 | LNU748 | canola\|10v1\|CD827836 | 5802 | 703 | 80.08 | glotblastn |
| 3411 | LNU748 | bean\|12v1\|CA899411_T1 | 5803 | 703 | 80.04 | glotblastn |
| 3412 | LNU748 | bean\|gb167\|BQ481622 | 5803 | 703 | 80.04 | glotblastn |
| 3413 | LNU748 | eucalyptus\|11v2\|CD669284_T1 | 5804 | 703 | 80.04 | glotblastn |
| 3414 | LNU748 | plantago\|11v1\|SRR066373X154528 | 5805 | 703 | 80.04 | glotblastn |
| 3415 | LNU748 | zostera\|10v1\|SRR057351S0003492 | 5806 | 703 | 80.04 | glotblastn |
| 3416 | LNU748 | euphorbia\|11v1\|AB253602_T1 | 5807 | 703 | 80 | glotblastn |
| 3417 | LNU526 | arabidopsis_lyrata\|09v1\|JGIAL030560_P1 | 5808 | 704 | 96.7 | globlastp |
| 3418 | LNU526 | thellungiella_halophilum\|11v1\|BY835088_P1 | 5809 | 704 | 90.4 | globlastp |
| 3419 | LNU526 | b_rapa\|11v1\|EG020633_P1 | 5810 | 704 | 88.5 | globlastp |
| 3420 | LNU526 | canola\|11v1\|EE445027_P1 | 5811 | 704 | 88.5 | globlastp |
| 3421 | LNU526 | canola\|10v1\|EG020633 | 5812 | 704 | 88.5 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 3422 | LNU526 | radish\|gb164\|EX763106 | 5813 | 704 | 87.71 | glotblastn |
| 3423 | LNU533 | barley\|12v1\|BI959564_P1 | 5814 | 705 | 91.5 | globlastp |
| 3424 | LNU533 | wheat\|12v3\|BG262497_T1 | 5815 | 705 | 80.97 | glotblastn |
| 3425 | LNU543 | rye\|12v1\|DRR001012.141393_P1 | 5816 | 706 | 88 | globlastp |
| 3426 | LNU545 | rye\|12v1\|DRR001013.134174_P1 | 5817 | 707 | 93.6 | globlastp |
| 3427 | LNU545 | wheat\|12v3\|CA728503_P1 | 5818 | 707 | 92.6 | globlastp |
| 3428 | LNU545 | wheat\|10v2\|CA706114 | 5819 | 707 | 92 | globlastp |
| 3429 | LNU545 | rye\|12v1\|DRR001012.102132_P1 | 5820 | 707 | 89.3 | globlastp |
| 3430 | LNU545 | rye\|12v1\|DRR001012.112205_P1 | 5821 | 707 | 87.4 | globlastp |
| 3431 | LNU553 | brachypodium\|09v1\|DV473467 | 5822 | 709 | 90.1 | globlastp |
| 3432 | LNU553 | brachypodium\|12v1\|BRADI2G57250_P1 | 5822 | 709 | 90.1 | globlastp |
| 3433 | LNU553 | rice\|11v1\|BI807443_P1 | 5823 | 709 | 86.4 | globlastp |
| 3434 | LNU553 | rice\|gb170\|OS01G66350 | 5823 | 709 | 86.4 | globlastp |
| 3435 | LNU553 | maize\|10v1\|AI615088_P1 | 5824 | 709 | 84.6 | globlastp |
| 3436 | LNU553 | foxtail_millet\|11v3\|PHY7SI000532M_P1 | 5825 | 709 | 84.3 | globlastp |
| 3437 | LNU553 | sorghum\|09v1\|SB03G042150 | 5826 | 709 | 83.56 | glotblastn |
| 3438 | LNU553 | sorghum\|12v1\|SB03G042150_P1 | 5827 | 709 | 81.2 | globlastp |
| 3439 | LNU553 | millet\|10v1\|EVO454PM003639_P1 | 5828 | 709 | 80.1 | globlastp |
| 3440 | LNU556 | switchgrass\|gb167\|DN142971 | 5829 | 710 | 83.8 | globlastp |
| 3441 | LNU556 | brachypodium\|09v1\|GT773644 | 5830 | 710 | 82.3 | globlastp |
| 3442 | LNU556 | brachypodium\|12v1\|BRADI1G47210_P1 | 5830 | 710 | 82.3 | globlastp |
| 3443 | LNU556 | brachypodium\|09v1\|GT764119 | 5831 | 710 | 81.6 | globlastp |
| 3444 | LNU556 | brachypodium\|12v1\|BRADI1G47250_P1 | 5831 | 710 | 81.6 | globlastp |
| 3445 | LNU556 | switchgrass\|gb167\|FE639530 | 5832 | 710 | 81.4 | globlastp |
| 3446 | LNU556 | rice\|11v1\|BM038529_P1 | 5833 | 710 | 80.5 | globlastp |
| 3447 | LNU557 | wheat\|10v2\|CA705720 | 5834 | 711 | 88.4 | globlastp |
| 3448 | LNU557 | wheat\|12v3\|CA705720_P1 | 5834 | 711 | 88.4 | globlastp |
| 3449 | LNU561 | rye\|12v1\|DRR001012.338830_P1 | 5835 | 712 | 93.5 | globlastp |
| 3450 | LNU561 | rye\|12v1\|DRR001012.81986_P1 | 5836 | 712 | 92.8 | globlastp |
| 3451 | LNU561 | wheat\|12v3\|BE497307_T1 | 5837 | 712 | 92.31 | glotblastn |
| 3452 | LNU561 | wheat\|12v3\|BM136563_P1 | 5838 | 712 | 92.1 | globlastp |
| 3453 | LNU561 | wheat\|12v3\|CA608472_P1 | 5839 | 712 | 91.6 | globlastp |
| 3454 | LNU561 | wheat\|10v2\|BF202883 | 5840 | 712 | 91.4 | globlastp |
| 3455 | LNU561 | rye\|12v1\|DRR001012.42495_T1 | 5841 | 712 | 91.16 | glotblastn |
| 3456 | LNU561 | wheat\|12v3\|BF202883_P1 | 5842 | 712 | 91 | globlastp |
| 3457 | LNU561 | rye\|12v1\|DRR001012.311678_P1 | 5843 | 712 | 81.7 | globlastp |
| 3458 | LNU562 | switchgrass\|gb167\|DN146456 | 5844 | 713 | 94.4 | globlastp |
| 3459 | LNU562 | foxtail_millet\|11v3\|PHY7SI022487M_P1 | 5845 | 713 | 93.8 | globlastp |
| 3460 | LNU562 | maize\|10v1\|T23364_P1 | 5846 | 713 | 92.4 | globlastp |
| 3461 | LNU569 | rye\|12v1\|DRR001012.14076_T1 | 5847 | 716 | 88.57 | glotblastn |
| 3462 | LNU569 | rye\|12v1\|DRR001012.101050_T1 | 5848 | 716 | 85.71 | glotblastn |
| 3463 | LNU569 | oat\|11v1\|GR338371_P1 | 5849 | 716 | 83 | globlastp |
| 3464 | LNU569 | brachypodium\|12v1\|BRADI2G54127_T1 | 5850 | 716 | 81.71 | glotblastn |
| 3465 | LNU569 | brachypodium\|09v1\|SRR031795S0000876 | 5850 | 716 | 81.71 | glotblastn |
| 3466 | LNU571 | wheat\|12v3\|BM259094_P1 | 5851 | 717 | 93.7 | globlastp |
| 3467 | LNU571 | pseudoroegneria\|gb167\|FF358434 | 5852 | 717 | 93.7 | globlastp |
| 3468 | LNU571 | wheat\|10v2\|BE399851 | 5851 | 717 | 93.7 | globlastp |
| 3469 | LNU571 | wheat\|10v2\|BE399386 | 5853 | 717 | 92.1 | globlastp |
| 3470 | LNU571 | rye\|12v1\|BE493824_P1 | 5854 | 717 | 91.3 | globlastp |
| 3471 | LNU571 | rye\|12v1\|DRR001012.258029_P1 | 5854 | 717 | 91.3 | globlastp |
| 3472 | LNU571 | rye\|12v1\|DRR001012.29081_P1 | 5854 | 717 | 91.3 | globlastp |
| 3473 | LNU571 | rye\|12v1\|DRR001012.349436_P1 | 5854 | 717 | 91.3 | globlastp |
| 3474 | LNU571 | rye\|12v1\|DRR001012.42070_P1 | 5854 | 717 | 91.3 | globlastp |
| 3475 | LNU571 | rye\|12v1\|DRR001013.18036_P1 | 5854 | 717 | 91.3 | globlastp |
| 3476 | LNU571 | rye\|gb164\|BE493824 | 5855 | 717 | 84.9 | globlastp |
| 3477 | LNU571 | oat\|11v1\|CN815212_T1 | 5856 | 717 | 81.75 | glotblastn |
| 3478 | LNU571 | oat\|10v2\|CN815212 | 5857 | 717 | 80.95 | glotblastn |
| 3479 | LNU572 | wheat\|12v3\|CA688345_P1 | 5858 | 718 | 97.1 | globlastp |
| 3480 | LNU572 | wheat\|12v3\|BE490826_T1 | 5859 | 718 | 96 | glotblastn |
| 3481 | LNU572 | oat\|10v2\|GR329360 | 5860 | 718 | 94.4 | globlastp |
| 3482 | LNU572 | foxtail_millet\|11v3\|PHY7SI036182M_P1 | 5861 | 718 | 88.9 | globlastp |
| 3483 | LNU572 | rice\|11v1\|AT003692_P1 | 5862 | 718 | 88.7 | globlastp |
| 3484 | LNU572 | rice\|gb170\|OS10G37330 | 5863 | 718 | 88.13 | glotblastn |
| 3485 | LNU572 | rye\|12v1\|DRR001012.254633_T1 | 5864 | 718 | 87.2 | globlastp |
| 3486 | LNU572 | sorghum\|09v1\|SB01G017070 | 5865 | 718 | 87 | globlastp |
| 3487 | LNU572 | sorghum\|12v1\|SB01G017070_P1 | 5865 | 718 | 87 | globlastp |
| 3488 | LNU572 | maize\|10v1\|AI964698_P1 | 5866 | 718 | 84.6 | globlastp |
| 3489 | LNU572 | rye\|12v1\|BE494007_P1 | 5867 | 718 | 83.5 | globlastp |
| 3490 | LNU572 | brachypodium\|09v1\|GT771458 | 5868 | 718 | 83.4 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 3491 | LNU572 | pseudoroegneria\|gb167\|FF361549 | 5869 | 718 | 82.9 | globlastp |
| 3492 | LNU572 | wheat\|10v2\|BQ171088 | 5870 | 718 | 82.4 | globlastp |
| 3493 | LNU572 | oat\|11v1\|GR329360XX2_P1 | 5871 | 718 | 80.8 | globlastp |
| 3494 | LNU574 | wheat\|12v3\|CJ585409_P1 | 5872 | 719 | 97.3 | globlastp |
| 3495 | LNU574 | rye\|12v1\|DRR001012.290284_P1 | 5873 | 719 | 97.2 | globlastp |
| 3496 | LNU574 | wheat\|12v3\|AL828608_T1 | 5874 | 719 | 96.25 | glotblastn |
| 3497 | LNU574 | brachypodium\|09v1\|DV488403 | 5875 | 719 | 89.3 | globlastp |
| 3498 | LNU574 | brachypodium\|12v1\|BRADI3G39100_P1 | 5875 | 719 | 89.3 | globlastp |
| 3499 | LNU574 | wheat\|12v3\|CA641729_T1 | 5876 | 719 | 87.07 | glotblastn |
| 3500 | LNU574 | foxtail_millet\|11v3\|PHY7SI013164M_P1 | 5877 | 719 | 82 | globlastp |
| 3501 | LNU574 | rice\|11v1\|CB000631_P1 | 5878 | 719 | 80.1 | globlastp |
| 3502 | LNU576 | wheat\|12v3\|BF200820_P1 | 5879 | 720 | 97.7 | globlastp |
| 3503 | LNU576 | wheat\|10v2\|BF200820 | 5880 | 720 | 96.8 | globlastp |
| 3504 | LNU576 | oat\|11v1\|CN821024_P1 | 5881 | 720 | 93.3 | globlastp |
| 3505 | LNU576 | oat\|10v2\|CN821024 | 5881 | 720 | 93.3 | globlastp |
| 3506 | LNU576 | brachypodium\|09v1\|GT794841 | 5882 | 720 | 88.8 | globlastp |
| 3507 | LNU576 | brachypodium\|12v1\|BRADI4G25490_P1 | 5882 | 720 | 88.8 | globlastp |
| 3508 | LNU576 | foxtail_millet\|11v3\|PHY7SI009778M_P1 | 5883 | 720 | 84.2 | globlastp |
| 3509 | LNU576 | sorghum\|09v1\|SB05G003290 | 5884 | 720 | 84.1 | globlastp |
| 3510 | LNU576 | sorghum\|12v1\|SB05G003290_P1 | 5884 | 720 | 84.1 | globlastp |
| 3511 | LNU576 | maize\|10v1\|AW191751_P1 | 5885 | 720 | 82.5 | globlastp |
| 3512 | LNU583 | rye\|12v1\|DRR001012.113506_P1 | 5886 | 722 | 86 | globlastp |
| 3513 | LNU583 | wheat\|12v3\|BE400015_P1 | 5887 | 722 | 85.6 | globlastp |
| 3514 | LNU583 | pseudoroegneria\|gb167\|FF358977 | 5888 | 722 | 85.4 | globlastp |
| 3515 | LNU583 | wheat\|10v2\|BE400015 | 5889 | 722 | 84.4 | globlastp |
| 3516 | LNU583 | oat\|11v1\|GO590986_P1 | 5890 | 722 | 82.3 | globlastp |
| 3517 | LNU583 | oat\|10v2\|GO590986 | 5890 | 722 | 82.3 | globlastp |
| 3518 | LNU583 | foxtail_millet\|11v3\|EC612535_P1 | 5891 | 722 | 81.3 | globlastp |
| 3519 | LNU583 | foxtail_millet\|10v2\|EC612535 | 5891 | 722 | 81.3 | globlastp |
| 3520 | LNU583 | sugarcane\|10v1\|CA137430 | 5892 | 722 | 80.86 | glotblastn |
| 3521 | LNU583 | rice\|11v1\|BM419772_T1 | 5893 | 722 | 80.75 | glotblastn |
| 3522 | LNU583 | rice\|gb170\|OS08G41710 | 5893 | 722 | 80.75 | glotblastn |
| 3523 | LNU583 | switchgrass\|gb167\|FE604518 | 5894 | 722 | 80.4 | globlastp |
| 3524 | LNU583 | millet\|10v1\|EVO454PM089032_P1 | 5895 | 722 | 80.1 | globlastp |
| 3525 | LNU583 | sorghum\|12v1\|SB07G026390_T1 | 5896 | 722 | 80.06 | glotblastn |
| 3526 | LNU597 | sorghum\|12v1\|SB01G003520_P1 | 5897 | 725 | 92.2 | globlastp |
| 3527 | LNU597 | sugarcane\|10v1\|CA065350 | 5898 | 725 | 91.4 | globlastp |
| 3528 | LNU597 | switchgrass\|gb167\|DN145143 | 5899 | 725 | 85.4 | globlastp |
| 3529 | LNU597 | switchgrass\|gb167\|DN140909 | 5900 | 725 | 85.2 | globlastp |
| 3530 | LNU598 | foxtail_millet\|10v2\|SICRP035923 | 726 | 726 | 100 | globlastp |
| 3531 | LNU598 | sugarcane\|10v1\|CA068596 | 726 | 726 | 100 | globlastp |
| 3532 | LNU598 | rice\|11v1\|BI801080_P1 | 5901 | 726 | 98.8 | globlastp |
| 3533 | LNU598 | rice\|gb170\|OS01G57966 | 5902 | 726 | 98.2 | globlastp |
| 3534 | LNU598 | lolium\|10v1\|GFXAM777385X10_P1 | 5903 | 726 | 97.6 | globlastp |
| 3535 | LNU598 | barley\|10v2\|AJ463873 | 5904 | 726 | 97.1 | globlastp |
| 3536 | LNU598 | barley\|12v1\|AJ463873_P1 | 5904 | 726 | 97.1 | globlastp |
| 3537 | LNU598 | rice\|gb170\|OSP1G00350 | 5905 | 726 | 97.1 | globlastp |
| 3538 | LNU598 | sesame\|12v1\|GFXJN637766X11_P1 | 5906 | 726 | 95.9 | globlastp |
| 3539 | LNU598 | zostera\|10v1\|SRR057351S0155546 | 5907 | 726 | 95.88 | glotblastn |
| 3540 | LNU598 | lettuce\|10v1\|GFXDQ383816X11 | 5908 | 726 | 95.3 | globlastp |
| 3541 | LNU598 | olea\|11v1\|SRR014463.1041_P1 | 5909 | 726 | 95.3 | globlastp |
| 3542 | LNU598 | rice\|gb170\|OS04G16762 | 5910 | 726 | 95.3 | globlastp |
| 3543 | LNU598 | cotton\|11v1\|GFXDQ345959X11_T1 | — | 726 | 95.29 | glotblastn |
| 3544 | LNU598 | rice\|11v1\|OSPRD018933_T1 | 5911 | 726 | 94.89 | glotblastn |
| 3545 | LNU598 | rice\|11v1\|OSPRD016064_T1 | — | 726 | 94.89 | glotblastn |
| 3546 | LNU598 | amorphophallus\|11v2\|SRR089351X193890_T1 | 5912 | 726 | 94.71 | glotblastn |
| 3547 | LNU598 | tragopogon\|10v1\|SRR020205S0005202 | 5913 | 726 | 94.71 | glotblastn |
| 3548 | LNU598 | ginseng\|10v1\|GFXAY582139X11_P1 | 5914 | 726 | 94.7 | globlastp |
| 3549 | LNU598 | poplar\|10v1\|GFXAP008956X11_P1 | 5915 | 726 | 94.7 | globlastp |
| 3550 | LNU598 | guizotia\|10v1\|GE562894_P1 | 5916 | 726 | 94.1 | globlastp |
| 3551 | LNU598 | pea\|11v1\|GFXHM029370X7_P1 | 5917 | 726 | 94.1 | globlastp |
| 3552 | LNU598 | cowpea\|12v1\|FC462221_P1 | 5918 | 726 | 93.5 | globlastp |
| 3553 | LNU598 | chickpea\|09v2\|GFXEU835853X8 | 5919 | 726 | 93.5 | globlastp |
| 3554 | LNU598 | potato\|10v1\|BQ116782_P1 | 5920 | 726 | 93.5 | globlastp |
| 3555 | LNU598 | solanum_phureja\|09v1\|SPHBG128894 | 5920 | 726 | 93.5 | globlastp |
| 3556 | LNU598 | plantago\|11v2\|GFXAY818918X1_P1 | 5921 | 726 | 92.9 | globlastp |
| 3557 | LNU598 | coffea\|10v1\|CF588864_P1 | 5922 | 726 | 92.9 | globlastp |
| 3558 | LNU598 | pigeonpea\|11v1\|CCCRP076070_P1 | 5923 | 726 | 92.4 | globlastp |
| 3559 | LNU598 | arabidopsis\|10v1\|ATCG00330_T1 | 5924 | 726 | 92.35 | glotblastn |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 3560 | LNU598 | lettuce\|12v1\|LSP12v1CRP101082_P1 | 5925 | 726 | 91.8 | globlastp |
| 3561 | LNU598 | medicago\|12v1\|MTCRP065936_P1 | 5926 | 726 | 88.2 | globlastp |
| 3562 | LNU598 | rice\|11v1\|SOLX00052763_T1 | — | 726 | 87.98 | glotblastn |
| 3563 | LNU598 | wheat\|12v3\|SRR043323X28152D1_T1 | — | 726 | 85.88 | glotblastn |
| 3564 | LNU598 | amborella\|12v3\|AMB12V3CRP028002_P1 | 5927 | 726 | 85.5 | globlastp |
| 3565 | LNU598 | cannabis\|12v1\|SOLX00089980_P1 | 5927 | 726 | 85.5 | globlastp |
| 3566 | LNU598 | castorbean\|11v1\|RCPRD000553_T1 | 5928 | 726 | 85.29 | glotblastn |
| 3567 | LNU598 | medicago\|09v1\|CRPMT030694 | 5929 | 726 | 84.57 | glotblastn |
| 3568 | LNU598 | pine\|10v2\|GFXEU998740X21_P1 | 5930 | 726 | 83.6 | globlastp |
| 3569 | LNU598 | castorbean\|09v1\|CRPRC021385 | 5931 | 726 | 83.53 | globlastp |
| 3570 | LNU598 | cannabis\|12v1\|SOLX00094857_P1 | 5932 | 726 | 83.2 | globlastp |
| 3571 | LNU598 | beet\|12v1\|AW119341_T1 | 5933 | 726 | 82.94 | glotblastn |
| 3572 | LNU598 | cedrus\|11v1\|SRR065007X186296_P1 | 5934 | 726 | 82 | globlastp |
| 3573 | LNU598 | castorbean\|11v1\|RCPRD020063_T1 | 5935 | 726 | 81.98 | glotblastn |
| 3574 | LNU598 | clementine\|11v1\|CX076017_T1 | 5936 | 726 | 80.12 | glotblastn |
| 3575 | LNU600 | switchgrass\|gb167\|FE618943 | 5937 | 727 | 81.4 | globlastp |
| 3576 | LNU600 | foxtail_millet\|11v3\|PHY7SI030740M_T1 | 5938 | 727 | 80.14 | glotblastn |
| 3577 | LNU602 | sugarcane\|10v1\|CA072560 | 5939 | 729 | 90.72 | glotblastn |
| 3578 | LNU602 | sorghum\|09v1\|SB01G036290 | 5940 | 729 | 90.7 | globlastp |
| 3579 | LNU602 | sorghum\|12v1\|SB01G036290_P1 | 5940 | 729 | 90.7 | globlastp |
| 3580 | LNU602 | switchgrass\|gb167\|FL696501 | 5941 | 729 | 86.32 | glotblastn |
| 3581 | LNU602 | foxtail_millet\|11v3\|PHY7SI034697M_T1 | 5942 | 729 | 85.85 | glotblastn |
| 3582 | LNU602 | foxtail_millet\|11v3\|SOLX00019218_T1 | 5942 | 729 | 85.58 | glotblastn |
| 3583 | LNU602 | foxtail_millet\|10v2\|SICRP021689 | 5942 | 729 | 85.06 | glotblastn |
| 3584 | LNU609 | oat\|11v1\|CN817015_P1 | 5943 | 731 | 88.2 | globlastp |
| 3585 | LNU609 | oat\|10v2\|CN817015 | 5943 | 731 | 88.2 | globlastp |
| 3586 | LNU609 | brachypodium\|09v1\|GT770985 | 5944 | 731 | 87.9 | globlastp |
| 3587 | LNU609 | brachypodium\|12v1\|BRADI3G41170_P1 | 5944 | 731 | 87.9 | globlastp |
| 3588 | LNU611 | millet\|10v1\|EVO454PM039171_P1 | 5945 | 732 | 91.6 | globlastp |
| 3589 | LNU617 | sugarcane\|10v1\|CA122646 | 5946 | 733 | 81.4 | globlastp |
| 3590 | LNU618 | sorghum\|09v1\|SB04G015010 | 5947 | 734 | 97.3 | globlastp |
| 3591 | LNU618 | foxtail_millet\|11v3\|PHY7SI016586M_P1 | 5948 | 734 | 94.7 | globlastp |
| 3592 | LNU618 | millet\|10v1\|CD725345_P1 | 5949 | 734 | 94.1 | globlastp |
| 3593 | LNU618 | brachypodium\|09v1\|GT767966 | 5950 | 734 | 90.4 | globlastp |
| 3594 | LNU618 | wheat\|12v3\|AL819023_P1 | 5951 | 734 | 89.6 | globlastp |
| 3595 | LNU618 | wheat\|10v2\|BE443113 | 5952 | 734 | 89.4 | globlastp |
| 3596 | LNU618 | rye\|12v1\|BE495888_P1 | 5953 | 734 | 89 | globlastp |
| 3597 | LNU618 | rice\|11v1\|BE040458_P1 | 5954 | 734 | 88.9 | globlastp |
| 3598 | LNU618 | barley\|10v2\|BF260983 | 5955 | 734 | 88.5 | globlastp |
| 3599 | LNU618 | rice\|gb170\|OS02G25580 | 5956 | 734 | 88.42 | glotblastn |
| 3600 | LNU618 | foxtail_millet\|10v2\|SICRP026301 | 5957 | 734 | 86.1 | globlastp |
| 3601 | LNU618 | sorghum\|09v1\|SB06G003780 | 5958 | 734 | 85.5 | globlastp |
| 3602 | LNU618 | sorghum\|12v1\|SB06G003780_P1 | 5958 | 734 | 85.5 | globlastp |
| 3603 | LNU618 | maize\|10v1\|BM333354_P1 | 5959 | 734 | 84.1 | globlastp |
| 3604 | LNU618 | brachypodium\|12v1\|BRADI5G04686_P1 | 5960 | 734 | 81 | globlastp |
| 3605 | LNU625 | foxtail_millet\|11v3\|PHY7SI035264M_T1 | 5961 | 737 | 81.52 | glotblastn |
| 3606 | LNU635 | sorghum\|12v1\|SB02G027030_P1 | 5962 | 739 | 88.6 | globlastp |
| 3607 | LNU635 | sorghum\|09v1\|SB02G027030 | 5963 | 739 | 88.56 | glotblastn |
| 3608 | LNU635 | brachypodium\|12v1\|BRADI4G32570_P1 | 5964 | 739 | 84.6 | globlastp |
| 3609 | LNU635 | barley\|12v1\|AK375191_T1 | 5965 | 739 | 84.23 | glotblastn |
| 3610 | LNU635 | rye\|12v1\|DRR001013.318992_T1 | 5966 | 739 | 82.96 | glotblastn |
| 3611 | LNU635 | wheat\|12v3\|CV759163_P1 | 5967 | 739 | 82.8 | globlastp |
| 3612 | LNU635 | brachypodium\|09v1\|GT849281 | 5968 | 739 | 81.8 | globlastp |
| 3613 | LNU635 | foxtail_millet\|11v3\|PHY7SI033331M_P1 | 5969 | 739 | 80.9 | globlastp |
| 3614 | LNU640 | rye\|12v1\|DRR001018.116439_T1 | 5970 | 741 | 80.39 | glotblastn |
| 3615 | LNU642 | sugarcane\|10v1\|BQ478968 | 5971 | 742 | 92.2 | globlastp |
| 3616 | LNU642 | switchgrass\|gb167\|DN151945 | 5972 | 742 | 88.4 | globlastp |
| 3617 | LNU642 | cenchrus\|gb166\|EB652840_P1 | 5973 | 742 | 84.6 | globlastp |
| 3618 | LNU642 | switchgrass\|gb167\|FE601408 | 5974 | 742 | 83.3 | globlastp |
| 3619 | LNU642 | millet\|10v1\|EVO454PM055068_T1 | 5975 | 742 | 82.96 | glotblastn |
| 3620 | LNU642 | brachypodium\|09v1\|DV469409 | 5976 | 742 | 82.9 | globlastp |
| 3621 | LNU642 | brachypodium\|12v1\|BRADI4G13327_P1 | 5976 | 742 | 82.9 | globlastp |
| 3622 | LNU642 | foxtail_millet\|11v3\|PHY7SI026655M_P1 | 5977 | 742 | 81.7 | globlastp |
| 3623 | LNU642 | oat\|10v2\|GO597132 | 5978 | 742 | 81.62 | globlastp |
| 3624 | LNU642 | foxtail_millet\|10v2\|OXFXTSLX00012567D1T1 | 5979 | 742 | 81.2 | globlastp |
| 3625 | LNU652 | foxtail_millet\|11v3\|PHY7SI036188M_P1 | 5980 | 744 | 88.3 | globlastp |
| 3626 | LNU652 | maize\|10v1\|BQ619264_T1 | 5981 | 744 | 87.34 | glotblastn |
| 3627 | LNU661 | maize\|10v1\|AW090965_P1 | 5982 | 746 | 98.4 | globlastp |
| 3628 | LNU661 | foxtail_millet\|11v3\|EC612084_P1 | 5983 | 746 | 96.2 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 3629 | LNU661 | sorghum\|09v1\|SB04G000670 | 5984 | 746 | 94.4 | globlastp |
| 3630 | LNU661 | sorghum\|12v1\|SB04G000670_P1 | 5984 | 746 | 94.4 | globlastp |
| 3631 | LNU661 | rice\|11v1\|AF074760_P1 | 5985 | 746 | 92.1 | globlastp |
| 3632 | LNU661 | rice\|gb170\|OS02G01740 | 5985 | 746 | 92.1 | globlastp |
| 3633 | LNU661 | barley\|12v1\|BI955313_P1 | 5986 | 746 | 90.8 | globlastp |
| 3634 | LNU661 | brachypodium\|09v1\|DV475687 | 5987 | 746 | 90.7 | globlastp |
| 3635 | LNU661 | brachypodium\|12v1\|BRADI3G00980_P1 | 5987 | 746 | 90.7 | globlastp |
| 3636 | LNU661 | wheat\|12v3\|BF202068_P1 | 5988 | 746 | 89.1 | globlastp |
| 3637 | LNU661 | sorghum\|09v1\|SB01G002670 | 5989 | 746 | 88.3 | globlastp |
| 3638 | LNU661 | wheat\|12v3\|BE498836_P1 | 5990 | 746 | 85.8 | globlastp |
| 3639 | LNU661 | rye\|12v1\|DRR001012.18421_T1 | 5991 | 746 | 83.84 | glotblastn |
| 3640 | LNU661 | banana\|12v1\|MAGEN2012001805_T1 | 5992 | 746 | 80.67 | glotblastn |
| 3641 | LNU661 | rice\|11v1\|OS03G53220_T1 | 5993 | 746 | 80.04 | glotblastn |
| 3642 | LNU661 | rice\|gb170\|OS03G53220 | 5993 | 746 | 80.04 | glotblastn |
| 3643 | LNU661 | brachypodium\|12v1\|BRADI1G44490_T1 | 5994 | 746 | 80.01 | glotblastn |
| 3644 | LNU666 | maize\|10v1\|AW000684_P1 | 5995 | 748 | 92 | globlastp |
| 3645 | LNU666 | sugarcane\|10v1\|CA075379 | 5996 | 748 | 84.4 | globlastp |
| 3646 | LNU690 | sugarcane\|10v1\|CA072956 | 5997 | 750 | 91.9 | globlastp |
| 3647 | LNU690 | maize\|10v1\|BQ280306_P1 | 5998 | 750 | 90.5 | globlastp |
| 3648 | LNU690 | foxtail_millet\|11v3\|PHY7SI013787M_P1 | 5999 | 750 | 84.9 | globlastp |
| 3649 | LNU690 | leymus\|gb166\|EG391030_P1 | 6000 | 750 | 82 | globlastp |
| 3650 | LNU690 | wheat\|10v2\|CA612717 | 6001 | 750 | 82 | globlastp |
| 3651 | LNU690 | oat\|11v1\|GR350128_P1 | 6002 | 750 | 80.6 | globlastp |
| 3652 | LNU690 | oat\|10v2\|GR350128 | 6002 | 750 | 80.6 | globlastp |
| 3653 | LNU693 | maize\|10v1\|BU498912_T1 | 6003 | 751 | 80.83 | glotblastn |
| 3654 | LNU697 | foxtail_millet\|11v3\|PHY7SI024127M_P1 | 6004 | 752 | 88.6 | globlastp |
| 3655 | LNU697 | wheat\|12v3\|AJ602513_P1 | 6005 | 752 | 82.3 | globlastp |
| 3656 | LNU697 | brachypodium\|12v1\|BRADI2G23440_T1 | 6006 | 752 | 81.01 | glotblastn |
| 3657 | LNU708 | sugarcane\|10v1\|CA067238 | 6007 | 754 | 98.8 | globlastp |
| 3658 | LNU708 | maize\|10v1\|AI461454_P1 | 6008 | 754 | 97.4 | globlastp |
| 3659 | LNU708 | maize\|10v1\|AI600411_P1 | 6009 | 754 | 97.1 | globlastp |
| 3660 | LNU708 | foxtail_millet\|11v3\|EC613043_P1 | 6010 | 754 | 95.5 | globlastp |
| 3661 | LNU708 | millet\|10v1\|EVO454PM008838_P1 | 6011 | 754 | 95.1 | globlastp |
| 3662 | LNU708 | switchgrass\|gb167\|FE613793 | 6012 | 754 | 95 | globlastp |
| 3663 | LNU708 | brachypodium\|09v1\|DV479236 | 6013 | 754 | 91.4 | globlastp |
| 3664 | LNU708 | brachypodium\|12v1\|BRADI5G24370_P1 | 6013 | 754 | 91.4 | globlastp |
| 3665 | LNU708 | foxtail_millet\|10v2\|SICRP012670 | 6014 | 754 | 91.35 | glotblastn |
| 3666 | LNU708 | rice\|11v1\|BE607430_P1 | 6015 | 754 | 90.6 | globlastp |
| 3667 | LNU708 | rice\|gb170\|OS04G55960 | 6015 | 754 | 90.6 | globlastp |
| 3668 | LNU708 | wheat\|12v3\|AF123610_P1 | 6016 | 754 | 88.8 | globlastp |
| 3669 | LNU708 | rye\|12v1\|DRR001012.114555_P1 | 6017 | 754 | 88.3 | globlastp |
| 3670 | LNU708 | wheat\|12v3\|CD873346_P1 | 6018 | 754 | 88.3 | globlastp |
| 3671 | LNU708 | rye\|12v1\|DRR001012.120420_P1 | 6019 | 754 | 87.8 | globlastp |
| 3672 | LNU708 | oat\|11v1\|CN818417_P1 | 6020 | 754 | 86.2 | globlastp |
| 3673 | LNU708 | oat\|10v2\|CN818417 | 6020 | 754 | 86.2 | globlastp |
| 3674 | LNU708 | rye\|12v1\|DRR001012.147669_P1 | 6021 | 754 | 85.8 | globlastp |
| 3675 | LNU708 | wheat\|10v2\|BE404749 | 6022 | 754 | 84 | globlastp |
| 3676 | LNU708 | wheat\|12v3\|BE490336_P1 | 6023 | 754 | 81.7 | globlastp |
| 3677 | LNU708 | barley\|10v2\|BE413142 | 6024 | 754 | 81.6 | globlastp |
| 3678 | LNU708 | millet\|10v1\|EVO454PM004765_P1 | 6025 | 754 | 80.7 | globlastp |
| 3679 | LNU720 | potato\|10v1\|CK244325_P1 | 6026 | 756 | 96.9 | globlastp |
| 3680 | LNU720 | solanum_phureja\|09v1\|SPHAW030717 | 6027 | 756 | 96.8 | globlastp |
| 3681 | LNU746 | wheat\|12v3\|BQ903918_P1 | 6028 | 760 | 99.4 | globlastp |
| 3682 | LNU746 | brachypodium\|09v1\|GT770485 | 6029 | 760 | 91 | globlastp |
| 3683 | LNU746 | brachypodium\|12v1\|BRADI5G26410_P1 | 6029 | 760 | 91 | globlastp |
| 3684 | LNU746 | rice\|11v1\|C97502_T1 | 6030 | 760 | 87.52 | glotblastn |
| 3685 | LNU746 | rice\|gb170\|OS04G58390 | 6031 | 760 | 87.5 | globlastp |
| 3686 | LNU748 | rye\|12v1\|BE705247_P1 | 6032 | 762 | 98.5 | globlastp |
| 3687 | LNU748 | rye\|12v1\|DRR001012.110825_P1 | 6033 | 762 | 98.5 | globlastp |
| 3688 | LNU748 | oat\|11v1\|CN815055_P1 | 6034 | 762 | 94.8 | globlastp |
| 3689 | LNU748 | oat\|10v2\|CN815055 | 6034 | 762 | 94.8 | globlastp |
| 3690 | LNU748 | brachypodium\|09v1\|DV473437 | 6035 | 762 | 94.2 | globlastp |
| 3691 | LNU748 | brachypodium\|12v1\|BRADI1G69170_P1 | 6035 | 762 | 94.2 | globlastp |
| 3692 | LNU748 | switchgrass\|gb167\|DN144965 | 6036 | 762 | 90.9 | globlastp |
| 3693 | LNU748 | switchgrass\|gb167\|DN144903 | 6037 | 762 | 90.5 | globlastp |
| 3694 | LNU748 | maize\|10v1\|AI673924_P1 | 6038 | 762 | 90.1 | globlastp |
| 3695 | LNU748 | sugarcane\|10v1\|CA069503 | 6039 | 762 | 90 | globlastp |
| 3696 | LNU748 | sorghum\|09v1\|SB01G042050 | 6040 | 762 | 89.8 | globlastp |
| 3697 | LNU748 | sorghum\|12v1\|SB01G042050_P1 | 6040 | 762 | 89.8 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 3698 | LNU748 | foxtail_millet\|11v3\|EC612029_P1 | 6041 | 762 | 89.6 | globlastp |
| 3699 | LNU748 | rice\|11v1\|BE230573_P1 | 6042 | 762 | 89.3 | globlastp |
| 3700 | LNU748 | rice\|gb170\|OS03G12910 | 6042 | 762 | 89.3 | globlastp |
| 3701 | LNU748 | millet\|10v1\|EVO454PM001724_P1 | 6043 | 762 | 89.1 | globlastp |
| 3702 | LNU748 | maize\|10v1\|BE512413_P1 | 6044 | 762 | 88.7 | globlastp |
| 3703 | LNU748 | rice\|gb170\|OS03G12900 | 6045 | 762 | 84.6 | globlastp |
| 3704 | LNU748 | barley\|12v1\|BE437722_P1 | 6046 | 762 | 82.6 | globlastp |
| 3705 | LNU748 | oil_palm\|11v1\|EL687445_P1 | 6047 | 762 | 82.5 | globlastp |

Table 2: Provided are the homologous polypeptides and polynucleotides of the genes identified in Table 1 and of their cloned genes, which can increase nitrogen use efficiency, fertilizer use efficiency, yield, seed yield, growth rate, vigor, biomass, oil content, fiber yield, fiber quality, fiber length, abiotic stress tolerance and/or water use efficiency of a plant. Homology was calculated as % of identity over the aligned sequences. The query sequences were polypeptide sequences SEQ ID NOs: 470-762) and the subject sequences are polypeptide sequences or polynucleotide sequences which were dynamically translated in all six reading frames identified in the database based on greater than 80% identity to the query polypeptide sequences.
"Polyp." = polypeptide;
"Polyn."—Polynucleotide.
Algor. = Algorithm.
"globlastp"—global homology using blastp;
"glotblastn"—global homology using tblastn.
"Hom."—homologous.

The output of the functional genomics approach described herein is a set of genes highly predicted to improve nitrogen use efficiency, fertilizer use efficiency, yield, seed yield, growth rate, vigor, biomass, oil content, fiber yield, fiber length, fiber quality, abiotic stress tolerance and/or water use efficiency of a plant by increasing their expression.

Although each gene is predicted to have its own impact, modifying the mode of expression of more than one gene or gene product (RNA, polypeptide) is expected to provide an additive or synergistic effect on the desired trait (e.g., nitrogen use efficiency, fertilizer use efficiency, yield, growth rate, vigor, biomass, oil content, abiotic stress tolerance and/or water use efficiency of a plant). Altering the expression of each gene described here alone or of a set of genes together increases the overall yield and/or other agronomic important traits, and hence is expected to increase agricultural productivity.

Example 3

Production of *Arabidopsis* Transcriptome and High Throughput Correlation Analysis Using 44K *Arabidopsis* Oligonucleotide Micro-Array In order to produce a high throughput correlation analysis comparing between plant phenotype and gene expression level, the present inventors utilized a *Arabidopsis* oligonucleotide micro-array, produced by Agilent Technologies [Hypertext Transfer Protocol://World Wide Web (dot) chem (dot) agilent (dot) com/Scripts/PDS (dot) asp?1Page=50879]. The array oligonucleotide represents about 44,000 *Arabidopsis* genes and transcripts. To define correlations between the levels of RNA expression with NUE, yield components or vigor related parameters various plant characteristics of 14 different *Arabidopsis* ecotypes were analyzed. Among them, ten ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed *Arabidopsis* Tissues—

Two tissues of plants [leaves and stems] growing at two different nitrogen fertilization levels (1.5 mM Nitrogen or 6 mM Nitrogen) were sampled and RNA was extracted as described above. Each micro-array expression information tissue type has received a Set ID as summarized Table 3 below.

TABLE 3

*Arabidopsis* transcriptome experimental sets

| Expression Set | Set ID |
|---|---|
| Leaves at 1.5 mM Nitrogen fertilization | A |
| Leaves at 6 mM Nitrogen fertilization | B |
| Stems at 1.5 mM Nitrogen fertilization | C |
| Stem at 6 mM Nitrogen fertilization | D |

Table 3.

*Arabidopsis* Yield Components and Vigor Related Parameters Under Different Nitrogen Fertilization Levels Assessment—

10 *Arabidopsis* accessions in 2 repetitive plots each containing 8 plants per plot were grown at greenhouse. The growing protocol used was as follows: surface sterilized seeds were sown in Eppendorf tubes containing 0.5× Murashige-Skoog basal salt medium and grown at 23° C. under 12-hour light and 12-hour dark daily cycles for 10 days. Then, seedlings of similar size were carefully transferred to pots filled with a mix of perlite and peat in a 1:1 ratio. Constant nitrogen limiting conditions were achieved by irrigating the plants with a solution containing 1.5 mM inorganic nitrogen in the form of $KNO_3$, supplemented with 2 mM $CaCl_2$, 1.25 mM $KH_2PO_4$, 1.50 mM $MgSO_4$, 5 mM KCl, 0.01 mM $H_3BO_3$ and microelements, while normal irrigation conditions was achieved by applying a solution of 6 mM inorganic nitrogen also in the form of $KNO_3$, supplemented with 2 mM $CaCl_2$, 1.25 mM $KH_2PO_4$, 1.50 mM $MgSO_4$, 0.01 mM $H_3BO_3$ and microelements. To follow plant growth, trays were photographed the day nitrogen limiting conditions were initiated and subsequently every 3 days for about 15 additional days. Rosette plant area was then determined from the digital pictures. ImageJ software was used for quantifying the plant size from the digital pictures [Hypertext Transfer Protocol://rsb (dot) info (dot) nih (dot) gov/ij/] utilizing proprietary scripts designed to analyze the size of rosette area from individual plants as a function of time. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]). Next, analyzed data was saved to text files and processed using the JMP statistical analysis software (SAS institute).

Data parameters collected are summarized in Table 4, hereinbelow.

TABLE 4

*Arabidopsis* correlated parameters (vectors)

| Correlated parameter with | Correlation ID |
|---|---|
| N 1.5 mM; Rosette Area at day 8 [$cm^2$] | 1 |
| N 1.5 mM; Rosette Area at day 10 [$cm^2$] | 2 |
| N 1.5 mM; Plot Coverage at day 8 [%] | 3 |
| N 1.5 mM; Plot Coverage at day 10 [%] | 4 |
| N 1.5 mM; Leaf Number at day 10 | 5 |
| N 1.5 mM; Leaf Blade Area at day 10 [$cm^2$] | 6 |
| N 1.5 mM; RGR of Rosette Area at day 3 [$cm^2$/day] | 7 |
| N 1.5 mM; t50 Flowering [day] | 8 |
| N 1.5 mM; Dry Weight [gr./plant] | 9 |
| N 1.5 mM; Seed Yield [gr./plant] | 10 |
| N 1.5 mM; Harvest Index | 11 |
| N 1.5 mM; 1000 Seeds weight [gr.] | 12 |
| N 1.5 mM; seed yield/rosette area at day 10 [gr/$cm^2$] | 13 |
| N 1.5 mM; seed yield/leaf blade [gr/$cm^2$] | 14 |
| N 1.5 mM; % Seed yield reduction compared to N 6 mM | 15 |
| N 1.5 mM; % Biomass reduction compared to N 6 mM | 16 |
| N 1.5 mM; N level/DW [SPAD unit/gr.] | 17 |
| N 1.5 mM; DW/N level [gr./SPAD unit] | 18 |
| N 1.5 mM; seed yield/N level [gr./SPAD unit] | 19 |
| N 6 mM; Rosette Area at day 8 [$cm^2$] | 20 |
| N 6 mM; Rosette Area at day 10 [$cm^2$] | 21 |
| N 6 mM; Plot Coverage at day 8 [%] | 22 |
| N 6 mM; Plot Coverage at day 10 [%] | 23 |
| N 6 mM; Leaf Number at day 10 | 24 |
| N 6 mM; Leaf Blade Area at day 10 | 25 |
| N 6 mM; RGR of Rosette Area at day 3 [$cm^2$/gr.] | 26 |
| N 6 mM; t50 Flowering [day] | 27 |
| N 6 mM; Dry Weight [gr./plant] | 28 |
| N 6 mM; Seed Yield [gr./plant] | 29 |
| N 6 mM; Harvest Index | 30 |
| N 6 mM; 1000 Seeds weight [gr.] | 31 |
| N 6 mM; seed yield/rosette area day at day 10 [gr./$cm^2$] | 32 |
| N 6 mM; seed yield/leaf blade [gr/$cm^2$] | 33 |
| N 6 mM; N level/FW | 34 |
| N 6 mM; DW/N level [gr./SPAD unit] | 35 |
| N 6 mM; N level/DW (SPAD unit/gr. plant) | 36 |
| N 6 mM; Seed yield/N unit [gr./SPAD unit] | 37 |

Table 4. "N" = Nitrogen at the noted concentrations; "gr." = grams; "SPAD" = chlorophyll levels; "t50" = time where 50% of plants flowered; "gr./SPAD unit" = plant biomass expressed in grams per unit of nitrogen in plant measured by SPAD. "DW" = plant dry weight; "N level/DW" = plant Nitrogen level measured in SPAD unit per plant biomass [gr.]; "DW/N level" = plant biomass per plant [gr.]/SPAD unit;

Assessment of NUE, Yield Components and Vigor-Related Parameters—

Ten *Arabidopsis* ecotypes were grown in trays, each containing 8 plants per plot, in a greenhouse with controlled temperature conditions for about 12 weeks. Plants were irrigated with different nitrogen concentration as described above depending on the treatment applied. During this time, data was collected documented and analyzed. Most of chosen parameters were analyzed by digital imaging.

Digital Imaging—Greenhouse Assay

An image acquisition system, which consists of a digital reflex camera (Canon EOS 400D) attached with a 55 mm focal length lens (Canon EF-S series) placed in a custom made Aluminum mount, was used for capturing images of plants planted in containers within an environmental controlled greenhouse. The image capturing process was repeated every 2-3 days starting at day 9-12 till day 16-19 (respectively) from transplanting.

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data was saved to text files and analyzed using the JMP statistical analysis software (SAS institute).

Leaf Analysis—

Using the digital analysis leaves data was calculated, including leaf number, leaf blade area, Rosette diameter and area.

Vegetative Growth Rate:

the relative growth rate (RGR) of leaf blade area (Formula V), leaf number (Formula VI), rosette area (Formula VII), rosette diameter (Formula VIII), plot coverage (Formula IX) and Petiole Relative Area (Formula X) were calculated as follows:

Relative growth rate of leaf blade area=Regression coefficient of leaf area along time course.   Formula V Relative growth rate of plant leaf number=Regression coefficient of plant leaf number along time course.   Formula VI Relative growth rate of rosette area=Regression coefficient of rosette area along time course.   Formula VII Relative growth rate of rosette diameter=Regression coefficient of rosette diameter along time course.   Formula VIII Relative growth rate of plot coverage=Regression coefficient of plot.   Formula IX Petiole Relative Area=[(Leaf blade*Leaf number)/Rosette.   Formula X Seed Yield and 1000 Seeds Weight—

At the end of the experiment all seeds from all plots were collected and weighed in order to measure seed yield per plant in terms of total seed weight per plant (gr.). For the calculation of 1000 seed weight, an average weight of 0.02 grams was measured from each sample, the seeds were scattered on a glass tray and a picture was taken. Using the digital analysis, the number of seeds in each sample was calculated.

Dry Weight and Seed Yield—

At the end of the experiment, plant were harvested and left to dry at 30° C. in a drying chamber. The biomass was separated from the seeds, weighed and divided by the number of plants. Dry weight=total weight of the vegetative portion above ground (excluding roots) after drying at 30° C. in a drying chamber.

Harvest Index—

The harvest index was calculated using Formula IV as described above.

$T_{50}$ Days to Flowering—

Each of the repeats was monitored for flowering date. Days of flowering was calculated from sowing date till 50% of the plots flowered.

Plant Nitrogen Level—

The chlorophyll content of leaves is a good indicator of the nitrogen plant status since the degree of leaf greenness is highly correlated to this parameter. Chlorophyll content was determined using a Minolta SPAD 502 chlorophyll meter and measurement was performed at time of flowering. SPAD meter readings were done on young fully developed leaf. Three measurements per leaf were taken per plot. Based on this measurement, parameters such as the ratio between seed yield per nitrogen unit [seed yield/N level=seed yield per plant [gr.]/SPAD unit], plant DW per nitrogen unit [DW/N level=plant biomass per plant [gr.]/SPAD unit], and nitrogen level per gram of biomass [N level/DW=SPAD unit/plant biomass per plant (gr.)] were calculated.

Percent of Seed Yield Reduction— measures the amount of seeds obtained in plants when grown under nitrogen-limiting conditions compared to seed yield produced at normal nitrogen levels expressed in %.

Experimental Results 10 different *Arabidopsis* accessions (ecotypes) were grown and characterized for 37 parameters as described above. The average for each of the measured parameters was calculated using the JMP software and values are summarized in Table 5 below. Subsequent correlation analysis between the various transcriptome sets (Table 3) and the measured parameters was conducted. Following, the results were integrated to the database.

TABLE 5

Measured parameters in *Arabidopsis* accessions

| Ecotype\Treatment | Line -1 | Line -2 | Line -3 | Line -4 | Line -5 | Line -6 | Line -7 | Line -8 | Line -9 | Line-10 |
|---|---|---|---|---|---|---|---|---|---|---|
| N 1.5 mM; Rosette Area at day 8 | 0.760 | 0.079 | 1.061 | 1.157 | 0.996 | 1.000 | 0.910 | 0.942 | 1.118 | 0.638 |
| N 1.5 mM; Rosette Area at day 10 | 1.430 | 1.325 | 1.766 | 1.971 | 1.754 | 1.832 | 1.818 | 1.636 | 1.996 | 1.150 |
| N 1.5 mM; Plot Coverage % at day 8 | 3.221 | 3.003 | 4.497 | 4.902 | 4.220 | 4.238 | 3.858 | 3.990 | 4.738 | 2.705 |
| N 1.5 mM; Plot Coverage % at day 10 | 6.058 | 5.614 | 7.484 | 8.351 | 7.432 | 7.764 | 7.702 | 6.933 | 8.458 | 4.871 |
| N 1.5 mM; Leaf Number at day 10 | 6.875 | 7.313 | 7.313 | 7.875 | 7.938 | 7.750 | 7.625 | 7.188 | 8.625 | 5.929 |
| N 1.5 mM; Leaf Blade Area at day 10 | 0.335 | 0.266 | 0.374 | 0.387 | 0.373 | 0.370 | 0.386 | 0.385 | 0.379 | 0.307 |
| N 1.5 mM; RGR of Rosette Area at day 3 | 0.631 | 0.793 | 0.502 | 0.491 | 0.605 | 0.720 | 0.825 | 0.646 | 0.668 | 0.636 |
| N 1.5 mM; t50 Flowering [day] | 15.967 | 20.968 | 14.836 | 24.708 | 23.566 | 23.698 | 18.059 | 19.488 | 23.568 | 21.888 |
| N 1.5 mM; Dry Weight [gr/plant] | 0.164 | 0.124 | 0.082 | 0.113 | 0.184 | 0.124 | 0.134 | 0.106 | 0.148 | 0.171 |
| N 1.5 mM; Seed Yield [gr/plant] | 0.032 | 0.025 | 0.023 | 0.010 | 0.006 | 0.009 | 0.032 | 0.019 | 0.012 | 0.014 |
| N 1.5 mM; Harvest Index | 0.192 | 0.203 | 0.295 | 0.085 | 0.031 | 0.071 | 0.241 | 0.179 | 0.081 | 0.079 |
| N 1.5 mM; 1000 Seeds weight[gr] | 0.016 | 0.016 | 0.018 | 0.014 | 0.018 | 0.022 | 0.015 | 0.014 | 0.022 | 0.019 |
| N 1.5 mM; seed yield/rosette area day at day 10 | 0.022 | 0.019 | 0.014 | 0.005 | 0.003 | 0.005 | 0.018 | 0.013 | 0.007 | 0.012 |
| N 1.5 mM; seed yield/leaf blade | 0.095 | 0.095 | 0.063 | 0.026 | 0.015 | 0.024 | 0.084 | 0.059 | 0.034 | 0.044 |
| N 1.5 mM; % Seed yield reduction compared to 6 mM | 72.559 | 84.701 | 78.784 | 87.996 | 91.820 | 92.622 | 76.710 | 81.938 | 91.301 | 85.757 |
| N 1.5 mM; % Biomass reduction compared to 6 mM | 60.746 | 76.706 | 78.560 | 78.140 | 62.972 | 78.641 | 73.192 | 83.068 | 77.190 | 70.120 |
| N 1.5 mM; Spad/FW | 45.590 | | | 42.108 | 28.151 | | 53.111 | | | 67.000 |
| N 1.5 mM; SPAD/DW | 167.300 | | | 241.061 | 157.823 | | 194.977 | | | 169.343 |
| N 1.5 mM; DW/SPAD | 0.006 | | | 0.004 | 0.006 | | 0.005 | | | 0.006 |
| N 1.5 mM; seed yield/spad | 0.001 | | | 0.000 | 0.000 | | 0.001 | | | 0.000 |
| N 6 mM; Rosette Area at day 8 | 0.759 | 0.857 | 1.477 | 1.278 | 1.224 | 1.095 | 1.236 | 1.094 | 1.410 | 0.891 |
| N 6 mM; Rosette Area at day 10 | 1.406 | 1.570 | 2.673 | 2.418 | 2.207 | 2.142 | 2.474 | 1.965 | 2.721 | 1.642 |
| N 6 mM; Plot Coverage % at day 8 | 3.216 | 3.631 | 6.259 | 5.413 | 5.187 | 4.641 | 5.236 | 4.634 | 5.974 | 3.774 |
| N 6 mM; Plot Coverage % at day 10 | 5.957 | 6.654 | 11.324 | 10.244 | 9.352 | 9.076 | 10.485 | 8.327 | 11.528 | 6.958 |
| N 6 mM; Leaf Number at day 10 | 6.250 | 7.313 | 8.063 | 8.750 | 8.063 | 8.750 | 8.375 | 7.125 | 9.438 | 6.313 |
| N 6 mM; Leaf Blade Area at day 10 | 0.342 | 0.315 | 0.523 | 0.449 | 0.430 | 0.430 | 0.497 | 0.428 | 0.509 | 0.405 |
| N 6 mM; RGR of Rosette Area at day 3 | 0.689 | 1.024 | 0.614 | 0.601 | 0.477 | 0.651 | 0.676 | 0.584 | 0.613 | 0.515 |
| N 6 mM; t50 Flowering [day] | 16.371 | 20.500 | 14.635 | 24.000 | 23.378 | 23.595 | 15.033 | 19.750 | 22.887 | 18.804 |

TABLE 5-continued

Measured parameters in *Arabidopsis* accessions

| Ecotype\Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| N 6 mM; Dry Weight [gr/plant] | 0.419 | 0.531 | 0.382 | 0.518 | 0.496 | 0.579 | 0.501 | 0.628 | 0.649 | 0.573 |
| N 6 mM; Seed Yield [gr/plant] | 0.116 | 0.165 | 0.108 | 0.082 | 0.068 | 0.119 | 0.139 | 0.107 | 0.138 | 0.095 |
| N 6 mM; Harvest Index | 0.280 | 0.309 | 0.284 | 0.158 | 0.136 | 0.206 | 0.276 | 0.171 | 0.212 | 0.166 |
| N 6 mM; 1000 Seeds weight[gr] | 0.015 | 0.017 | 0.018 | 0.012 | 0.016 | 0.016 | 0.015 | 0.014 | 0.017 | 0.016 |
| N 6 mM; seed yield/rosette area day at day 10 | 0.082 | 0.106 | 0.041 | 0.034 | 0.031 | 0.056 | 0.057 | 0.055 | 0.051 | 0.058 |
| N 6 mM; seed yield/leaf blade | 0.339 | 0.526 | 0.207 | 0.183 | 0.158 | 0.277 | 0.281 | 0.252 | 0.271 | 0.235 |
| N 6 mM; Spad /FW | 22.489 | | | 28.268 | 17.641 | | 33.323 | | | 39.003 |
| N 6 mM; DW/SPAD (biomass/N unit) | 0.019 | | | 0.018 | 0.028 | | 0.015 | | | 0.015 |
| N 6 mM; spad/DW (gN/g plant) | 53.705 | | | 54.625 | 35.548 | | 66.479 | | | 68.054 |
| N 6 mM; Seed yield/N unit | 0.004 | | | 0.003 | 0.002 | | 0.005 | | | 0.003 |

Table 5. Provided are the measured parameters under various treatments in various ecotypes (Arabidopsis accessions).

Example 4

Production of *Arabidopsis* Transcriptome and High Throughput Correlation Analysis of Yield, Biomass and/or Vigor Related Parameters Using 44K *Arabidopsis* Full Genome Oligonucleotide Micro-Array To produce a high throughput correlation analysis comparing between plant phenotype and gene expression level, the present inventors utilized an *Arabidopsis thaliana* oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 40,000 *A. thaliana* genes and transcripts designed based on data from the TIGR ATH1 v.5 database and *Arabidopsis* MPSS (University of Delaware) databases. To define correlations between the levels of RNA expression and yield, biomass components or vigor related parameters, various plant characteristics of 15 different *Arabidopsis* ecotypes were analyzed. Among them, nine ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed *Arabidopsis* Tissues—

Five tissues at different developmental stages including root, leaf, flower at anthesis, seed at 5 days after flowering (DAF) and seed at 12 DAF, representing different plant characteristics, were sampled and RNA was extracted as described above. Each micro-array expression information tissue type has received a Set ID as summarized in Table 6 below.

TABLE 6

Tissues used for *Arabidopsis* transcriptome expression sets

| Expression Set | Set ID |
|---|---|
| Root | A |
| Leaf | B |
| Flower | C |
| Seed 5 DAF | D |
| Seed 12 DAF | E |

Table 6: Provided are the identification (ID) letters of each of the *Arabidopsis* expression sets (A-E). DAF = days after flowering.

Yield Components and Vigor Related Parameters Assessment—

Eight out of the nine *Arabidopsis* ecotypes were used in each of 5 repetitive blocks (named A, B, C, D and E), each containing 20 plants per plot. The plants were grown in a greenhouse at controlled conditions in 22° C., and the N:P:K fertilizer (20:20:20; weight ratios) [nitrogen (N), phosphorus (P) and potassium (K)] was added. During this time data was collected, documented and analyzed. Additional data was collected through the seedling stage of plants grown in a tissue culture in vertical grown transparent agar plates. Most of chosen parameters were analyzed by digital imaging.

Digital Imaging in Tissue Culture—

A laboratory image acquisition system was used for capturing images of plantlets sawn in square agar plates. The image acquisition system consists of a digital reflex camera (Canon EOS 300D) attached to a 55 mm focal length lens (Canon EF-S series), mounted on a reproduction device (Kaiser RS), which included 4 light units (4×150 Watts light bulb) and located in a darkroom.

Digital Imaging in Greenhouse—

The image capturing process was repeated every 3-4 days starting at day 7 till day 30. The same camera attached to a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P43.0 GHz processor) and a public domain program—ImageJ 1.37, Java based image processing program, which was developed at the U.S. National Institutes of Health and is freely available on the internet at Hypertext Transfer Protocol://rsbweb (dot) nih (dot) gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf Analysis—

Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images. The blade circularity was calculated as laminar width divided by laminar length.

Root Analysis—

During 17 days, the different ecotypes were grown in transparent agar plates. The plates were photographed every 3 days starting at day 7 in the photography room and the roots development was documented (see examples in FIGS. 3A-F). The growth rate of roots was calculated according to Formula XL Relative growth rate of root coverage=Regression coefficient of root coverage along time course.   Formula XI Vegetative Growth Rate Analysis— was calculated according to Formulas V-X above. The analysis was ended with the appearance of overlapping plants.

For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in Siliques Analysis—

On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds Average Weight—

At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil Percentage in Seeds—

At the end of the experiment all seeds from plots of blocks A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) was used to create a calibration curve for the Low Resonance NMR. The content of oil of all seed samples was determined using the Low Resonance NMR (MARAN Ultra—Oxford Instrument) and its MultiQuant software package.

Silique Length Analysis—

On day 50 from sowing, 30 siliques from different plants in each plot were sampled in block A. The chosen siliques were green-yellow in color and were collected from the bottom parts of a grown plant's stem. A digital photograph was taken to determine silique's length.

Dry Weight and Seed Yield—

On day 80 from sowing, the plants from blocks A-C were harvested and left to dry at 30° C. in a drying chamber. The biomass and seed weight of each plot was separated, measured and divided by the number of plants. Dry weight=total weight of the vegetative portion above ground (excluding roots) after drying at 30° C. in a drying chamber; Seed yield per plant=total seed weight per plant (gr).

Oil Yield—

The oil yield was calculated using Formula XII.

Seed Oil yield=Seed yield per plant (gr.)*Oil % in seed.   Formula XII

Harvest Index (Seed)—

The harvest index was calculated using Formula IV (described above).

Experimental Results

Nine different *Arabidopsis* ecotypes were grown and characterized for 18 parameters (named as vectors). Table 7 describes the *Arabidopsis* correlated parameters. The average for each of the measured parameter was calculated using the JMP software (Tables 8-9) and a subsequent correlation analysis was performed. Results were then integrated to the database.

TABLE 7

*Arabidopsis* correlated parameters (vectors)

| Correlated parameter with | Correlation ID |
|---|---|
| Root length day 13 (cm) | 1 |
| Root length day 7 (cm) | 2 |
| Relative root growth (cm/day) day 13 | 3 |
| Fresh weight per plant (gr.) at bolting stage | 4 |
| Dry matter per plant (gr.) | 5 |
| Vegetative growth rate (cm$^2$/day) till 8 true leaves | 6 |
| Blade circularity (calculated as laminar width divided by laminar length) | 7 |
| Lamina width (cm) | 8 |
| Lamina length (cm) | 9 |
| Total leaf area per plant (cm) | 10 |
| 1000 Seed weight (gr.) | 11 |
| Oil % per seed | 12 |
| Seeds per silique | 13 |
| Silique length (cm) | 14 |
| Seed yield per plant (gr.) | 15 |
| Oil yield per plant (mg) | 16 |
| Harvest Index | 17 |
| Leaf width/length | 18 |

Table 7. Provided are the *Arabidopsis* correlated parameters (correlation ID Nos. 1-18). Abbreviations: Cm = centimeter(s); gr. = gram(s); mg = milligram(s).

The characterized values are summarized in Tables 8 and 9 below.

TABLE 8

Measured parameters in *Arabidopsis* ecotypes

| Ecotype | 15 | 16 | 12 | 11 | 5 | 17 | 10 | 13 | 14 |
|---|---|---|---|---|---|---|---|---|---|
| An-1 | 0.34 | 118.63 | 34.42 | 0.0203 | 0.64 | 0.53 | 46.86 | 45.44 | 1.06 |
| Col-0 | 0.44 | 138.73 | 31.19 | 0.0230 | 1.27 | 0.35 | 109.89 | 53.47 | 1.26 |
| Ct-1 | 0.59 | 224.06 | 38.05 | 0.0252 | 1.05 | 0.56 | 58.36 | 58.47 | 1.31 |
| Cvi (N8580) | 0.42 | 116.26 | 27.76 | 0.0344 | 1.28 | 0.33 | 56.80 | 35.27 | 1.47 |
| Gr-6 | 0.61 | 218.27 | 35.49 | 0.0202 | 1.69 | 0.37 | 114.66 | 48.56 | 1.24 |
| Kondara | 0.43 | 142.11 | 32.91 | 0.0263 | 1.34 | 0.32 | 110.82 | 37.00 | 1.09 |
| Ler-1 | 0.36 | 114.15 | 31.56 | 0.0205 | 0.81 | 0.45 | 88.49 | 39.38 | 1.18 |
| Mt-0 | 0.62 | 190.06 | 30.79 | 0.0226 | 1.21 | 0.51 | 121.79 | 40.53 | 1.18 |
| Shakdara | 0.55 | 187.62 | 34.02 | 0.0235 | 1.35 | 0.41 | 93.04 | 25.53 | 1.00 |

Table 8. Provided are the values of each of the parameters measured in Arabidopsis ecotypes:
15 = Seed yield per plant (gram);
16 = oil yield per plant (mg);
12 = oil % per seed;
11 = 1000 seed weight (gr.);
5 = dry matter per plant (gr.);
17 = harvest index;
10 = total leaf area per plant (cm);
13 = seeds per silique;
14 = Silique length (cm).

TABLE 9

Additional measured parameters in *Arabidopsis* ecotypes

| Ecotype | 6 | 3 | 2 | 1 | 4 | 9 | 8 | 18 | 7 |
|---|---|---|---|---|---|---|---|---|---|
| An-1 | 0.313 | 0.631 | 0.937 | 4.419 | 1.510 | 2.767 | 1.385 | 0.353 | 0.509 |
| Col-0 | 0.378 | 0.664 | 1.759 | 8.530 | 3.607 | 3.544 | 1.697 | 0.288 | 0.481 |
| Ct-1 | 0.484 | 1.176 | 0.701 | 5.621 | 1.935 | 3.274 | 1.460 | 0.316 | 0.450 |
| Cvi (N8580) | 0.474 | 1.089 | 0.728 | 4.834 | 2.082 | 3.785 | 1.374 | 0.258 | 0.370 |
| Gr-6 | 0.425 | 0.907 | 0.991 | 5.957 | 3.556 | 3.690 | 1.828 | 0.356 | 0.501 |
| Kondara | 0.645 | 0.774 | 1.163 | 6.372 | 4.338 | 4.597 | 1.650 | 0.273 | 0.376 |
| Ler-1 | 0.430 | 0.606 | 1.284 | 5.649 | 3.467 | 3.877 | 1.510 | 0.305 | 0.394 |
| Mt-0 | 0.384 | 0.701 | 1.414 | 7.060 | 3.479 | 3.717 | 1.817 | 0.335 | 0.491 |
| Shakdara | 0.471 | 0.782 | 1.251 | 7.041 | 3.710 | 4.149 | 1.668 | 0.307 | 0.409 |

Table 9. Provided are the values of each of the parameters measured in Arabidopsis ecotypes:
6 = Vegetative growth rate ($cm^2$/day) until 8 true leaves;
3 = relative root growth (cm/day) (day 13);
2 = Root length day 7 (cm);
1 = Root length day 13 (cm);
4 = fresh weight per plant (gr.) at bolting stage;
9 = Lamima length (cm);
8 = Lamina width (cm);
18 = Leaf width/length;
7 = Blade circularity.

Example 5

Plant Fiber Development in Cotton Production of Cotton Transcriptome and High Throughput Correlation Analysis Using Cotton Oligonucleotide Microarray In order to conduct high throughput gene expression correlation analysis, the present inventors used cotton oligonucleotide microarray, designed and produced by "Comparative Evolutionary Genomics of Cotton" [Hypertext Transfer Protocol (http)://cottonevolution (dot) info/). This Cotton Oligonucleotide Microarray is composed of 12,006 Integrated DNA Technologies (IDT) oligonucleotides derived from an assembly of more than 180,000 *Gossypium* ESTs sequenced from 30 cDNA libraries. For additional details see PCT/IL2005/000627 and PCT/IL2007/001590 which are fully incorporated herein by reference.

TABLE 10

Cotton transcriptome experimental sets

| Expression Set | Set ID |
|---|---|
| cotton fiber 5 d | A |
| cotton fiber 10 d | B |
| cotton fiber 15 d | C |

Table 10. Provided are the cotton transcriptome expression sets. "5 d" = 5 days post anthesis; "10 d" = 10 days post anthesis; "15 d" = 15 days post anthesis. "DPA" = days-post-anthesis.

In order to define correlations between the levels of RNA expression and fiber length, fibers from 8 different cotton lines were analyzed. These fibers were selected showing very good fiber quality and high lint index (Pima types, originating from other cotton species, namely *G. barbadense*), different levels of quality and lint indexes from various *G. hirsutum* lines: good quality and high lint index (Acala type), and poor quality and short lint index (Tamcot type, and old varieties). A summary of the fiber length of the different lines is provided in Table 11 below.

Experimental Procedures

RNA Extraction—

Fiber development stages, representing different fiber characteristics, at 5, 10 and 15 DPA were sampled and RNA was extracted as described above.

Fiber Length Assessment—

Fiber length of the selected cotton lines was measured using fibrograph. The fibrograph system was used to compute length in terms of "Upper Half Mean" length. The upper half mean (UHM) is the average length of longer half of the fiber distribution. The fibrograph measures length in span lengths at a given percentage point World Wide Web (dot) cottoninc (dot) com/ClassificationofCotton/?Pg=4#Length].

Experimental Results

Eight different cotton lines were grown, and their fiber length was measured. The fibers UHM values are summarized in Table 11 herein below. The R square was calculated for each of the genes.

TABLE 11

Summary of the fiber length of the 8 different cotton lines

| Cotton variety | Length (UHM) | |
|---|---|---|
| | Mean | STD |
| SA 217 SD | 0.89 | 0.04 |
| SA 68 SD | 1.01 | 0.03 |
| Tamcot | 1.06 | 0.01 |
| DP 90 | 1.1 | 0.08 |
| ZG 236 | 1.15 | 0.00 |
| Coker 310 | 1.21 | 0.02 |
| S7 | 1.26 | 0.02 |
| Pima | 1.36 | 0.00 |

Table 11: Presented are the means and standard deviations (STD) of 8 different cotton lines.

Example 6

Production of Rice Transcriptome Using a 44K Rice Oligonucleotide Micro-Array

In order to produce differential expression analysis of rice plants subjected to nitrogen limiting conditions compared to normal (non-limiting) nitrogen conditions, the present inventors have utilized a Rice oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 rice genes and transcripts.

Experimental Procedures

Assessment of Rice Plants Grown Under Different Nitrogen Fertilization Levels—

Five rice accessions were grown in 3 repetitive plots, each containing 10 plants, at a net house under semi-hydroponics conditions. Briefly, the growing protocol was as follows: Rice seeds were sown in trays filled with a mix of vermiculite and peat in a 1:1 ratio. Constant nitrogen limiting conditions were achieved by irrigating the plants with a solution containing 0.8 mM inorganic nitrogen in the form of $KNO_3$, supplemented with 1 mM $KH_2PO_4$, 1 mM $MgSO_4$, 3.6 mM $K_2SO_4$ and microelements, while normal nitrogen levels were achieved by applying a solution of 8 mM inorganic nitrogen also in the form of $KNO_3$ with 1 mM $KH_2PO_4$, 1 mM $MgSO_4$, and microelements.

Analyzed Rice Tissues—

All 5 selected rice varieties were pooled in 1 batch per each treatment. Two tissues [leaves and roots] growing at two different nitrogen fertilization levels, 0.8 mM Nitrogen (nitrogen limiting conditions) or 8 mM Nitrogen (normal nitrogen conditions) were sampled and RNA was extracted as described above. For convenience, each micro-array expression information tissue type has received a Set ID as summarized in Table 12 below.

TABLE 12

Rice transcriptome expression sets

| Expression Set | Set ID |
|---|---|
| Leaves at 0.8 mM Nitrogen fertilization | A |
| Leaves at 8 mM Nitrogen fertilization | B |
| Roots at 0.8 mM Nitrogen fertilization | C |
| Roots at 8 mM Nitrogen fertilization | D |

Table 12.

Example 7

Production of Barley Transcriptome and High Throughput Correlation Analysis Using a 44K Barley Oligonucleotide Micro-Array In order to produce a high throughput correlation analysis comparing between plant phenotype and gene expression level, the present inventors utilized a Barley oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 47,500 Barley genes and transcripts. In order to define correlations between the levels of RNA expression and yield or vigor related parameters, various plant characteristics of 25 different Barley accessions were analyzed. Among them, 13 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed Barley Tissues—

Five tissues at different developmental stages [meristem, flower, booting spike, stem, flag leaf], representing different plant characteristics, were sampled and RNA was extracted as described above. Each micro-array expression information tissue type has received a Set ID as summarized in Table 13 below.

TABLE 13

Barley transcriptome expression sets

| Expression Set | Set ID |
|---|---|
| Meristem | A |
| Flower | B |
| Booting spike | C |
| Stem | D |
| Flag leaf | E |

Table 13.

Barley Yield Components and Vigor Related Parameters Assessment—

25 Barley accessions in 4 repetitive blocks (named A, B, C, and D), each containing 4 plants per plot were grown at net house. Plants were phenotyped on a daily basis following the standard descriptor of barley (Table 14, below). Harvest was conducted while 50% of the spikes were dry to avoid spontaneous release of the seeds. Plants were separated to the vegetative part and spikes, of them, 5 spikes were threshed (grains were separated from the glumes) for additional grain analysis such as size measurement, grain count per spike and grain yield per spike. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol:// rsbweb (dot) nih (dot) gov/]. Next, analyzed data was saved to text files and processed using the JMP statistical analysis software (SAS institute).

TABLE 14

Barley standard descriptors

| Trait | Parameter | Range | Description |
|---|---|---|---|
| Growth habit | Scoring | 1-9 | Prostrate (1) or Erect (9) |
| Hairiness of basal leaves | Scoring | P (Presence)/ A (Absence) | Absence (1) or Presence (2) |
| Stem pigmentation | Scoring | 1-5 | Green (1), Basal only or Half or more (5) |
| Days to Flowering | Days | | Days from sowing to emergence of awns |
| Plant height | Centimeter (cm) | | Height from ground level to top of the longest spike excluding awns |
| Spikes per plant | Number | | Terminal Counting |
| Spike length | Centimeter (cm) | | Terminal Counting 5 spikes per plant |
| Grains per spike | Number | | Terminal Counting 5 spikes per plant |
| Vegetative dry weight | Gram | | Oven-dried for 48 hours at 70° C. |
| Spikes dry weight | Gram | | Oven-dried for 48 hours at 30° C. |

Table 14.

Grains Per Spike—

At the end of the experiment (50% of the spikes were dry) all spikes from plots within blocks A-D were collected. The total number of grains from 5 spikes that were manually threshed was counted. The average grain per spike was calculated by dividing the total grain number by the number of spikes.

Grain Average Size (Cm)—

At the end of the experiment (50% of the spikes were dry) all spikes from plots within blocks A-D were collected. The total grains from 5 spikes that were manually threshed were scanned and images were analyzed using the digital imaging system. Grain scanning was done using Brother scanner (model DCP-135), at the 200 dpi resolution and analyzed with Image J software. The average grain size was calculated by dividing the total grain size by the total grain number.

Grain Average Weight (mgr)—

At the end of the experiment (50% of the spikes were dry) all spikes from plots within blocks A-D were collected. The total grains from 5 spikes that were manually threshed were counted and weight. The average weight was calculated by dividing the total weight by the total grain number.

Grain Yield Per Spike (GR)—

At the end of the experiment (50% of the spikes were dry) all spikes from plots within blocks A-D were collected. The total grains from 5 spikes that were manually threshed were weight. The grain yield was calculated by dividing the total weight by the spike number.

Spike Length Analysis—

At the end of the experiment (50% of the spikes were dry) all spikes from plots within blocks A-D were collected. The five chosen spikes per plant were measured using measuring tape excluding the awns.

Spike Number Analysis—

At the end of the experiment (50% of the spikes were dry) all spikes from plots within blocks A-D were collected. The spikes per plant were counted.

Growth Habit Scoring—

At the growth stage 10 (booting), each of the plants was scored for its growth habit nature. The scale that was used was 1 for prostate nature till 9 for erect.

Hairiness of Basal Leaves—

At the growth stage 5 (leaf sheath strongly erect; end of tillering), each of the plants was scored for its hairiness nature of the leaf before the last. The scale that was used was 1 for prostate nature till 9 for erect.

Plant Height—

At the harvest stage (50% of spikes were dry) each of the plants was measured for its height using measuring tape. Height was measured from ground level to top of the longest spike excluding awns.

Days to Flowering—

Each of the plants was monitored for flowering date. Days of flowering was calculated from sowing date till flowering date.

Stem Pigmentation—

At the growth stage 10 (booting), each of the plants was scored for its stem color. The scale that was used was 1 for green till 5 for full purple.

Vegetative Dry Weight and Spike Yield—

At the end of the experiment (50% of the spikes were dry) all spikes and vegetative material from plots within blocks A-D were collected. The biomass and spikes weight of each plot was separated, measured and divided by the number of plants.

Dry weight=total weight of the vegetative portion above ground (excluding roots) after drying at 70° C. in oven for 48 hours;

Spike yield per plant=total spike weight per plant (gr) after drying at 30° C. in oven for 48 hours.

Harvest Index (for Barley)—

The harvest index is calculated using Formula XIII

Harvest Index=Average spike dry weight per plant/ (Average vegetative dry weight per plant+Average spike dry weight per plant)  Formula XIII

TABLE 15

Barley correlated parameters (vectors)

| Correlated parameter (units) | Correlation ID |
|---|---|
| Grains per spike (numbers) | 1 |
| Grains size (mm$^2$) | 2 |

TABLE 15-continued

Barley correlated parameters (vectors)

| Correlated parameter (units) | Correlation ID |
| --- | --- |
| Grain weight (milligrams) | 3 |
| Grain Yield per spike (gr/spike) | 4 |
| Spike length (cm) | 5 |
| Spikes per plant (numbers) | 6 |
| Growth habit (scores 1-9) | 7 |
| Hairiness of basal leaves (scoring 1-2) | 8 |
| Plant height (cm) | 9 |
| Days to flowering (days) | 10 |
| Stem pigmentation (scoring 1-5) | 11 |
| Vegetative dry weight (gram) | 12 |
| Harvest Index (ratio) | 13 |

Table 15.

Experimental Results 13 different Barley accessions were grown and characterized for 13 parameters as described above. The average for each of the measured parameter was calculated using the JMP software and values are summarized in Tables 16 and 17 below. Subsequent correlation analysis between the various transcriptome sets (Table 13) and the average parameters, was conducted. Follow, results were integrated to the database.

TABLE 16

Measured parameters of correlation Ids in Barley accessions

| Accession/Parameter | 6 | 10 | 3 | 5 | 2 | 1 | 7 |
| --- | --- | --- | --- | --- | --- | --- | --- |
| Amatzya | 48.85 | 62.40 | 35.05 | 12.04 | 0.27 | 20.23 | 2.60 |
| Ashqelon | 48.27 | 64.08 | 28.06 | 10.93 | 0.23 | 17.98 | 2.00 |
| Canada park | 37.42 | 65.15 | 28.76 | 11.83 | 0.24 | 17.27 | 1.92 |
| Havarim stream | 61.92 | 58.92 | 17.87 | 9.90 | 0.17 | 17.73 | 3.17 |
| Jordan est | 33.27 | 63.00 | 41.22 | 11.68 | 0.29 | 14.47 | 4.33 |
| Klil | 41.69 | 70.54 | 29.73 | 11.53 | 0.28 | 16.78 | 2.69 |
| Maale Efraim | ND | 52.80 | 25.22 | 8.86 | 0.22 | 13.47 | 3.60 |
| Mt Arbel | 40.63 | 60.88 | 34.99 | 11.22 | 0.28 | 14.07 | 3.50 |
| Mt Harif | 62.00 | 58.10 | 20.58 | 11.11 | 0.19 | 21.54 | 3.00 |
| Neomi | 49.33 | 53.00 | 27.50 | 8.58 | 0.22 | 12.10 | 3.67 |
| Neot Kdumim | 50.60 | 60.40 | 37.13 | 10.18 | 0.27 | 14.36 | 2.47 |
| Oren canyon | 43.09 | 64.58 | 29.56 | 10.51 | 0.27 | 15.28 | 3.50 |
| Yeruham | 51.40 | 56.00 | 19.58 | 9.80 | 0.18 | 17.07 | 3.00 |

Table 16. Provided are the values of each of the parameters measured in Barley accessions according to the following correlation identifications (Correlation Ids):
6 = Spikes per plant;
10 = Days to flowering;
3 = Grain weight;
5 = Spike length;
2 = Grains Size;
1 = Grains per spike;
7 = Growth habit.

TABLE 17

Barley accessions, additional measured parameters

| Accession/Parameter | 8 | 9 | 4 | 11 | 12 | 13 |
| --- | --- | --- | --- | --- | --- | --- |
| Amatzya | 1.53 | 134.27 | 3.56 | 1.13 | 78.87 | 0.45 |
| Ashqelon | 1.33 | 130.50 | 2.54 | 2.50 | 66.14 | 0.42 |
| Canada park | 1.69 | 138.77 | 2.58 | 1.69 | 68.49 | 0.40 |
| Havarim stream | 1.08 | 114.58 | 1.57 | 1.75 | 53.39 | 0.44 |
| Jordan est | 1.42 | 127.75 | 3.03 | 2.33 | 68.30 | 0.43 |
| Klil | 1.69 | 129.38 | 2.52 | 2.31 | 74.17 | 0.40 |
| Maale Efraim | 1.30 | 103.89 | 1.55 | 1.70 | 35.35 | 0.52 |
| Mt Arbel | 1.19 | 121.63 | 2.62 | 2.19 | 58.33 | 0.48 |
| Mt Harif | 1.00 | 126.80 | 2.30 | 2.30 | 62.23 | 0.44 |
| Neomi | 1.17 | 99.83 | 1.68 | 1.83 | 38.32 | 0.49 |
| Neot Kdumim | 1.60 | 121.40 | 2.68 | 3.07 | 68.31 | 0.45 |
| Oren canyon | 1.08 | 118.42 | 2.35 | 1.58 | 56.15 | ND |
| Yeruham | 1.17 | 117.17 | 1.67 | 2.17 | 42.68 | ND |

Table 17. Provided are the values of each of the parameters measured in Barley accessions according to the following correlation identifications (Correlation Ids):
8 = Hairiness of basal leaves;
9 = Plant height;
4 = Grain yield per spike;
11 = Stem pigmentation;
12 = Vegetative dry weight;
13 = Harvest Index.

Example 8

Production of Barley Transcriptome and High Throughput Correlation Analysis Using 60K Barley Oligonucleotide Micro-Array In order to produce a high throughput correlation analysis comparing between plant phenotype and gene expression level, the present inventors utilized a Barley oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 60K Barley genes and transcripts. In order to define correlations between the levels of RNA expression and yield or vigor related parameters, various plant characteristics of 15 different Barley accessions were analyzed. Among them, 10 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed Barley Tissues—

Four tissues at different developmental stages [leaf, meristem, root tip and adventitious root], representing different plant characteristics, were sampled and RNA was extracted as described above. Each micro-array expression information tissue type has received a Set ID as summarized in Table 18 below.

TABLE 18

Barley transcriptome expression sets

| Expression Set | Set ID |
| --- | --- |
| Leaf/drought/reproductive | A |
| Leaf/drought/vegetative | B |
| Leaf/low N/TP3 | C |
| Leaf/normal/TP3 | D |
| Root tip/low N/TP3 | E |
| Root tip/normal/TP3 | F |
| Root tip/drought/vegetative | G |
| Root tip/recovery drought/vegetative | H |
| Adv root/low N/TP3 | I |
| Adv root/normal/TP3 | J |
| Meristem/drought/vegetative | K |
| Booting spike/drought/reproductive | L |
| Booting spike/low N/reproductive | M |
| Booting spike/normal/reproductive | N |
| Leaf/normal/reproductive | O |
| Leaf/low N/reproductive | P |

TABLE 18-continued

| Barley transcriptome expression sets | |
|---|---|
| Expression Set | Set ID |
| Stem/normal/reproductive | Q |
| Stem/low N/reproductive | R |

Table 18. Provided are the barley transcriptome expression sets.

Barley Yield Components and Vigor Related Parameters Assessment—

15 Barley accessions in 5 repetitive blocks, each containing 5 plants per pot were grown at net house. Three different treatments were applied: plants were regularly fertilized and watered during plant growth until harvesting (as recommended for commercial growth, plants were irrigated 2-3 times a week, and fertilization was given in the first 1.5 months of the growth period) or under low Nitrogen (80% percent less Nitrogen) or under drought stress (cycles of drought and re-irrigating were conducted throughout the whole experiment, overall 40% less water were given in the drought treatment). Plants were phenotyped on a daily basis following the parameters listed in Table 19 below. Harvest was conducted while all the spikes were dry. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

Grain Yield (gr.)—

At the end of the experiment all spikes of the pots were collected. The total grains from all spikes that were manually threshed were weighted. The grain yield was calculated by per plot or per plant.

Spike Length and Width Analysis—

At the end of the experiment the length and width of five chosen spikes per plant were measured using measuring tape excluding the awns.

Spike Number Analysis—

The spikes per plant were counted.

Plant Height—

Each of the plants was measured for its height using measuring tape. Height was measured from ground level to top of the longest spike excluding awns at two time points at the Vegetative growth (30 days after sowing) and at harvest.

Spike Weight—

The biomass and spikes weight of each plot was separated, measured and divided by the number of plants.

Dry weight=total weight of the vegetative portion above ground (excluding roots) after drying at 70° C. in oven for 48 hours at two time points at the Vegetative growth (30 days after sowing) and at harvest.

Spikelet per spike=number of spikelets per spike was counted.

Root/Shoot Ratio—

The Root/Shoot Ratio is calculated using Formula XIV.

$$\text{Root/Shoot Ratio=total weight of the root at harvest/total weight of the vegetative portion above ground at harvest.} \quad \text{Formula XIV}$$

Total No. Of Tillers— all tillers were counted per plot at two time points at the Vegetative growth (30 days after sowing) and at harvest.

Percent of Reproductive Tillers— the number of reproductive tillers barring a spike at harvest was divided by the total numbers of tillers.

SPAD—

Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), Root Length (cm) and No. of Lateral Roots—

3 plants per plot were selected for measurement of root weight, root length and for counting the number of lateral roots formed.

Shoot FW (Fresh Weight)— weight of 3 plants per plot were recorded at different time-points.

Average Grain Area ($cm^2$)

At the end of the growing period the grains were separated from the spike. A sample of ~200 grains was weighted, photographed and images were processed using the below described image processing system. The grain area was measured from those images and was divided by the number of grains.

Average Grain Length and Width (cm)—

At the end of the growing period the grains were separated from the spike. A sample of ~200 grains was weighted, photographed and images were processed using the below described image processing system. The sum of grain lengths or width (longest axis) was measured from those images and was divided by the number of grains Average Grain Perimeter (Cm)—

At the end of the growing period the grains were separated from the spike. A sample of ~200 grains was weighted, photographed and images were processed using the below described image processing system. The sum of grain perimeter was measured from those images and was divided by the number of grains.

Heading Date— the day in which booting stage was observed was recorded and number of days from sowing to heading was calculated.

Relative Water Content—

Fresh weight (FW) of three leaves from three plants each from different seed ID was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) is calculated according to Formula I above.

Harvest Index (for Barley)—

The harvest index is calculated using Formula XIII above.

Relative Growth Rate:

the relative growth rate (RGR) of Plant Height (Formula XV below), SPAD (Formula XVI) and number of tillers (Formula XVII) were calculated as follows:

$$\text{Relative growth rate of plant height=Regression coefficient of plant height along time course.} \quad \text{Formula XV}$$

$$\text{Relative growth rate of SPAD=Regression coefficient of SPAD measurements along time course.} \quad \text{Formula XVI}$$

$$\text{Relative growth rate of Number of tillers=Regression coefficient of Number of tillers along time course.} \quad \text{Formula XVII}$$

Ratio Drought/Normal:

Represents ratio for the specified parameter of Drought condition results divided by Normal conditions results (maintenance of phenotype under drought in comparison to normal conditions).

TABLE 19

Barley correlated parameters (vectors)

| Correlation set | Correlation ID |
|---|---|
| Lateral roots per plant vegetative [number] Drought | 1 |
| Lateral roots per plant at TP3 [number] Low N | 2 |
| Lateral roots per plant at TP3 [number] Normal | 3 |
| Lateral roots per plant vegetative [number] Ratio Drought/Normal | 4 |
| Root DW per plant [gr.]/Shoot DW [gr.] per plant Drought | 5 |
| Root DW per plant [gr.]/Shoot DW [gr.] per plant Ratio Drought/Normal | 6 |
| Root DW per plant vegetative stage [gr.] Drought | 7 |
| Root DW per plant vegetative stage [gr.] Ratio Drought/Normal | 8 |
| Root FW per plant vegetative stage [gr.] Drought | 9 |
| Root FW per plant at vegetative stage [gr.] Low N | 10 |
| Root FW per plant at vegetative stage [gr.] Normal | 11 |
| Root FW per plant vegetative stage [gr.] Ratio Drought/Normal | 12 |
| Root length per plant vegetative [cm] Drought | 13 |
| Root length per plant at vegetative stage [cm] Low N | 14 |
| Root length per plant at vegetative stage [cm] Normal | 15 |
| Root length per plant vegetative [cm] Ratio Drought/Normal | 16 |
| Leaf Area at TP4 [cm$^2$] Low N | 17 |
| Leaf Area at TP4 [cm$^2$] Normal | 18 |
| Leaf maximal length at TP4 [mm] Low N | 19 |
| Leaf maximal length at TP4 [mm] Normal | 20 |
| Leaf maximal width at TP4 [mm] Low N | 21 |
| Leaf maximal width at TP4 [mm] Normal | 22 |
| Number of leaves per plant at TP4 [number] Low N | 23 |
| Number of leaves per plant at TP4 [number] Normal | 24 |
| Shoot DW at vegetative stage [gr.] Drought | 25 |
| Shoot DW at vegetative stage [gr.] Ratio Drought/Normal | 26 |
| Shoot DW at harvest per plant [gr.] Drought | 27 |
| Shoot DW at harvest per plant [gr.] Drought Ratio Drought/Normal | 28 |
| Shoot FW per plant at harvest [gr.] Drought | 29 |
| Shoot FW per plant at vegetative stage [gr.] Normal | 30 |
| Shoot FW per plant at harvest [gr.] Ratio Drought/Normal | 31 |
| Shoot FW per plant at vegetative stage [gr.] Low N | 32 |
| Chlorophyll level vegetative stage [SPAD] Drought | 33 |
| Chlorophyll level at vegetative stage [SPAD] Normal | 34 |
| Chlorophyll level at vegetative stage [SPAD] Ratio Drought/Normal | 35 |
| Chlorophyll level at vegetative stage [SPAD] Low N | 36 |
| RGR by chlorophyll levels Drought | 37 |
| RGR by chlorophyll levels vegetative stage Ratio Drought/normal | 38 |
| Shoot DW at harvest [gr.] Normal | 39 |
| Plant height per plant at vegetative stage [cm] Low N | 40 |
| Plant height per plot at harvest [cm] Drought | 41 |
| Plant height per plot at harvest [cm] Normal | 42 |
| Plant height per plot at harvest [cm] Ratio Drought/Normal | 43 |
| Plant height per plot at harvest [cm] Low N | 44 |
| RGR by plant height Drought | 45 |
| Relative water content vegetative [percent] Drought | 46 |
| Relative water content vegetative stage [percent] Ratio Drought/Normal | 47 |
| Tillers per plant at vegetative stage [number] Low N | 48 |
| Tillers per plant at vegetative stage [number] Normal | 49 |
| Tillers per plant at harvest [number] Drought | 50 |
| Tillers per plot at harvest [number] Normal | 51 |
| Tillers per plot at harvest [number] Ratio Drought/Normal | 52 |
| Tillers per plot at harvest [number] Low N | 53 |
| Harvest index [number] Drought | 54 |
| Harvest index [number] Ratio Drought/Normal | 55 |
| Spike length [cm] Drought | 56 |
| Spike length [cm] Normal | 57 |
| Spike length [cm] Ratio Drought/Normal | 58 |
| Spike length [cm] Low N | 59 |
| Spike width [mm] Drought | 60 |
| Spike width [mm] Normal | 61 |
| Spike width [mm] Ratio Drought/Normal | 62 |
| Spike width [mm] Low N | 63 |
| Spikes per plant [number] Drought | 64 |
| Spikes per plot [number] Normal | 65 |
| Spikes per plant [number] Ratio Drought/Normal | 66 |
| Spikes per plot [number] Low N | 67 |
| Spikes yield per plant [gr.] Drought | 68 |
| Spikes yield per plot [gr.] Normal | 69 |

TABLE 19-continued

| Barley correlated parameters (vectors) | |
|---|---|
| Correlation set | Correlation ID |
| Spikes yield per plant [gr.] Ratio Drought/Normal | 70 |
| Spikes yield per plot [gr.] Low N | 71 |
| Grain yield per plant [gr.] Drought | 72 |
| Grain yield per plot [gr.] Normal | 73 |
| Grain yield per plant [gr.] Ratio Drought/Normal | 74 |
| Grain yield per plot [gr.] Low N | 75 |
| Grains per plant [number] Drought | 76 |
| Grains per plot [number] Normal | 77 |
| Grains per plant [number] Ratio Drought/Normal | 78 |
| Grains per plot [number] Low N | 79 |
| Shoot/root Normal | 80 |
| Shoot/root low N | 81 |
| Shoot DW at harvest [gr.] low N | 82 |
| Roots DW [gr.] Normal | 83 |
| Roots DW [gr.] low N | 84 |
| Spikelet per spike [number] Normal | 85 |
| Spikelet per spike [number] Low N | 86 |
| Grain area [cm2] Normal | 87 |
| Grain area [cm2] low N | 88 |
| Grain length [cm] Normal | 89 |
| Grain length [cm] low N | 90 |
| Grain perimeter [cm] Normal | 91 |
| Grain perimeter [cm] low N | 92 |
| Grain width [cm] Normal | 93 |
| Grain width [cm] low N | 94 |
| Ratio Grains DW/shoots DW Normal | 95 |
| Ratio Grains DW/shoots DW low N | 96 |
| Grain yield per plant [gr.] Normal | 97 |
| Grain yield per plant [gr.] low N | 98 |
| Heading date [days] Drought | 99 |
| Heading date [days] Ratio Drought/Normal | 100 |
| Percent of reproductive tillers [percent] low N | 101 |
| Percent of reproductive tillers [percent] Normal | 102 |

Table 19. Provided are the barley correlated parameters. "TP" = time point; "DW" = dry weight; "FW" = fresh weight; "Low N" = Low Nitrogen; "Relative water content [percent] Ratio Drought/Normal" - maintenance of phenotype under drought in comparison to normal conditions Experimental Results 15 different Barley accessions were grown and characterized for different parameters as described above. Table 19 describes the Barley correlated parameters. The average for each of the measured parameter was calculated using the JMP software and values are summarized in Tables 20-29 below. Subsequent correlation analysis between the various transcriptome sets and the average parameters was conducted. Follow, results were integrated to the database.

TABLE 20

| Measured parameters of correlation IDs in Barley accessions under Drought conditions | | | | | | | | |
|---|---|---|---|---|---|---|---|---|
| Corr. ID/Line | 2 | 4 | 6 | 8 | 9 | 10 | 11 | 13 |
| 54 | 0.686 | 0.6 | 0.286 | 0.439 | 0.78 | 0.474 | 0.66 | 0.526 |
| 25 | 0.169 | 0.249 | 0.132 | 0.187 | 0.218 | 0.215 | 0.21 | |
| 46 | 69.8 | 87.4 | 58.3 | 80.6 | 73.1 | 80.6 | 53.4 | 55.9 |
| 99 | 90 | 90 | 90 | 81.6 | 90 | 75 | 71 | 65 |
| 5 | 0.02 | 0.012 | 0.023 | 0.012 | 0.012 | 0.013 | 0.012 | 0.008 |
| 45 | 0.939 | 0.774 | 0.388 | 0.884 | −0.13 | 0.273 | 0.856 | 0.733 |
| 37 | −0.072 | −0.063 | −0.004 | −0.072 | 0.025 | 0.087 | −0.123 | 0.001 |
| 76 | 252 | 348 | 71.5 | 160 | 377 | 170 | 268 | 111 |
| 72 | 7.75 | 8.5 | 2.05 | 5.38 | 11 | 5.55 | 9.8 | 3.55 |
| 41 | 48 | 40.8 | 47.4 | 64.8 | 52.6 | 46 | 52.8 | 35 |
| 64 | 3.43 | 8.55 | 3.05 | 4.07 | 3.72 | 4.2 | 4.36 | 7.6 |
| 56 | 15.6 | 16 | 14.2 | 14.8 | 16.5 | 16.7 | 16.8 | 13.3 |
| 60 | 7.62 | 6.06 | 7.84 | 7.81 | 8.35 | 8.64 | 9.07 | 7.82 |
| 68 | 15 | 22 | 11.7 | 18.8 | 21 | 17.7 | 24.2 | 18.2 |
| 50 | 8.78 | 13.9 | 8.45 | 9.15 | 5.12 | 11.7 | 9.04 | 10.9 |
| 27 | 3.55 | 5.67 | 5.12 | 6.86 | 3.11 | 6.15 | 5.05 | 3.2 |
| 7 | 70.7 | 66.2 | 117 | 84.1 | 37.5 | 77.5 | 60.2 | 27.1 |
| 13 | 18.3 | 21.7 | 17 | 15.2 | 27 | 21.7 | 20.3 | 22 |
| 1 | 6.67 | 6 | 6.33 | 7 | 7 | 8.33 | 8.67 | 7.33 |
| 9 | 1.68 | 1.45 | 0.583 | 0.633 | 1.07 | 2.07 | 1.48 | 1.12 |

TABLE 20-continued

Measured parameters of correlation IDs in Barley
accessions under Drought conditions

| Corr. ID/Line | 2 | 4 | 6 | 8 | 9 | 10 | 11 | 13 |
|---|---|---|---|---|---|---|---|---|
| 33 | 39.7 | 42.1 | 42.4 | 42.3 | 36.8 | 41.3 | 33.6 | 36.6 |
| 29 | 1.22 | 1.88 | 0.9 | 0.9 | 1.43 | 1.9 | 1.52 | 1.17 |

Table 20. Provided are the values of each of the parameters (as described above) measured in Barley accessions (line) under drought growth conditions. Growth conditions are specified in the experimental procedure section.

TABLE 21

Measured parameters of correlation IDs in additional Barley accessions under Drought conditions

| Corr. ID/Line | 15 | 31 | 38 | 50 | 53 | 93 | 13s |
|---|---|---|---|---|---|---|---|
| 54 | 0.526 | 0.687 | 0.752 | 0.809 | 0.869 | 0.406 | 0.687 |
| 46 | 43.2 | 45.5 | 76.5 | | | | |
| 99 | 66.8 | 90 | | | | | |
| 5 | 0.025 | 0.008 | 0.008 | 0.007 | 0.016 | 0.026 | 0.006 |
| 45 | 0.401 | 0.699 | 0.713 | 0.8 | 0.915 | 0.198 | 0.881 |
| 37 | 0.037 | 0.013 | 0.003 | 0.035 | 0.05 | −0.063 | 0.01 |
| 76 | 154 | 288 | 274 | 358 | 521 | 105 | 205 |
| 72 | 5.28 | 9.92 | 10.2 | 14 | 17.5 | 2.56 | 7.2 |
| 41 | 45.2 | 37.7 | 41.2 | 49.9 | 43 | 32 | 38 |
| 64 | 4.92 | 6.9 | 5.8 | 9.67 | 5.42 | 3.21 | 8.44 |
| 56 | 14.2 | 15.7 | 17.5 | 18.3 | 17.4 | 12.7 | 13.5 |
| 60 | 8.74 | 6.98 | 8.05 | 6.72 | 9.55 | 5.47 | 7.32 |
| 68 | 19.5 | 23.4 | 28.2 | 33 | 34.8 | 9.88 | 18 |
| 50 | 10.3 | 13 | 7.44 | 11 | 6.78 | 16.1 | 10.2 |
| 27 | 4.76 | 4.52 | 3.38 | 3.31 | 2.65 | 3.74 | 3.28 |
| 7 | 117 | 37.3 | 25.6 | 22.1 | 41.1 | 98.9 | 18.6 |
| 13 | 20.7 | 21 | 20.3 | 19.7 | 16.7 | 15 | 24 |
| 1 | 6.67 | 7.67 | 6.67 | 8.67 | 7.67 | 6.67 | 7.67 |
| 9 | 1.67 | 1.62 | 0.85 | 1.38 | 0.817 | 0.7 | 1.87 |
| 33 | 45.1 | 38.3 | 36.2 | 31.8 | 33.5 | 40.6 | 40.5 |
| 29 | 1.9 | 1.75 | 1.58 | 1.73 | 1 | 0.833 | 1.95 |

Table 21. Provided are the values of each of the parameters (as described above) measured in Barley accessions (line) under drought growth conditions. Growth conditions are specified in the experimental procedure section.

TABLE 22

Additional measured parameters of correlation IDs in Barley accessions under Drought conditions

| Corr. ID/Line | 2 | 4 | 6 | 8 | 9 | 10 | 11 | 13 |
|---|---|---|---|---|---|---|---|---|
| 78 | 0.21 | 0.25 | 0.1 | 0.1 | 0.28 | 0.12 | 0.22 | 0.11 |
| 74 | 0.14 | 0.14 | 0.07 | 0.07 | 0.2 | 0.08 | 0.17 | 0.06 |
| 43 | 0.59 | 0.66 | 0.64 | 0.79 | 0.56 | 0.51 | 0.61 | 0.67 |
| 66 | 0.62 | 1.09 | 0.49 | 0.65 | 0.99 | 0.73 | 0.96 | 1.11 |
| 58 | 0.94 | 0.78 | 0.77 | 0.86 | 0.97 | 0.83 | 0.82 | 0.86 |
| 62 | 0.66 | 0.74 | 0.79 | 0.72 | 0.72 | 0.75 | 0.77 | 0.68 |
| 70 | 0.18 | 0.22 | 0.18 | 0.18 | 0.27 | 0.16 | 0.23 | 0.19 |
| 28 | 0.54 | 0.77 | 0.42 | 0.65 | 0.52 | 0.61 | 0.45 | 0.59 |
| 8 | 1.06 | 0.88 | 0.77 | 0.85 | 1.06 | 0.94 | 0.44 | 0.66 |
| 16 | 0.76 | 1.12 | 0.82 | 0.43 | 0.71 | 0.66 | 0.74 | 1.16 |
| 4 | 0.65 | 0.58 | 0.95 | 0.78 | 0.66 | 1.09 | 0.74 | 0.79 |
| 12 | 0.81 | 0.85 | 1.06 | 0.3 | 0.44 | 1.1 | 1 | 1.02 |
| 52 | 1.61 | 1.75 | 1.33 | 1.4 | 1.22 | 1.87 | 1.57 | 1.72 |
| 35 | 0.95 | 0.93 | 0.96 | 1.01 | 0.93 | 0.98 | 0.72 | 1.3 |
| 31 | 0.47 | 0.74 | 0.72 | 0.37 | 0.4 | 0.6 | 0.5 | 0.47 |
| 26 | 0.65 | 1.01 | 0.94 | | 0.7 | 0.93 | 0.71 | |
| 47 | 0.56 | 0.5 | | 0.78 | 0.55 | 0.78 | 0.58 | 0.9 |
| 55 | 0.77 | 0.67 | 0.41 | 0.5 | 0.87 | 0.54 | 0.79 | 0.58 |
| 6 | 1.97 | 1.14 | 1.84 | 1.31 | 2.06 | 1.55 | 0.97 | 1.12 |

Table 22. Provided are the values of each of the parameters (as described above) measured in Barley accessions (line) under drought growth conditions. Growth conditions are specified in the experimental procedure section.

TABLE 23

Additional measured parameters of correlation IDs in additional Barley accessions under Drought conditions

| Corr. ID/Line | 15 | 31 | 38 | 50 | 53 | 93 | 13s |
|---|---|---|---|---|---|---|---|
| 78 | 0.17 | 0.22 | 0.24 | 0.58 | 0.43 | 0.43 | 0.19 |
| 74 | 0.15 | 0.15 | 0.2 | 0.47 | 0.32 | 0.32 | 0.14 |
| 43 | 0.61 | 0.7 | 0.63 | 0.87 | 0.86 | 0.51 | 0.72 |
| 66 | 0.83 | 0.87 | 1.12 | 1.09 | 0.92 | 0.52 | 1.3 |
| 58 | 0.78 | 0.83 | 0.89 | 0.94 | 0.88 | 0.78 | 0.77 |
| 62 | 0.87 | 0.75 | 0.74 | 0.86 | 0.85 | 0.88 | 0.67 |
| 70 | 0.25 | 0.23 | 0.34 | 0.68 | 0.55 | 0.25 | 0.23 |
| 28 | 0.41 | 0.75 | 0.65 | 0.8 | 0.68 | 0.46 | 0.67 |
| 8 | 0.71 | 0.5 | 0.62 | 0.87 | 0.94 | 0.68 | 0.37 |
| 16 | 0.76 | 0.68 | 0.77 | 0.56 | 0.42 | 0.8 | 0.78 |
| 4 | 0.71 | 0.85 | 0.77 | 0.96 | 0.88 | 0.87 | 0.88 |
| 12 | 0.8 | 1.13 | 0.34 | 0.58 | 0.07 | 0.93 | 1.67 |
| 52 | 1.6 | 1.63 | 1.59 | 1.33 | 1.62 | 1.96 | 1.8 |
| 35 | 1.03 | 0.82 | 0.93 | 0.8 | 0.94 | 1.03 | 1.06 |
| 31 | 0.46 | 0.58 | 0.62 | | 0.81 | | 0.68 |
| 26 | | | 0.92 | | | | |
| 47 | 0.65 | 0.78 | 0.83 | | | | |
| 55 | 0.7 | 0.75 | 0.83 | 0.92 | 0.93 | 0.82 | 0.75 |
| 6 | 1.72 | 0.67 | 0.96 | 1.08 | 1.38 | 1.46 | 0.56 |

Table 23. Provided are the values of each of the parameters (as described above) measured in Barley accessions (line) under drought growth conditions. Growth conditions are specified in the experimental procedure section.

TABLE 24

Measured parameters of correlation IDs in Barley accessions under normal conditions

| Corr. ID/Line | 10 | 11 | 13 | 15 | 2 | 31 | 38 | 4 |
|---|---|---|---|---|---|---|---|---|
| 85 | 6 | 6 | 6 | 6 | 6 | 2.8 | 6 | 2 |
| 80 | 1.48 | 0.64 | 0.84 | 0.82 | 1.15 | 0.69 | 1.26 | 0.72 |
| 69 | 69.8 | 39.9 | 69.4 | 59.7 | 60.8 | 79.1 | 63.5 | 62.7 |
| 65 | 38.6 | 32 | 41.5 | 38 | 34.2 | 45.6 | 30 | 49.8 |
| 39 | 89.2 | 99.7 | 45.8 | 49.4 | 74.3 | 55.1 | 47.3 | 60.3 |
| 87 | 0.25 | 0.24 | 0.24 | 0.23 | 0.24 | 0.25 | 0.24 | 0.22 |
| 89 | 0.89 | 0.87 | 0.86 | 0.80 | 0.83 | 0.78 | 0.90 | 0.72 |
| 91 | 2.24 | 2.24 | 2.18 | 2.05 | 2.08 | 2.03 | 2.25 | 1.88 |
| 93 | 0.35 | 0.35 | 0.35 | 0.37 | 0.37 | 0.41 | 0.35 | 0.39 |
| 95 | 0.40 | 0.16 | 1.01 | 0.79 | 0.41 | 0.99 | 0.67 | 0.61 |
| 77 | 683 | 510 | 1090 | 768 | 621 | 1070 | 988 | 903 |
| 97 | 6.65 | 3.96 | 9.27 | 7.65 | 6.06 | 10.8 | 7.94 | 7.4 |
| 73 | 33.2 | 19.8 | 46.4 | 38.3 | 30.3 | 54.1 | 39.7 | 37 |
| 83 | 118 | 151 | 86.3 | 85.2 | 120 | 90.7 | 40.6 | 90.5 |

Table 24. Provided are the values of each of the parameters (as described above) measured in Barley accessions (line) under normal growth conditions. Growth conditions are specified in the experimental procedure section.

TABLE 25

Measured parameters of correlation IDs in additional Barley accessions normal conditions

| Corr. ID/Line | 50 | 53 | 6 | 8 | 9 | 93 | s13 |
|---|---|---|---|---|---|---|---|
| 85 | 2 | 5.2 | 6 | 6 | 6 | 4.67 | 4 |
| 80 | 1.17 | 0.71 | 0.38 | 0.51 | 2.16 | 0.67 | 0.40 |
| 69 | 50.3 | 60 | 34.9 | 60.1 | 55.9 | 16.9 | 21.7 |
| 65 | 71.4 | 28 | 36 | 27.6 | 23.6 | 54.7 | 48 |
| 39 | 88 | 38.9 | 97.7 | 48.3 | 62.5 | 58 | 72.8 |
| 87 | 0.23 | 0.22 | 0.24 | 0.21 | 0.18 | 0.19 | 0.17 |
| 89 | 0.82 | 0.79 | 0.80 | 0.80 | 0.65 | 0.82 | 0.77 |
| 91 | 2.09 | 2.03 | 2.02 | 1.98 | 1.69 | 1.98 | 1.89 |
| 93 | 0.36 | 0.36 | 0.37 | 0.34 | 0.35 | 0.29 | 0.29 |
| 95 | 0.28 | 1.04 | 0.12 | 0.86 | 0.58 | 0.05 | 0.08 |
| 77 | 582 | 904 | 242 | 928 | 984 | 158 | 263 |
| 97 | 4.52 | 8.41 | 2 | 8.05 | 7.07 | 0.747 | 1.14 |
| 73 | 22.6 | 39.7 | 10.8 | 40.3 | 35.4 | 3.73 | 5.67 |
| 83 | 92.6 | 64 | 287 | 95.8 | 34 | 121 | 207 |

Table 25. Provided are the values of each of the parameters (as described above) measured in Barley accessions (line) under normal growth conditions. Growth conditions are specified in the experimental procedure section.

TABLE 26

Additional measured parameters of correlation IDs in Barley accessions under normal conditions

| Corr. ID/Line | 11 | 13 | 15 | 2 | 31 | 4 | 50 | 53 | 6 | 9 |
|---|---|---|---|---|---|---|---|---|---|---|
| 42 | 84 | 64.7 | 66.2 | 72 | 56.6 | 65.8 | 82 | 62.8 | 67.4 | 91.6 |
| 61 | 19.2 | 16.5 | 16.1 | 17.2 | 19.1 | 20.3 | 20.4 | 21.7 | 18.3 | 16.5 |
| 57 | 9.05 | 9.54 | 10.3 | 10.5 | 8.83 | 7.38 | 6.55 | 10.4 | 8.25 | 10.2 |
| 51 | 41.6 | 46.7 | 38.8 | 34.6 | 48.6 | 49.2 | 48.8 | 29 | 40 | 27.5 |
| 15 | 15 | 21.3 | 15.2 | 27.2 | 16 | 24 | 20.3 | 13.5 | 21.8 | 21.5 |
| 3 | 8.67 | 7 | 9.67 | 10.7 | 9.67 | 9.67 | 9.67 | 8.67 | 8.33 | 10 |
| 11 | 0.27 | 0.27 | 0.27 | 0.62 | 0.27 | 0.35 | 0.35 | 0.32 | 0.25 | 0.23 |
| 49 | 2 | 2 | 1.67 | 2.33 | 3.33 | 2.33 | 2.33 | 1.33 | 1 | 1.33 |
| 34 | 41.4 | 39.1 | 36.8 | 34.2 | 42.8 | 37 | 33.7 | 36.9 | 35.2 | 35 |
| 30 | 1.9 | 2.17 | 1.82 | 15.6 | 3.02 | 2.58 | 3 | 1.75 | 1.25 | 2.18 |
| 24 | 18.2 | 24.2 | 22 | 23.2 | 28.3 | 22.2 | 25.5 | 19 | 22.7 | 17.3 |
| 18 | 199 | 294 | 296 | 313 | 309 | 259 | 276 | 291 | 273 | 299 |
| 22 | 5.45 | 5.77 | 6.03 | 4.63 | 5.33 | 5.83 | 6.03 | 5.43 | 5.8 | 5.75 |
| 20 | 348 | 502 | 470 | 535 | 551 | 479 | 594 | 399 | 499 | 384 |

Table 26. Provided are the values of each of the parameters (as described above) measured in Barley accessions (line) under normal growth conditions. Growth conditions are specified in the experimental procedure section.

TABLE 27

Measured parameters of correlation IDs in additional Barley accessions under Low N conditions

| Corr. ID/Line | 10 | 11 | 13 | 15 | 2 | 31 | 38 | 4 |
|---|---|---|---|---|---|---|---|---|
| 88 | 0.25 | 0.25 | 0.26 | 0.24 | 0.25 | 0.23 | 0.23 | 0.21 |
| 90 | 0.90 | 0.92 | 0.93 | 0.82 | 0.86 | 0.76 | 0.83 | 0.74 |
| 92 | 2.28 | 2.33 | 2.28 | 2.08 | 2.13 | 1.96 | 2.09 | 1.88 |
| 94 | 0.35 | 0.35 | 0.35 | 0.36 | 0.37 | 0.38 | 0.35 | 0.36 |
| 96 | 0.39 | 0.42 | 1.25 | 0.69 | 0.43 | 0.87 | 0.77 | 0.53 |
| 79 | 153 | 165 | 230 | 125 | 100 | 223 | 159 | 219 |
| 98 | 1.34 | 1.46 | 1.95 | 1.26 | 1.13 | 1.95 | 1.28 | 1.47 |
| 75 | 6.68 | 7.31 | 9.76 | 6.29 | 5.67 | 9.74 | 6.40 | 7.35 |
| 84 | 39.9 | 26.2 | 17.3 | 32.9 | 33.9 | 83.8 | 29.6 | 37.2 |
| 86 | 6 | 6 | 6 | 6 | 6 | 2 | 6 | 2 |
| 81 | 0.69 | 1.08 | 0.77 | 0.38 | 0.83 | 0.42 | 0.29 | 0.57 |
| 71 | 11.40 | 13.40 | 13.70 | 10.60 | 11.30 | 15.10 | 11.60 | 12.20 |
| 67 | 10.8 | 9 | 12.2 | 8.4 | 7.8 | 14.5 | 8.4 | 15 |
| 53 | 16 | 14.6 | 16.2 | 14 | 12.5 | 18.8 | 11.6 | 21.2 |
| 82 | 17.40 | 17.80 | 8.25 | 7.28 | 13.20 | 11.30 | 8.95 | 14.20 |

Provided are the values of each of the parameters (as described above) measured in Barley accessions (line) under low nitrogen growth conditions. Growth conditions are specified in the experimental procedure section.

TABLE 28

Measured parameters of correlation IDs in additional Barley accessions under Low N conditions

| | Line | | | | | | |
|---|---|---|---|---|---|---|---|
| Corr. ID | 50 | 53 | 6 | 8 | 9 | 93 | s13 |
| 88 | 0.24 | 0.20 | 0.22 | 0.23 | 0.19 | 0.19 | 0.17 |
| 90 | 0.86 | 0.73 | 0.81 | 0.85 | 0.68 | 0.81 | 0.79 |
| 92 | 2.19 | 1.88 | 2.03 | 2.11 | 1.77 | 2.00 | 1.90 |
| 94 | 0.35 | 0.35 | 0.35 | 0.35 | 0.36 | 0.30 | 0.28 |
| 96 | 0.34 | 0.87 | 0.15 | 0.58 | 0.76 | 0.05 | 0.07 |
| 79 | 134 | 134 | 88.2 | 174 | 202 | 86.7 | 61.6 |
| 98 | 0.98 | 1.16 | 0.92 | 1.33 | 1.57 | 0.29 | 0.22 |
| 75 | 5.06 | 5.43 | 4.62 | 6.67 | 7.83 | 1.44 | 1.12 |
| 84 | 44.4 | 14.5 | 41.5 | 23.7 | 20.9 | 49.7 | 54 |
| 86 | 2 | 5.2 | 6 | 6 | 6 | 2 | 2 |
| 81 | 0.60 | 0.55 | 2.88 | 1.36 | 0.89 | 2.49 | 0.40 |
| 71 | 11.60 | 8.76 | 9.15 | 12.40 | 12.20 | 5.68 | 5.04 |
| 67 | 25 | 7 | 11.6 | 7.6 | 5.4 | 16.4 | 12 |
| 53 | 23.5 | 11 | 16 | 10.8 | 6.75 | 35 | |
| 82 | 15.70 | 6.42 | 55.90 | 11.50 | 10.90 | 58.90 | 17.10 |

Table 28. Provided are the values of each of the parameters (as described above) measured in Barley accessions (line) under low nitrogen growth conditions. Growth conditions are specified in the experimental procedure section.

TABLE 29

Additional measured parameters of correlation IDs in Barley accessions under Low N conditions

| Corr. ID | Line | | | | | | | | | |
|---|---|---|---|---|---|---|---|---|---|---|
| | 11 | 13 | 15 | 2 | 31 | 4 | 50 | 53 | 6 | 9 |
| 36 | 23.3 | 24 | 26.1 | 26.6 | 23.2 | 25.4 | 23.9 | 24.2 | 26.5 | 25 |
| 10 | 0.23 | 0.38 | 0.55 | 0.88 | 0.50 | 0.43 | 0.40 | 0.32 | 0.12 | 0.30 |
| 32 | 0.43 | 0.43 | 0.62 | 0.78 | 0.53 | 0.45 | 0.58 | 0.43 | 0.33 | 0.50 |
| 63 | 8.13 | 7.95 | 9.40 | 9.60 | 7.16 | 7.06 | 4.94 | 8.51 | 9.43 | 10.00 |
| 14 | 21.7 | 24.7 | 24.5 | 22.2 | 23 | 30.5 | 21.7 | 22.8 | 22 | 23.8 |
| 44 | 82 | 41 | 44.6 | 65.8 | 47.8 | 53.8 | 59.4 | 56.4 | 61.4 | 81.8 |
| 59 | 19.6 | 15.2 | 16.6 | 90.2 | 16.4 | 20.4 | 19.3 | 18.8 | 16.3 | 18.8 |
| 40 | 18.8 | 16.3 | 19.2 | 22.5 | 18.2 | 19.7 | 26 | 19.8 | 17.3 | 19.2 |
| 23 | 8 | 8 | 10 | 10 | 11.5 | 8.6 | 8.5 | 6.33 | 7.5 | 7.5 |
| 2 | 6 | 5 | 7.33 | 6.33 | 6 | 6.67 | 6 | 4.67 | 4.33 | 5.67 |
| 21 | 5.17 | 5.25 | 5.10 | 5.20 | 5.33 | 5.32 | 5.30 | 5.10 | 5.12 | 5.15 |
| 19 | 108 | 103 | 135 | 152 | 149 | 124 | 142 | 95 | 112 | 124 |
| 17 | 46.3 | 39.4 | 57.9 | 67.8 | 64.2 | 52.4 | 57.1 | 46.2 | 51.5 | 68 |

Table 29. Provided are the values of each of the parameters (as described above) measured in Barley accessions (line) under low nitrogen growth conditions. Growth conditions are specified in the experimental procedure section.

Example 9

Production of *Sorghum* Transcriptome and High Throughput Correlation Analysis with Yield, Nue, and Abst Related Parameters Measured in Fields Using 44K *Sorghum* Oligonucleotide Micro-Arrays In order to produce a high throughput correlation analysis between plant phenotype and gene expression level, the present inventors utilized a *sorghum* oligonucleotide microarray, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 *sorghum* genes and transcripts. In order to define correlations between the levels of RNA expression with ABST, yield and NUE components or vigor related parameters, various plant characteristics of 17 different *sorghum* hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of *Sorghum* Varieties Across Ecotypes Grown Under Regular Growth Conditions, Severe Drought Conditions and Low Nitrogen Conditions Experimental Procedures 17 *Sorghum* varieties were grown in 3 repetitive plots, in field. Briefly, the growing protocol was as follows:

1. Regular Growth Conditions:

*Sorghum* plants were grown in the field using commercial fertilization and irrigation protocols (370 liter per meter, fertilization of 14 units of 21% urea per entire growth period).

2. Drought Conditions:

*Sorghum* seeds were sown in soil and grown under normal condition until around 35 days from sowing, around stage V8 (eight green leaves are fully expanded, booting not started yet). At this point, irrigation was stopped, and severe drought stress was developed.

3. Low Nitrogen Fertilization Conditions:

*Sorghum* plants were fertilized with 50% less amount of nitrogen in the field than the amount of nitrogen applied in the regular growth treatment. All the fertilizer was applied before flowering.

Analyzed *Sorghum* Tissues—

All 10 selected *Sorghum* hybrids were sampled per each treatment. Tissues [Flag leaf, Flower meristem and Flower] from plants growing under normal conditions, severe drought stress and low nitrogen conditions were sampled and RNA was extracted as described above. Each microarray expression information tissue type has received a Set ID as summarized in Table 30 below.

TABLE 30

*Sorghum* transcriptome expression sets in field experiments

| Expression Set | Set ID |
|---|---|
| *Sorghum* field/flag leaf/Drought | A |
| *Sorghum* field/flag leaf/Low N | B |
| *Sorghum* field/flag leaf/Normal | C |
| *Sorghum* field/flower meristem/Drought | D |
| *Sorghum* field/flower meristem/Low N | E |
| *Sorghum* field/flower meristem/Normal | F |
| *Sorghum* field/flower/Drought | G |
| *Sorghum* field/flower/Low N | H |
| *Sorghum* field/flower/Normal | J |

Table 30: Provided are the *sorghum* transcriptome expression sets. Flag leaf = the leaf below the flower; Flower meristem = Apical meristem following panicle initiation; Flower = the flower at the anthesis day.

The following parameters were collected using digital imaging system:

Average Grain Area ($cm^2$)—

At the end of the growing period the grains were separated from the Plant 'Head'. A sample of ~200 grains were weighted, photographed and images were processed using the below described image processing system. The grain area was measured from those images and was divided by the number of grains.

Average Grain Length (cm)—

At the end of the growing period the grains were separated from the Plant 'Head'. A sample of ~200 grains were weighted, photographed and images were processed using the below described image processing system. The sum of grain lengths (longest axis) was measured from those images and was divided by the number of grains.

Head Average Area ($cm^2$)—

At the end of the growing period 5 'Heads' were, photographed and images were processed using the below described image processing system. The 'Head' area was measured from those images and was divided by the number of 'Heads'.

Head Average Length (cm)—

At the end of the growing period 5 'Heads' were, photographed and images were processed using the below described image processing system. The 'Head' length (longest axis) was measured from those images and was divided by the number of 'Heads'.

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol:// rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Seed Weight per Head (gr.)—

At the end of the experiment (plant 'Heads') heads from plots within blocks A-C were collected. 5 heads were separately threshed and grains were weighted, all additional heads were threshed together and weighted as well. The average grain weight per head was calculated by dividing the total grain weight by number of total heads per plot (based on plot). In case of 5 heads, the total grains weight of 5 heads was divided by 5.

FW Head Per Plant Gram—

At the end of the experiment (when heads were harvested) total heads and 5 selected heads per plots within blocks A-C were collected separately. The heads (total and 5) were weighted (gr.) separately, and the average fresh weight per plant was calculated for total (FW Head/Plant gr. based on plot) and for 5 (FW Head/Plant gr. based on 5 plants) heads.

Plant Height—

Plants were characterized for height during growing period at 5 time points. In each measure, plants were measured for their height using a measuring tape. Height was measured from ground level to top of the longest leaf.

Plant Leaf Number—

Plants were characterized for leaf number during growing period at 5 time points. In each measure, plants were measured for their leaf number by counting all the leaves of 3 selected plants per plot.

Relative Growth Rate— was calculated using Formulas XV (above) and VI (above).

SPAD—

Chlorophyll content was determined using a Minolta SPAD 502 chlorophyll meter and measurement was performed 64 days post sowing. SPAD meter readings were done on young fully developed leaf. Three measurements per leaf were taken per plot.

Vegetative Dry Weight and Heads—

At the end of the experiment (when inflorescence were dry) all inflorescence and vegetative material from plots within blocks A-C were collected. The biomass and heads weight of each plot was separated, measured and divided by the number of heads.

Dry weight=total weight of the vegetative portion above ground (excluding roots) after drying at 70° C. in oven for 48 hours;

Harvest Index (HI) (*Sorghum*)—

The harvest index was calculated using Formula XVIII.

Harvest Index=Average grain dry weight per Head/
(Average vegetative dry weight per Head+Average Head dry weight)  Formula XVIII FW Heads/(FW Heads+FW Plants)—

The total fresh weight of heads and their respective plant biomass was measured at the harvest day. The heads weight was divided by the sum of weights of heads and plants.

Experimental Results 17 different *sorghum* hybrids were grown and characterized for different parameters (Table 31). The average for each of the measured parameter was calculated using the JMP software (Tables 32-36) and a subsequent correlation analysis was performed. Results were then integrated to the database.

TABLE 31

*Sorghum* correlated parameters (vectors)

| Correlation set | Correlation ID |
|---|---|
| [Grain yield/SPAD 64 DPS], Low N | 1 |
| [Grain yield/SPAD 64 DPS], Normal | 2 |
| [Grain Yield + plant biomass/SPAD 64 DPS], Low N | 3 |
| [Grain Yield + plant biomass/SPAD 64 DPS], Normal | 4 |
| [Plant biomass (FW)/SPAD 64 DPS], Drought | 5 |
| [Plant biomass (FW)/SPAD 64 DPS], Low N | 6 |
| [Plant biomass (FW)/SPAD 64 DPS], Normal | 7 |
| Average Grain Area ($cm^2$), Drought | 8 |
| Average Grain Area ($cm^2$), Low N | 9 |
| Average Grain Area ($cm^2$), Normal | 10 |
| Final Plant Height (cm), Drought | 11 |
| Final Plant Height (cm), Low N | 12 |
| Final Plant Height (cm), Normal | 13 |
| FW - Head/Head gr. (based on 5 heads), Low N | 14 |
| FW - Head/Head gr. (based on 5 heads), Normal | 15 |
| FW - Head/Plant gr. (based on plot), Drought | 16 |
| FW - Head/Plant gr. (based on plot), Low N | 17 |
| FW - Head/Plant gr. (based on plot), Normal | 18 |
| FW Heads/(FW Heads + FW Plants) (all plot), Drought | 19 |
| FW Heads/(FW Heads + FW Plants) (all plot), Low N | 20 |
| FW Heads/(FW Heads + FW Plants) (all plot), Normal | 21 |
| FW/Plant gr. (based on plot), Drought | 22 |
| FW/Plant gr. (based on plot), Low N | 23 |
| FW/Plant gr. (based on plot), Normal | 24 |
| Head Average Area ($cm^2$), Drought | 25 |
| Head Average Area ($cm^2$), Low N | 26 |
| Head Average Area ($cm^2$), Normal | 27 |
| Head Average Length (cm), Drought | 28 |
| Head Average Length (cm), Low N | 29 |
| Head Average Length (cm), Normal | 30 |
| Head Average Perimeter (cm), Drought | 31 |
| Head Average Perimeter (cm), Low N | 32 |
| Head Average Perimeter (cm), Normal | 33 |
| Head Average Width (cm), Drought | 34 |
| Head Average Width (cm), Low N | 35 |
| Head Average Width (cm), Normal | 36 |
| Leaf SPAD 64 DPS (Days Post Sowing), Drought | 37 |
| Leaf SPAD 64 DPS (Days Post Sowing), Low N | 38 |
| Leaf SPAD 64 DPS (Days Post Sowing), Normal | 39 |
| Lower Ratio Average Grain Area, Low N | 40 |
| Lower Ratio Average Grain Area, Normal | 41 |
| Lower Ratio Average Grain Length, Low N | 42 |
| Lower Ratio Average Grain Length, Normal | 43 |
| Lower Ratio Average Grain Perimeter, Low N | 44 |
| Lower Ratio Average Grain Perimeter, Normal | 45 |
| Lower Ratio Average Grain Width, Low N | 46 |
| Lower Ratio Average Grain Width, Normal | 47 |
| Total grain weight/Head (based on plot) gr., Low N | 48 |
| Total grain weight/Head gr. (based on 5 heads), Low N | 49 |
| Total grain weight/Head gr. (based on 5 heads), Normal | 50 |
| Total grain weight/Head gr. (based on plot), Normal | 51 |
| Total grain weight/Head gr. (based on plot), Drought | 52 |

TABLE 31-continued

Sorghum correlated parameters (vectors)

| Correlation set | Correlation ID |
|---|---|
| Upper Ratio Average Grain Area, Drought | 53 |
| Upper Ratio Average Grain Area, Low N | 54 |
| Upper Ratio Average Grain Area, Normal | 55 |

Table 31. Provided are the Sorghum correlated parameters (vectors). "gr." = grams; "SPAD" = chlorophyll levels; "FW" = Plant Fresh weight; "DW" = Plant Dry weight; "normal" = standard growth conditions; "DPS" = days post-sowing; "Low N" = Low Nitrogen. FW - Head/Plant gr. (based on 5 plants), fresh weigh of the harvested heads was divided by the number of heads that were phenotyped, Low N-low nitrogen conditions: Lower Ratio Average Grain Area grain area of the lower fraction of grains.

TABLE 32

Measured parameters in Sorghum accessions under normal conditions

| | Correlation ID | | | | | | | | | | |
|---|---|---|---|---|---|---|---|---|---|---|---|
| Seed ID | 2 | 4 | 7 | 10 | 13 | 15 | 18 | 21 | 24 | 27 | 30 |
| 20 | 3.78 | 4.5 | 0.724 | 0.105 | 95.2 | 406 | 175 | 0.51 | 163 | 120 | 25.6 |
| 21 | 7.74 | 8.17 | 0.433 | 0.112 | 79.2 | 518 | 223 | 0.51 | 213 | 168 | 26.8 |
| 22 | 7.01 | 7.87 | 0.858 | 0.131 | 198 | 148 | 56.4 | 0.115 | 335 | 85.1 | 21 |
| 24 | 10.1 | 10.7 | 0.583 | 0.129 | 234 | 423 | 112 | 0.263 | 313 | 157 | 26.8 |
| 25 | 7.65 | 8.34 | 0.693 | 0.139 | 189 | 92 | 67.3 | 0.12 | 462 | 104 | 23.1 |
| 26 | 3.34 | 4.4 | 1.05 | 0.141 | 195 | 101 | 66.9 | 0.177 | 318 | 102 | 21.8 |
| 27 | 3.05 | 3.73 | 0.687 | 0.11 | 117 | 424 | 126 | 0.459 | 151 | 169 | 31.3 |
| 28 | 3.9 | 4.83 | 0.929 | 0.113 | 92.8 | 386 | 108 | 0.432 | 138 | 109 | 23.2 |
| 29 | 2.83 | 3.67 | 0.841 | 0.102 | 113 | 410 | 124 | 0.425 | 168 | 135 | 25.7 |
| 30 | 2.18 | 2.89 | 0.716 | 0.118 | 97.5 | 329 | 103 | 0.442 | 129 | 169 | 28.8 |
| 31 | 2.19 | 2.91 | 0.721 | 0.121 | 98 | 391 | 82.3 | 0.458 | 97.6 | 156 | 28.1 |
| 32 | 2.41 | 3.12 | 0.705 | 0.111 | 100 | 436 | 77.6 | 0.447 | 99.3 | 112 | 23 |
| 33 | 3.58 | 4.75 | 1.17 | 0.117 | 106 | 430 | 91.2 | 0.447 | 112 | 155 | 28.1 |
| 34 | 2.9 | 3.69 | 0.792 | 0.108 | 151 | 441 | 150 | 0.513 | 157 | 172 | 30 |
| 35 | 3 | 3.85 | 0.849 | 0.105 | 117 | 416 | 109 | 0.46 | 131 | 169 | 30.5 |
| 36 | 4.85 | 5.83 | 0.984 | 0.11 | 124 | 430 | 108 | 0.442 | 136 | 163 | 27.2 |
| 37 | | | | 0.105 | 126 | 428 | 131 | 0.386 | 209 | 170 | 29.3 |

Table 32: Provided are the values of each of the parameters (as described above) measured in Sorghum accessions (Seed ID) under normal conditions. Growth conditions are specified in the experimental procedure section.

TABLE 33

Additional measured parameters in Sorghum accessions under normal growth conditions

| | Corr. ID | | | | | | | | | |
|---|---|---|---|---|---|---|---|---|---|---|
| Seed ID | 33 | 36 | 39 | 41 | 43 | 45 | 47 | 50 | 51 | 55 |
| 20 | 61.2 | 5.97 | 43 | 0.825 | 0.914 | 0.914 | 0.908 | 47.4 | 31.1 | 1.22 |
| 21 | 67.9 | 7.92 | 0 | 0.74 | 0.884 | 0.869 | 0.833 | 46.3 | 26.4 | 1.3 |
| 22 | 56.3 | 4.87 | 43.3 | 0.778 | 0.921 | 0.913 | 0.85 | 28.4 | 18.7 | 1.13 |
| 24 | 65.4 | 7.43 | 44.7 | 0.802 | 0.908 | 0.948 | 0.874 | 70.4 | 38.4 | 1.14 |
| 25 | 67.5 | 5.58 | 45.8 | 0.697 | 0.89 | 0.902 | 0.788 | 32.1 | 26.7 | 1.16 |
| 26 | 67.5 | 5.88 | 41.6 | 0.699 | 0.877 | 0.915 | 0.799 | 49.2 | 28.8 | 1.15 |
| 27 | 74.4 | 6.78 | 45.2 | 0.827 | 0.913 | 0.913 | 0.904 | 63.5 | 47.7 | 1.19 |
| 28 | 56.2 | 5.99 | 45.1 | 0.805 | 0.903 | 0.91 | 0.893 | 44.5 | 31 | 1.23 |
| 29 | 61.6 | 6.62 | 43 | 0.841 | 0.92 | 0.918 | 0.915 | 56.6 | 40 | 1.25 |
| 30 | 71.4 | 7.42 | 45.6 | 0.788 | 0.923 | 0.93 | 0.854 | 60 | 38.4 | 1.24 |
| 31 | 68.6 | 6.98 | 44.8 | 0.765 | 0.893 | 0.911 | 0.863 | 45.5 | 32.1 | 1.32 |
| 32 | 56.4 | 6.19 | 45.3 | 0.803 | 0.913 | 0.916 | 0.885 | 58.2 | 32.7 | 1.22 |
| 33 | 67.8 | 7.02 | 46.5 | 0.806 | 0.907 | 0.904 | 0.898 | 70.6 | 32.8 | 1.18 |
| 34 | 71.5 | 7.18 | 44 | 0.821 | 0.911 | 0.912 | 0.905 | 70.1 | 51.5 | 1.18 |
| 35 | 78.9 | 7 | 45.1 | 0.814 | 0.904 | 0.905 | 0.91 | 54 | 35.7 | 1.22 |
| 36 | 67 | 7.39 | 45.1 | 0.818 | 0.903 | 0.909 | 0.902 | 59.9 | 38.3 | 1.25 |
| 37 | 74.1 | 7.35 | 43.1 | 0.817 | 0.913 | 0.905 | 0.899 | 52.6 | 42.4 | 1.22 |

Table 33: Provided are the values of each of the parameters (as described above) measured in Sorghum accessions (Seed ID) under normal conditions. Growth conditions are specified in the experimental procedure section.

TABLE 34

Measured parameters in *Sorghum* accessions under Low nitrogen conditions

| Seed ID | \multicolumn{11}{c}{Corr. ID} |
|---|---|---|---|---|---|---|---|---|---|---|---|
|  | 1 | 3 | 6 | 9 | 12 | 14 | 17 | 20 | 23 | 26 | 29 |
| 20 | 0.677 | 6.02 | 5.34 | 0.105 | 104 | 388 | 215 | 0.505 | 205 | 96.2 | 23.2 |
| 21 | 0.784 | 5.91 | 5.12 | 0.111 | 80.9 | 429 | 205 | 0.506 | 200 | 215 | 25.6 |
| 22 | 0.458 | 8.5 | 8.04 | 0.136 | 205 | 298 | 73.5 | 0.166 | 341 | 98.6 | 20.9 |
| 24 | 0.871 | 6.75 | 5.88 | 0.121 | 125 | 280 | 123 | 0.391 | 241 | 183 | 28.4 |
| 25 | 0.584 | 13.1 | 12.5 | 0.141 | 225 | 208 | 153 | 0.21 | 538 | 120 | 24.3 |
| 26 | 0.557 | 9.57 | 9.02 | 0.134 | 208 | 304 | 93.2 | 0.192 | 359 | 110 | 22.6 |
| 27 | 1.17 | 4.67 | 3.5 | 0.119 | 121 | 436 | 134 | 0.476 | 149 | 172 | 32.1 |
| 28 | 0.634 | 3.61 | 2.98 | 0.117 | 100 | 376 | 77.4 | 0.375 | 129 | 84.8 | 20.4 |
| 29 | 1.31 | 5.89 | 4.58 | 0.116 | 121 | 475 | 130 | 0.42 | 179 | 156 | 26.7 |
| 30 | 0.862 | 3.77 | 2.91 | 0.129 | 94.5 | 438 | 99.8 | 0.441 | 124 | 137 | 26.3 |
| 31 | 0.735 | 3.26 | 2.53 | 0.131 | 110 | 383 | 76.9 | 0.429 | 101 | 138 | 25.4 |
| 32 | 0.607 | 3.61 | 3 | 0.12 | 115 | 375 | 84.2 | 0.387 | 132 | 96.5 | 23.1 |
| 33 | 0.648 | 3.24 | 2.59 | 0.116 | 105 | 425 | 92.2 | 0.438 | 118 | 158 | 27.9 |
| 34 | 1.14 | 5.1 | 3.96 | 0.115 | 174 | 434 | 139 | 0.439 | 177 | 164 | 28.9 |
| 35 | 0.87 | 4.25 | 3.38 | 0.107 | 116 | 409 | 113 | 0.442 | 144 | 138 | 27.6 |
| 36 | 0.91 | 3.81 | 2.9 | 0.121 | 139 | 378 | 95.5 | 0.43 | 127 | 135 | 25.5 |
| 37 | 0.894 | 4.76 | 3.86 | 0.109 | 144 | 432 | 129 | 0.417 | 180 | 166 | 30.3 |

Table 34: Provided are the values of each of the parameters (as described above) measured in *Sorghum* accessions (Seed ID) under low nitrogen conditions. Growth conditions are specified in the experimental procedure section.

TABLE 35

Additional measured parameters in *Sorghum* accessions under low nitrogen growth conditions

| Seed ID | \multicolumn{10}{c}{Corr. ID} |
|---|---|---|---|---|---|---|---|---|---|---|
|  | 32 | 35 | 38 | 40 | 42 | 44 | 46 | 48 | 49 | 54 |
| 20 | 56.3 | 5.26 | 38.3 | 0.815 | 0.91 | 0.901 | 0.901 | 25.9 | 50.3 | 1.18 |
| 21 | 79.2 | 10.4 | 39 | 0.77 | 0.9 | 0.884 | 0.852 | 30.6 | 50.9 | 1.31 |
| 22 | 53.2 | 5.93 | 42.3 | 0.81 | 0.921 | 0.915 | 0.893 | 19.4 | 36.1 | 1.11 |
| 24 | 76.2 | 8.25 | 40.9 | 0.793 | 0.898 | 0.897 | 0.88 | 35.6 | 73.1 | 1.21 |
| 25 | 67.3 | 6.19 | 43.1 | 0.78 | 0.908 | 0.919 | 0.863 | 25.2 | 37.9 | 1.19 |
| 26 | 59.5 | 6.12 | 39.9 | 0.799 | 0.926 | 0.918 | 0.871 | 22.2 | 36.4 | 1.18 |
| 27 | 79.3 | 6.8 | 42.7 | 0.834 | 0.918 | 0.916 | 0.91 | 50 | 71.7 | 1.16 |
| 28 | 51.5 | 5.25 | 43.3 | 0.788 | 0.89 | 0.891 | 0.888 | 27.5 | 35 | 1.23 |
| 29 | 69.9 | 7.52 | 39 | 0.806 | 0.901 | 0.898 | 0.899 | 51.1 | 76.7 | 1.17 |
| 30 | 66.2 | 6.59 | 42.7 | 0.772 | 0.909 | 0.907 | 0.857 | 36.8 | 57.6 | 1.22 |
| 31 | 67.4 | 6.85 | 40.1 | 0.741 | 0.886 | 0.895 | 0.842 | 29.4 | 42.9 | 1.24 |
| 32 | 57.9 | 5.32 | 44 | 0.804 | 0.897 | 0.903 | 0.897 | 26.7 | 36.5 | 1.19 |
| 33 | 70.6 | 7.25 | 45.4 | 0.788 | 0.894 | 0.896 | 0.887 | 29.4 | 68.6 | 1.23 |
| 34 | 73.8 | 7.19 | 44.8 | 0.823 | 0.911 | 0.914 | 0.908 | 51.1 | 71.8 | 1.16 |
| 35 | 66.9 | 6.27 | 42.6 | 0.801 | 0.888 | 0.894 | 0.899 | 37 | 49.3 | 1.34 |
| 36 | 65.4 | 6.57 | 43.8 | 0.809 | 0.892 | 0.896 | 0.902 | 39.9 | 43.9 | 1.21 |
| 37 | 76 | 6.82 | 46.7 | 0.807 | 0.901 | 0.897 | 0.897 | 41.8 | 52.1 | 1.21 |

Table 35: Provided are the values of each of the parameters (as described above) measured in *Sorghum* accessions (Seed ID) under low nitrogen conditions. Growth conditions are specified in the experimental procedure section.

TABLE 36

Measured parameters in *Sorghum* accessions under drought conditions

| Seed ID | \multicolumn{13}{c}{Correlation ID} |
|---|---|---|---|---|---|---|---|---|---|---|---|---|---|
|  | 5 | 8 | 11 | 16 | 19 | 22 | 25 | 28 | 31 | 34 | 37 | 52 | 53 |
| 20 | 5.13 | 0.10 | 89 | 155 | 0.42 | 208 | 83 | 21.6 | 52.8 | 4.83 | 40.6 | 22.1 | 1.31 |
| 21 | 3.38 | 0.12 | 76 | 122 | 0.47 | 138 | 108 | 21.9 | 64.5 | 6.31 | 40.9 | 16.8 | 1.19 |
| 22 | 5.67 | 0.11 | 92 | 131 | 0.42 | 255 | 89 | 21.6 | 56.6 | 5.16 | 45 | 9.19 | 1.29 |
| 24 | 9.51 | 0.09 | 94 | 241 | 0.37 | 402 | 136 | 22.0 | 64.4 | 7.78 | 42.3 | 104 | 1.46 |
| 25 | 5.16 | 0.09 | 151 | 69 | 0.23 | 234 | 91 | 21.0 | 53.2 | 5.28 | 45.2 | 3.24 | 1.21 |
| 26 | 9.66 | 0.11 | 111 | 186 | 0.31 | 392 | 124 | 28.6 | 71.7 | 5.49 | 40.6 | 22 | 1.21 |
| 27 | 1.99 |  | 99 | 62 | 0.41 | 89 | 86 | 21.3 | 55.6 | 5.04 | 44.8 | 9.97 |  |
| 28 | 1.12 |  | 84 | 39 | 0.44 | 51 | 85 | 20.8 | 53.0 | 5.07 | 45.1 | 18.6 |  |

TABLE 36-continued

Measured parameters in *Sorghum* accessions under drought conditions

| Seed ID | Correlation ID | | | | | | | | | | | |
|---|---|---|---|---|---|---|---|---|---|---|---|---|
| | 5 | 8 | 11 | 16 | 19 | 22 | 25 | 28 | 31 | 34 | 37 | 52 | 53 |
| 29 | 2.14 | | 99 | 59 | 0.40 | 87 | 113 | 24.7 | 69.8 | 5.77 | 40.6 | 29.3 | |
| 30 | 2.65 | | 92 | 76 | 0.44 | 120 | 101 | 24.3 | 65.1 | 5.37 | 45.4 | 10.5 | |
| 31 | 0.87 | | 82 | 34 | 0.47 | 37 | 80 | 21.9 | 55.3 | 4.66 | 42.6 | 14.8 | |
| 32 | 1.09 | | 99 | 42 | 0.47 | 48 | 127 | 25.0 | 69.1 | 6.35 | 44.2 | 12.9 | |
| 33 | 0.99 | | 87 | 42 | 0.48 | 44 | 86 | 19.5 | 53.3 | 5.58 | 44.6 | 18.2 | |
| 34 | 5.46 | | 100 | 132 | 0.35 | 232 | 92 | 20.4 | 56.3 | 5.76 | 42.4 | 11.6 | |
| 35 | 2.68 | | 83 | 61 | 0.35 | 116 | 78 | 16.8 | 49.1 | 5.86 | 43.2 | 18.6 | |
| 36 | 3.05 | | 84 | 44 | 0.23 | 123 | 77 | 18.9 | 51.9 | 5.1 | 40.3 | 16.4 | |
| 37 | 8.40 | | 92 | 185 | 0.33 | 342 | | | | | 40.8 | | |

Table 36: Provided are the values of each of the parameters (as described above) measured in *Sorghum* accessions (Seed ID) under drought conditions. Growth conditions are specified in the experimental procedure section.

Example 10

Production of *Sorghum* Transcriptome and High Throughput Correlation Analysis with Biomass, Nue, and Abst Related Parameters Measured in Semi-Hydroponics Conditions Using 44K *Sorghum* Oligonucleotide Micro-Arrays

*Sorghum* Vigor Related Parameters Under Low Nitrogen, 100 mM NaCl, Low Temperature (10±2° C.) and Normal Growth Conditions—

Ten *Sorghum* hybrids were grown in 3 repetitive plots, each containing 17 plants, at a net house under semi-hydroponics conditions. Briefly, the growing protocol was as follows: *Sorghum* seeds were sown in trays filled with a mix of vermiculite and peat in a 1:1 ratio. Following germination, the trays were transferred to the high salinity solution (100 mM NaCl in addition to the Full Hoagland solution), low temperature (10±2° C. in the presence of Full Hoagland solution), low nitrogen solution (the amount of total nitrogen was reduced in 90% from the full Hoagland solution (i.e., to a final concentration of 10% from full Hoagland solution, final amount of 1.2 mM N) or at Normal growth solution (Full Hoagland containing 16 mM N solution, at 28±2° C.). Plants were grown at 28±2° C.

Full Hoagland solution consists of: $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

Analyzed *Sorghum* Tissues—

All 10 selected *Sorghum* hybrids were sampled per each treatment. Three tissues [leaves, meristems and roots] growing at 100 mM NaCl, low temperature (10±2° C.), low Nitrogen (1.2 mM N) or under Normal conditions were sampled and RNA was extracted as described above. Each micro-array expression information tissue type has received a Set ID as summarized in Table 37 below.

TABLE 37

*Sorghum* transcriptome expression sets under semi hydroponics conditions

| Expression set | Set Id |
|---|---|
| *Sorghum* roots under Low Nitrogen | A |
| *Sorghum* leaves under Low Nitrogen | B |
| *Sorghum* meristems under Low Nitrogen | C |
| *Sorghum* roots under Normal Growth | D |
| *Sorghum* leaves under Normal Growth | E |
| *Sorghum* meristems under Normal Growth | F |
| *Sorghum* roots under 100 mM NaCl | G |
| *Sorghum* leaves under 100 mM NaCl | H |
| *Sorghum* meristems under 100 mM NaCl | I |
| *Sorghum* roots under cold | J |
| *Sorghum* leaves under cold | K |
| *Sorghum* meristems under cold | L |

Table 37: Provided are the *Sorghum* transcriptome expression sets. Cold conditions = 10 ± 2° C.; NaCl = 100 mM NaCl; low nitrogen = 1.2 mM Nitrogen; Normal conditions = 16 mM Nitrogen.

Experimental Results 10 different *Sorghum* hybrids were grown and characterized for the following parameters: "Leaf No"=leaf number per plant (average of five plants); "Plant Height"=plant height [cm] (average of five plants); "DW Root/Plant"—root dry weight per plant (average of five plants); DW Shoot/Plant—shoot dry weight per plant (average of five plants) (Table 38). The average for each of the measured parameter was calculated using the JMP software and values are summarized in Tables 39-42 below. Subsequent correlation analysis was performed. Results were then integrated to the database.

TABLE 38

*Sorghum* correlated parameters (vectors)

| Correlation set | Correlation ID |
|---|---|
| DW Root/Plant - 100 mM NaCl | 1 |
| DW Root/Plant - Cold | 2 |
| DW Root/Plant - Low Nitrogen | 3 |
| DW Root/Plant - Normal | 4 |
| DW Shoot/Plant - 100 mM NaCl | 5 |
| DW Shoot/Plant - Cold | 6 |
| DW Shoot/Plant - Low Nitrogen | 7 |
| DW Shoot/Plant - Normal | 8 |
| Leaf Number TP1 - 100 mM NaCl | 9 |
| Leaf Number TP1 - Cold | 10 |
| Leaf Number TP1 - Low Nitrogen | 11 |
| Leaf Number TP1 - Normal | 12 |
| Leaf Number TP2 - 100 mM NaCl | 13 |
| Leaf Number TP2 - Cold | 14 |
| Leaf Number TP2 - Low Nitrogen | 15 |
| Leaf Number TP2 - Normal | 16 |
| Leaf Number TP3 - 100 mM NaCl | 17 |
| Leaf Number TP3 - Cold | 18 |
| Leaf Number TP3 - Low Nitrogen | 19 |

TABLE 38-continued

Sorghum correlated parameters (vectors)

| Correlation set | Correlation ID |
|---|---|
| Leaf Number TP3 - Normal | 20 |
| Shoot/Root - Normal | 21 |
| NUE per roots biomass - Normal | 22 |
| NUE per shoots biomass - Normal | 23 |
| NUE per total biomass - Normal | 24 |
| NUE per roots biomass - Low N | 25 |
| NUE per shoots biomass - Low N | 26 |
| NUE per total biomass - Low N | 27 |
| Percent of reduction of root biomass compared to normal - Low N | 28 |
| Percent of reduction of shoot biomass compared to normal - Low N | 29 |
| Percent of reduction of total biomass compared to normal - Low N | 30 |
| Plant Height TP1 - 100 mM NaCl | 31 |
| Plant Height TP1 - Cold | 32 |
| Plant Height TP1 - Low N | 33 |
| Plant Height TP1 - Normal | 34 |
| Plant Height TP2 - 100 mM NaCl | 35 |
| Plant Height TP2 - Cold | 36 |
| Plant Height TP2 - Low N | 37 |
| Plant Height TP2 - Normal | 38 |
| Plant Height TP3 - 100 mM NaCl | 39 |
| Plant Height TP3 - Low N | 40 |
| RGR Leaf Num Normal | 41 |
| Root Biomass DW [gr.]/SPAD - 100 mM NaCl | 42 |
| Root Biomass DW [gr.]/SPAD - Cold | 43 |
| Root Biomass DW [gr.]/SPAD - Low N | 44 |
| Root Biomass DW [gr.]/SPAD - Normal | 45 |
| Shoot Biomass DW [gr.]/SPAD - 100 mM NaCl | 46 |
| Shoot Biomass DW [gr.]/SPAD - Cold | 47 |
| Shoot Biomass DW [gr.]/SPAD - Low N | 48 |
| Shoot Biomass DW [gr.]/SPAD - Normal | 49 |
| Shoot/Root - Low N | 50 |
| SPAD - 100 mM NaCl | 51 |
| SPAD - Cold | 52 |
| SPAD - Low Nitrogen | 53 |
| SPAD - Normal | 54 |
| SPAD 100 - mM NaCl | 55 |
| Total Biomass DW [gr.]/SPAD - 100 mM NaCl | 56 |
| Total Biomass DW [gr.]/SPAD - Cold | 57 |
| Total Biomass DW [gr.]/SPAD - Low N | 58 |
| Total Biomass DW [gr.]/SPAD - Normal | 59 |

Table 38: Provided are the *Sorghum* correlated parameters. Cold conditions = 10 ± 2° C.; NaCl = 100 mM NaCl; low nitrogen = 1.2 mM Nitrogen; Normal conditions = 16 mM Nitrogen * TP-1-2-3 refers to time points 1, 2 and 3.

TABLE 39

*Sorghum* accessions, measured parameters under low nitrogen growth conditions

| Corr. ID | Seed ID | | | | | | | | | |
|---|---|---|---|---|---|---|---|---|---|---|
| | 20 | 22 | 26 | 27 | 28 | 29 | 30 | 31 | 34 | 37 |
| 3 | 0.04 | 0.11 | 0.20 | 0.10 | 0.08 | 0.09 | 0.13 | 0.09 | 0.09 | 0.09 |
| 7 | 0.08 | 0.19 | 0.33 | 0.16 | 0.16 | 0.16 | 0.26 | 0.20 | 0.13 | 0.18 |
| 11 | 3.0 | 3.1 | 3.9 | 3.5 | 3.2 | 3.1 | 3.1 | 3.3 | 3.1 | 3.1 |
| 15 | 4.0 | 4.6 | 5.0 | 4.7 | 4.6 | 4.7 | 5.0 | 4.9 | 4.7 | 4.6 |
| 19 | 3.9 | 4.3 | 4.7 | 4.2 | 4.3 | 4.6 | 4.6 | 4.7 | 4.0 | 4.1 |
| 27 | 27.5 | 64.1 | 115.0 | 58.0 | 52.2 | 35.1 | 84.6 | 63.7 | 47.0 | 60.0 |
| 50 | 1.9 | 1.7 | 1.7 | 1.6 | 2.1 | 1.8 | 2.1 | 2.1 | 1.5 | 2.0 |
| 25 | 9.7 | 23.5 | 43.9 | 22.6 | 16.9 | 12.4 | 28.2 | 20.5 | 18.8 | 20.1 |
| 26 | 17.9 | 40.6 | 71.4 | 35.4 | 35.3 | 22.7 | 56.4 | 43.2 | 28.3 | 39.9 |
| 28 | 84.5 | 81.0 | 117.0 | 101.0 | 72.5 | 71.8 | 93.5 | 76.1 | 86.8 | 80.5 |
| 29 | 81.6 | 79.2 | 105.0 | 103.0 | 83.7 | 83.2 | 108.0 | 81.4 | 70.3 | 75.9 |
| 30 | 82.6 | 79.8 | 109.0 | 102.0 | 79.7 | 78.8 | 102.0 | 79.6 | 76.1 | 77.4 |
| 53 | 6.89 | 6.57 | 6.31 | 7.45 | 6.89 | 5.87 | 6.15 | 6.05 | 7.68 | 6.74 |
| 33 | 6.73 | 9.77 | 12.70 | 8.67 | 9.77 | 9.23 | 10.30 | 10.10 | 7.93 | 8.23 |
| 37 | 13.3 | 20.6 | 23.7 | 18.0 | 19.3 | 19.2 | 21.9 | 22.1 | 18.2 | 21.0 |
| 40 | 22.2 | 31.1 | 34.7 | 30.0 | 30.8 | 29.9 | 30.9 | 32.4 | 29.4 | 30.7 |
| 44 | 0.002 | 0.004 | 0.007 | 0.003 | 0.003 | 0.003 | 0.005 | 0.003 | 0.003 | 0.003 |
| 48 | 0.003 | 0.007 | 0.011 | 0.005 | 0.005 | 0.006 | 0.009 | 0.007 | 0.004 | 0.007 |
| 53 | 26.9 | 28.0 | 29.6 | 31.5 | 29.6 | 26.8 | 28.5 | 28.2 | 30.5 | 27.6 |
| 58 | 0.005 | 0.011 | 0.018 | 0.008 | 0.008 | 0.009 | 0.014 | 0.010 | 0.007 | 0.010 |

Table 39: Provided are the values of each of the parameters (as described above) measured in *Sorghum* accessions (Seed ID) under low nitrogen conditions. Growth conditions are specified in the experimental procedure section.

TABLE 40

*Sorghum* accessions, measured parameters under salinity (100 mM NaCl) conditions

| Corr. ID | Seed ID | | | | | | | | | |
|---|---|---|---|---|---|---|---|---|---|---|
| | 20 | 22 | 26 | 27 | 28 | 29 | 30 | 31 | 34 | 37 |
| 1 | 0.05 | 0.10 | 0.12 | 0.07 | 0.08 | 0.08 | 0.14 | 0.10 | 0.17 | 0.14 |
| 5 | 0.09 | 0.19 | 0.20 | 0.14 | 0.13 | 0.13 | 0.15 | 0.19 | 0.10 | 0.12 |
| 9 | 3.0 | 3.1 | 3.4 | 3.1 | 3.3 | 3.1 | 3.1 | 3.3 | 3.0 | 3.1 |
| 13 | 4.0 | 4.4 | 4.9 | 4.6 | 4.5 | 4.5 | 4.5 | 4.8 | 4.3 | 4.2 |
| 17 | 4.0 | 4.1 | 4.6 | 4.4 | 4.1 | 4.3 | 4.1 | 4.5 | 3.8 | 4.2 |
| 51 | 8.2 | 8.5 | 6.1 | 7.0 | 8.5 | 6.9 | 7.8 | 7.1 | 8.6 | 8.2 |
| 31 | 7.9 | 9.5 | 10.9 | 7.9 | 9.7 | 8.5 | 8.9 | 10.4 | 7.0 | 7.8 |
| 35 | 14.2 | 16.3 | 20.4 | 13.3 | 15.9 | 16.5 | 15.5 | 18.9 | 13.7 | 15.8 |

TABLE 40-continued

Sorghum accessions, measured parameters under salinity (100 mM NaCl) conditions

| Corr. ID | Seed ID | | | | | | | | | |
|---|---|---|---|---|---|---|---|---|---|---|
| | 20 | 22 | 26 | 27 | 28 | 29 | 30 | 31 | 34 | 37 |
| 39 | 21.8 | 23.2 | 30.4 | 22.8 | 23.7 | 23.3 | 22.5 | 26.8 | 20.3 | 23.6 |
| 42 | 0.002 | 0.003 | 0.004 | 0.002 | 0.002 | 0.003 | 0.004 | 0.003 | 0.005 | 0.004 |
| 46 | 0.003 | 0.005 | 0.007 | 0.004 | 0.004 | 0.004 | 0.005 | 0.006 | 0.003 | 0.004 |
| 55 | 32.7 | 35.1 | 28.0 | 30.9 | 34.5 | 30.0 | 32.1 | 31.9 | 32.5 | 34.3 |
| 56 | 0.004 | 0.008 | 0.012 | 0.007 | 0.006 | 0.007 | 0.009 | 0.009 | 0.008 | 0.008 |

Table 40: Provided are the values of each of the parameters (as described above) measured in Sorghum accessions (Seed ID) under 100 mM NaCl growth conditions. Growth conditions are specified in the experimental procedure section.

TABLE 41

Sorghum accessions, measured parameters under cold conditions

| Corr. ID | Seed ID | | | | | | | | | |
|---|---|---|---|---|---|---|---|---|---|---|
| | 20 | 22 | 26 | 27 | 28 | 29 | 30 | 31 | 34 | 37 |
| 2 | 0.068 | 0.108 | 0.163 | 0.094 | 0.084 | 0.114 | 0.137 | 0.127 | 0.108 | 0.139 |
| 6 | 0.078 | 0.154 | 0.189 | 0.112 | 0.130 | 0.165 | 0.152 | 0.150 | 0.112 | 0.141 |
| 10 | 3.0 | 3.0 | 3.5 | 3.2 | 3.4 | 3.2 | 3.1 | 3.1 | 3.1 | 3.0 |
| 14 | 3.9 | 4.1 | 4.6 | 4.2 | 4.3 | 4.2 | 4.2 | 4.3 | 4.2 | 4.0 |
| 18 | 4.7 | 5.3 | 5.4 | 5.5 | 5.3 | 5.1 | 4.5 | 5.4 | 5.4 | 5.2 |
| 52 | 6.1 | 5.7 | 5.0 | 5.9 | 5.3 | 5.9 | 7.2 | 5.3 | 5.9 | 5.7 |
| 32 | 6.5 | 8.8 | 10.4 | 6.8 | 9.0 | 9.0 | 8.0 | 9.2 | 6.5 | 7.2 |
| 36 | 11.2 | 15.9 | 18.4 | 12.2 | 16.0 | 14.6 | 14.6 | 17.3 | 13.4 | 13.9 |
| 43 | 0.002 | 0.004 | 0.006 | 0.003 | 0.003 | 0.004 | 0.004 | 0.004 | 0.003 | 0.005 |
| 47 | 0.003 | 0.005 | 0.007 | 0.003 | 0.005 | 0.006 | 0.005 | 0.005 | 0.004 | 0.005 |
| 52 | 28.6 | 30.3 | 27.0 | 32.3 | 28.3 | 29.9 | 32.5 | 28.6 | 31.7 | 29.6 |
| 57 | 0.005 | 0.009 | 0.013 | 0.006 | 0.008 | 0.009 | 0.009 | 0.010 | 0.007 | 0.009 |

Table 41: Provided are the values of each of the parameters (as described above) measured in Sorghum accessions (Seed ID) under cold growth conditions. Growth conditions are specified in the experimental procedure section.

TABLE 42

Sorghum accessions, measured parameters under regular growth conditions

| Corr. ID | Seed ID | | | | | | | | | |
|---|---|---|---|---|---|---|---|---|---|---|
| | 20 | 22 | 26 | 27 | 28 | 29 | 30 | 31 | 34 | 37 |
| 4 | 0.05 | 0.13 | 0.17 | 0.10 | 0.11 | 0.12 | 0.14 | 0.12 | 0.10 | 0.12 |
| 8 | 0.10 | 0.24 | 0.31 | 0.16 | 0.19 | 0.19 | 0.24 | 0.24 | 0.19 | 0.24 |
| 12 | 3.0 | 3.1 | 3.8 | 3.2 | 3.2 | 3.2 | 3.1 | 3.4 | 3.0 | 3.0 |
| 16 | 4.2 | 4.5 | 4.8 | 4.6 | 4.5 | 5.0 | 4.6 | 4.9 | 4.5 | 4.6 |
| 20 | 5.3 | 5.9 | 6.2 | 5.8 | 5.8 | 5.7 | 5.7 | 6.0 | 5.6 | 6.1 |
| 54 | 5.0 | 5.0 | 4.8 | 5.0 | 4.3 | 4.3 | 5.4 | 4.3 | 5.9 | 5.5 |
| 21 | 2.0 | 1.9 | 1.9 | 1.6 | 1.8 | 1.6 | 1.8 | 2.0 | 1.9 | 2.2 |
| 22 | 0.9 | 2.2 | 2.8 | 1.7 | 1.8 | 2.0 | 2.3 | 2.0 | 1.1 | 1.9 |
| 23 | 1.7 | 3.9 | 5.1 | 2.6 | 3.2 | 3.1 | 4.0 | 4.0 | 2.0 | 4.0 |
| 24 | 2.5 | 6.1 | 8.0 | 4.3 | 4.9 | 5.0 | 6.2 | 6.0 | 3.1 | 5.9 |
| 34 | 7.5 | 9.3 | 12.9 | 8.6 | 8.9 | 8.5 | 10.7 | 10.3 | 7.9 | 8.8 |
| 38 | 15.0 | 18.2 | 22.1 | 17.6 | 18.1 | 18.5 | 22.8 | 22.0 | 20.0 | 21.8 |
| 41 | 0.16 | 0.19 | 0.16 | 0.17 | 0.17 | 0.17 | 0.17 | 0.17 | 0.17 | 0.20 |
| 45 | 0.002 | 0.005 | 0.006 | 0.004 | 0.004 | 0.005 | 0.005 | 0.005 | 0.003 | 0.003 |
| 49 | 0.004 | 0.008 | 0.011 | 0.005 | 0.008 | 0.008 | 0.008 | 0.010 | 0.006 | 0.007 |
| 54 | 26.7 | 29.3 | 29.9 | 29.1 | 25.0 | 24.6 | 30.8 | 25.5 | 32.9 | 33.5 |
| 59 | 0.006 | 0.013 | 0.016 | 0.009 | 0.012 | 0.013 | 0.012 | 0.014 | 0.009 | 0.011 |

Table 42: Provided are the values of each of the parameters (as described above) measured in Sorghum accessions (Seed ID) under regular growth conditions. Growth conditions are specified in the experimental procedure section.

Example 11

Production of Maize Transcriptome and High Throughput Correlation Analysis with Yield and Nue Related Parameters Using 60K Maize Oligonucleotide Micro-Arrays In order to produce a high throughput correlation analysis between plant phenotype and gene expression level, the present inventors utilized a maize oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 maize genes and transcripts.

Correlation of Maize Hybrids Across Ecotypes Grown Under Regular Growth Conditions Experimental Procedures 12 Maize hybrids were grown in 3 repetitive plots, in field. Maize seeds were planted and plants were grown in the field using commercial fertilization and irrigation protocols [485 metric cubes of water per dunam (1000 m$^2$), 30 units of uran 21% fertilization per entire growth period]. In order to define correlations between the levels of RNA expression with stress and yield components or vigor related parameters, the 12 different maize hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Analyzed Maize Tissues—

All 10 selected maize hybrids were sampled per 3 time points (TP2=V6–V8, TP5=R1–R2, TP6=R3–R4). Four types of plant tissues [Ear, flag leaf indicated in Table 43 as "leaf", grain distal part, and internode] growing under Normal conditions were sampled and RNA was extracted as described above. Each micro-array expression information tissue type has received a Set ID as summarized in Table 43 below.

TABLE 43

Maize transcriptome expression sets

| Expression Set | Set ID |
|---|---|
| Maize field/Normal/Ear TP5 | A |
| Maize field/Normal/Ear TP6 | B |
| Maize field/Normal/Grain Distal | C |
| Maize field/Normal/Internode TP2 | D |
| Maize field/Normal/Internode TP5 | E |
| Maize field/Normal/Internode TP6 | F |
| Maize field/Normal/Leaf TP2 | G |
| Maize field/Normal/Leaf TP5 | H |

Table 43: Provided are the maize transcriptome expression sets. Leaf = the leaf below the main ear; Flower meristem = Apical meristem following male flower initiation; Ear = the female flower at the anthesis day. Grain Distal = maize developing grains from the cob extreme area, Grain Basal = maize developing grains from the cob basal area; Internodes = internodes located above and below the main ear in the plant. TP = time point.

The following parameters were collected using digital imaging system:

Grain Area (cm$^2$)—

At the end of the growing period the grains were separated from the ear. A sample of ~200 grains were weighted, photographed and images were processed using the below described image processing system. The grain area was measured from those images and was divided by the number of grains.

Grain Length and Grain Width (cm)—

At the end of the growing period the grains were separated from the ear. A sample of ~200 grains were weighted, photographed and images were processed using the below described image processing system. The sum of grain lengths/or width (longest axis) was measured from those images and was divided by the number of grains.

Ear Area (cm$^2$)—

At the end of the growing period 5 ears were, photographed and images were processed using the below described image processing system. The Ear area was measured from those images and was divided by the number of Ears.

Ear Length and Ear Width (cm)—

At the end of the growing period 5 ears were, photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (gr.)—

At the end of the experiment all ears from plots within blocks A-C were collected. Six ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear FW (gr.)—

At the end of the experiment (when ears were harvested) total and 6 selected ears per plots within blocks A-C were collected separately. The plants with (total and 6) were weighted (gr.) separately and the average ear per plant was calculated for total (Ear FW per plot) and for 6 (Ear FW per plant).

Plant Height and Ear Height—

Plants were characterized for height at harvesting. In each measure, 6 plants were measured for their height using a measuring tape. Height was measured from ground level to top of the plant below the tassel. Ear height was measured from the ground level to the place were the main ear is located.

Leaf Number Per Plant—

Plants were characterized for leaf number during growing period at 5 time points. In each measure, plants were measured for their leaf number by counting all the leaves of 3 selected plants per plot.

Relative Growth Rate was calculated using Formulas V-XI, XV-XVII (described above).

SPAD—

Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS).

Dry Weight Per Plant—

At the end of the experiment (when inflorescence were dry) all vegetative material from plots within blocks A-C were collected.

Dry weight=total weight of the vegetative portion above ground (excluding roots) after drying at 70° C. in oven for 48 hours.

Harvest Index (HI) (Maize)—

The harvest index was calculated using Formula XIX.

Harvest Index=Average grain dry weight per Ear/(Average vegetative dry weight per Ear+Average Ear dry weight)     Formula XIX Percent Filled Ear [%]—

It was calculated as the percentage of the Ear area with grains out of the total ear.

Cob Diameter [cm]—

The diameter of the cob without grains was measured using a ruler.

Kernel Row Number Per Ear—

The number of rows in each ear was counted.

Experimental Results 12 different maize hybrids were grown and characterized for different parameters. The correlated parameters are described in Table 44 below. The average for each of the measured parameter was calculated using the JMP software (Tables 45-46) and a subsequent correlation analysis was performed. Results were then integrated to the database.

TABLE 44

Maize correlated parameters (vectors)

| Correlations | Correlation ID |
|---|---|
| SPAD 54DPS [SPAD units] | 1 |
| SPAD 46DPS [SPAD units] | 2 |
| Growth Rate Leaf Num | 3 |
| Plant Height per Plot [cm] | 4 |
| Ear Height [cm] | 5 |
| Leaf Number per Plant [number] | 6 |
| Ear Length [cm] | 7 |
| Percent Filled Ear [%] | 8 |
| Cob Diameter [mm] | 9 |
| Kernel Row Number per Ear [number] | 10 |
| DW per Plant [gr] | 11 |
| Ear FW per Plant [gr] | 12 |
| Normalized Grain Weight per plant [gr] | 13 |
| Ears FW per plot [gr] | 14 |
| Normalized Grain Weight per plot [gr] | 15 |
| Ear Area [$cm^2$] | 16 |
| Ear Width [cm] | 17 |
| Grain Area [$cm^2$] | 18 |
| Grain Length [cm] | 19 |
| Grain Width [cm] | 20 |

Table 44. SPAD 46DPS and SPAD 54DPS: Chlorophyll level after 46 and 54 days after sowing (DPS). "FW" = fresh weight; "DW" = dry weight.

TABLE 45

Measured parameters in Maize accessions under normal conditions

| | Seed ID | | | | | | | | | | |
|---|---|---|---|---|---|---|---|---|---|---|---|
| | 1 | 2 | 3 | 4 | 5 | 6 | 7 | 8 | 9 | 10 | 11 |
| Line 1 | 54.8 | 55.3 | 0.306 | 287 | 135 | 11.9 | 20.9 | 80.4 | 28.7 | 16.2 | 656 |
| Line 2 | 54.3 | 51.7 | 0.283 | 278 | 135 | 12 | 19.7 | 80.6 | 29 | 16.2 | 658 |
| Line 3 | 57.2 | 56.4 | 0.221 | 270 | 116 | 8.4 | 19.1 | 94.3 | 23.8 | 15 | 472 |
| Line 4 | 56 | 53.5 | 0.281 | 275 | 132 | 11.7 | 20.5 | 82.1 | 28.1 | 16.2 | 641 |
| Line 5 | 59.7 | 55.2 | 0.269 | 238 | 114 | 11.8 | 21.3 | 92.7 | 25.7 | 15.9 | 581 |
| Line 6 | 59.1 | 59.4 | 0.244 | 225 | 94.3 | 12.3 | 18.2 | 82.8 | 25.8 | 15.2 | 569 |
| Line 7 | 58 | 58.5 | 0.244 | 264 | 121 | 12.4 | 19 | 73.2 | 26.4 | 16 | 511 |
| Line 8 | 60.4 | 55.9 | 0.266 | 252 | 108 | 12.2 | 18.6 | 81.1 | 25.2 | 14.8 | 544 |
| Line 9 | 54.8 | 53 | | | | | | | | | |
| Line 10 | 53.3 | 50 | | | | | | | | | |
| Line 11 | 61.1 | 59.7 | 0.301 | 278 | 112 | 12.6 | 21.7 | 91.6 | 26.7 | 15.4 | 522 |
| Line 12 | 51.4 | 53.9 | 0.194 | 164 | 60.4 | 9.28 | 16.7 | 81.1 | 14.3 | 574 | 141 |

Table 45: Provided are the values of each of the parameters (as described above) measured in maize accessions (Seed ID) under regular growth conditions. Growth conditions are specified in the experimental procedure section.

TABLE 46

Additional measured parameters in Maize accessions under regular growth conditions

| | Seed ID | | | | | | | | |
|---|---|---|---|---|---|---|---|---|---|
| | 12 | 13 | 14 | 15 | 16 | 17 | 18 | 19 | 20 |
| Line 1 | 272 | 157 | 280 | 140 | 91.6 | 5.73 | 0.806 | 1.23 | 0.824 |
| Line 2 | 246 | 141 | 278 | 154 | 85.1 | 5.58 | 0.753 | 1.17 | 0.81 |
| Line 3 | 190 | 129 | 190 | 121 | 77.9 | 5.1 | 0.674 | 1.07 | 0.794 |
| Line 4 | 262 | 154 | 288 | 152 | 90.5 | 5.67 | 0.755 | 1.18 | 0.803 |
| Line 5 | 264 | 177 | 248 | 159 | 96 | 5.53 | 0.766 | 1.2 | 0.803 |
| Line 6 | 178 | 120 | 176 | 117 | 72.4 | 5.23 | 0.713 | 1.12 | 0.803 |
| Line 7 | 189 | 120 | 192 | 123 | 74 | 5.22 | 0.714 | 1.14 | 0.791 |
| Line 8 | 197 | 134 | 205 | 131 | 76.5 | 5.33 | 0.753 | 1.13 | 0.837 |
| Line 9 | | | | | | | | | |
| Line 10 | | | | | | | | | |
| Line 11 | 261 | 173 | 264 | 171 | 95.4 | 5.58 | 0.762 | 1.18 | 0.812 |
| Line 12 | 54.3 | 143 | 40.8 | 55.2 | 4.12 | 0.796 | 0.921 | 0.675 | |

Table 46: Provided are the values of each of the parameters (as described above) measured in maize accessions (Seed ID) under regular growth conditions. Growth conditions are specified in the experimental procedure section.

Example 12

Production of Maize Transcriptome and High Throughput Correlation Analysis with Yield and Nue Related Parameters when Grown Under Reduced Nitrogen Fertilization Using 60K Maize Oligonucleotide Micro-Arrays In order to produce a high throughput correlation analysis between plant phenotype and gene expression level, the present inventors utilized a maize oligonucleotide microarray, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 maize genes and transcripts.

Correlation of Maize Hybrids Across Ecotypes Grown Under Low Nitrogen Conditions Experimental Procedures 12 Maize hybrids were grown in 3 repetitive plots, in field. Maize seeds were planted and plants were grown in the field using commercial fertilization and irrigation protocols (485 metric cubes of water per dunam, 30 units of uran 21% fertilization per entire growth period) or with 50% of commercial fertilization to produce low N treatment. In order to define correlations between the levels of RNA expression with NUE and yield components or vigor related parameters, the 12 different maize hybrids were analyzed. Among them, 11 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Analyzed Maize Tissues—

All 10 selected maize hybrids were sampled per each treatment (low N and normal conditions), in three time points (TP2=V6–V8 (six to eight collar leaf are visible, rapid growth phase and kernel row determination begins), TP5=R1–R2 (silking-blister), TP6=R3–R4 (milk-dough). Four types of plant tissues [Ear, flag leaf indicated in Table 47 as leaf, grain distal part, and internode] were sampled and RNA was extracted as described above. Each micro-array expression information tissue type has received a Set ID as summarized in Table 47 below.

TABLE 47

Maize transcriptome expression sets

| Expression Set | Set ID |
| --- | --- |
| Maize field/Low/N/Ear/TP5 | A |
| Maize field/Low/N/Ear/TP6 | B |
| Maize field/Low/N/Internodes/TP2 | C |
| Maize field/Low/N/Internodes/TP5 | D |
| Maize field/Low/N/Leaf/TP5 | E |
| Maize field/Low/N/Leaf/TP6 | F |
| Maize field/Normal/Ear/R1-R2 | G |
| Maize field/Normal/Grain/Distal/R4-R5 | H |
| Maize field/Normal/Internode/R3-R4 | J |
| Maize field/Normal/Internode/V6-V8 | K |
| Maize field/Normal/Leaf/R1-R2 | L |
| Maize field/Normal/Leaf/V6-V8 | M |
| Maize field/Low/N/Internodes/TP6 | N |
| Maize field/Low/N/Leaf/TP2 | O |

TABLE 47-continued

Maize transcriptome expression sets

| Expression Set | Set ID |
| --- | --- |
| Maize field/Normal/Ear/R3-R4 | P |
| Maize field/Normal/Internode/R1-R2 | Q |

Table 47: Provided are the maize transcriptome expression sets. Leaf = the leaf below the main ear; Flower meristem = Apical meristem following male flower initiation; Ear = the female flower at the anthesis day. Grain Distal = maize developing grains from the cob extreme area, Grain Basal = maize developing grains from the cob basal area; Internodes = internodes located above and below the main ear in the plant.

The following parameters were collected were collected either by sampling 6 plants per plot or by measuring the parameter across all the plants within the plot.

Seed Yield Per Plant (Kg.)—

At the end of the experiment all ears from plots within blocks A-C were collected. 6 ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear Weight Per Plot (gr.)—

At the end of the experiment (when ears were harvested) total and 6 selected ears per plots within blocks were collected separately. The plants with (total and 6) were weighted (gr.) separately and the average ear per plant was calculated for Ear weight per plot (total of 42 plants per plot).

Plant Height and Ear Height—

Plants were characterized for height at harvesting. In each measure, 6 plants were measured for their height using a measuring tape. Height was measured from ground level to top of the plant below the tassel. Ear height was measured from the ground level to the place were the main ear is located.

Leaf Number Per Plant—

Plants were characterized for leaf number during growing period at 5 time points. In each measure, plants were measured for their leaf number by counting all the leaves of 3 selected plants per plot.

SPAD—

Chlorophyll content was determined using a Minolta SPAD 502 chlorophyll meter and measurement was performed 64 days post sowing. SPAD meter readings were done on young fully developed leaf. Seven measurements per leaf were taken per plot. Data were taken after once per weeks after sowing.

Dry Weight Per Plant—

At the end of the experiment (when Inflorescence were dry) all vegetative material from plots within blocks A-C were collected.

Dry weight=total weight of the vegetative portion above ground (excluding roots) after drying at 70° C. in oven for 48 hours;

Ear Length of Filled Ear [cm]—

It was calculated as the length of the ear with grains out of the total ear.

Ear Length and Width [cm]—

It was calculated as the length and width of the ear in the filled. Measurement was performed in 6 plants per each plot.

Kernel Row Number Per Ear—

The number of rows in each ear was counted.

Stalk Width [cm]—

The diameter of the stalk was measured in the internode located below the main ear. Measurement was performed in 6 plants per each plot.

Leaf area index [LAI]=total leaf area of all plants in a plot. Measurement was performed using a Leaf area-meter.

NUE [kg/kg]—
the ratio between total grain yield per total N applied in soil.

NUpE [kg/kg]—
Is the ratio between total plant biomass per total N applied in soil.

Yield/Stalk Width [kg/cm]—
Is the ratio between total grain yields and the width of the stalk.

Yield/LAI [kg]—
Is the ratio between total grain yields and total leaf area index.

Experimental Results 11 different maize hybrids were grown and characterized for different parameters. Table 48 describes the Maize correlated parameters. The average for each of the measured parameter was calculated using the JMP software (Tables 49-50) and a subsequent correlation analysis was performed. Results were then integrated to the database.

TABLE 48

| Maize correlated parameters (vectors) | |
|---|---|
| Correlation set | Correlation ID |
| Ear Length [cm] Low N | 1 |
| Ear Length [cm] Normal | 2 |
| Ear Length of filled area [cm] Low N | 3 |
| Ear Length of filled area [cm] Normal | 4 |
| Ear width [mm] Low N | 5 |
| Ear width [mm] Normal | 6 |
| Ears weight per plot [kg] Low N | 7 |
| Ears weight per plot [kg] Normal | 8 |
| Final Leaf Area [number] Low N | 9 |
| Final Leaf Area [number] Normal | 10 |
| Final Leaf Number [number] Low N | 11 |
| Final Leaf Number [number] Normal | 12 |
| Final Main Ear Height [cm] Low N | 13 |
| Final Main Ear Height [cm] Normal | 14 |
| Final Plant DW [kg] Low N | 15 |
| Final Plant DW [kg] Normal | 16 |
| Final Plant Height [cm] Low N | 17 |
| Final Plant Height [cm] Normal | 18 |
| No of rows per ear [number] Low N | 19 |
| No of rows per ear [number] Normal | 20 |
| NUE at early grain filling [R1-R2] yield kg/N in plant per SPAD Low N | 21 |
| NUE at early grain filling [R1-R2] yield kg/N in plant per SPAD Normal | 22 |
| NUE at grain filling [R3-R4] yield kg/N in plant per SPAD Low N | 23 |
| NUE at grain filling [R3-R4] yield kg/N in plant per SPAD Normal | 24 |
| NUE yield kg/N applied in soil kg Low N | 25 |
| NUE yield kg/N applied in soil kg Normal | 26 |
| NUpE [biomass/N applied] Low N | 27 |
| NUpE [biomass/N applied] Normal | 28 |
| Seed yield per dunam [kg] Low N | 29 |
| Seed yield per dunam [kg] Normal | 30 |
| seed yield per plant [kg] Normal | 31 |
| seed yield per plant [kg] Low N | 32 |
| SPAD at R1-R2 [number] Low N | 33 |
| SPAD at R1-R2 [number] Normal | 34 |
| SPAD at R3-R4 [number] Low N | 35 |
| SPAD at R3-R4 [number] Normal | 36 |
| Stalk width [cm] at TP5 Normal | 37 |
| Stalk width [cm] at TP5 Low N | 38 |
| Yield/LAI Low N | 39 |
| Yield/LAI Normal | 40 |
| Yield/stalk width Normal | 41 |
| Yield/stalk width Low N | 42 |

Table 48. "cm" = centimeters' "mm" = millimeters; "kg" = kilograms; SPAD at R1-R2 and SPAD R3-R4: Chlorophyll level after early and late stages of grain filling; "NUE" = nitrogen use efficiency; "NUpE" = nitrogen uptake efficiency; "LAI" = leaf area; "N" = nitrogen; Low N = under low Nitrogen conditions; "Normal" = under normal conditions; "dunam" = 1000 m².

TABLE 49

Measured parameters in Maize accessions under normal fertilization

| Corr. ID | Line | | | | | | | | | | |
|---|---|---|---|---|---|---|---|---|---|---|---|
| | 1 | 2 | 3 | 4 | 5 | 6 | 7 | 8 | 9 | 10 | 11 |
| 16 | 1.27 | 1.30 | 1.33 | 1.50 | 1.30 | 1.58 | 1.42 | 1.37 | 1.70 | 11.40 | 0.42 |
| 8 | 8.94 | 7.02 | 7.53 | 7.99 | 8.48 | 5.63 | 6.10 | 6.66 | 8.21 | 8.40 | 1.88 |
| 31 | 0.17 | 0.14 | 0.15 | 0.16 | 0.15 | 0.12 | 0.12 | 0.13 | 0.15 | 0.17 | 0.04 |
| 30 | 1340 | 1090 | 1200 | 1270 | 1200 | 937 | 986 | 1050 | 1230 | 1370 | 301 |
| 18 | 273 | 260 | 288 | 238 | 287 | 225 | 264 | 252 | 279 | 278 | 164 |
| 14 | 130.0 | 122.0 | 128.0 | 113.0 | 135.0 | 94.3 | 121.0 | 108.0 | 140.0 | 112.0 | 60.4 |
| 12 | 11.8 | 11.1 | 13.3 | 11.8 | 11.9 | 12.3 | 12.4 | 12.2 | 11.7 | 12.6 | 9.3 |
| 37 | 2.9 | 2.6 | 2.7 | 2.9 | 2.7 | 2.6 | 2.9 | 2.7 | 2.7 | 2.8 | 2.3 |
| 2 | 19.9 | 20.2 | 18.1 | 19.9 | 19.5 | 17.7 | 17.7 | 17.3 | 17.5 | 20.5 | 19.9 |
| 6 | 51.1 | 46.3 | 45.9 | 47.6 | 51.4 | 47.4 | 47.3 | 46.8 | 48.3 | 49.3 | 41.8 |
| 4 | 16.2 | 17.5 | 17.7 | 18.4 | 15.7 | 14.7 | 12.9 | 14.0 | 12.3 | 18.8 | 16.1 |
| 20 | 16.1 | 14.7 | 15.4 | 15.9 | 16.2 | 15.2 | 16.0 | 14.8 | 17.7 | 15.4 | 14.3 |
| 34 | 56.9 | 57.2 | 59.3 | 61.6 | 58.6 | 61.2 | 60.2 | 61.1 | 57.5 | 62.2 | 52.0 |
| 36 | 59.9 | 60.9 | 56.9 | 58.7 | 58.7 | 63.2 | 59.8 | 62.4 | 57.2 | 61.9 | 49.3 |
| 26 | 4.5 | 3.6 | 4.0 | 4.2 | 4.0 | 3.1 | 3.3 | 3.5 | 4.1 | 4.6 | 1.0 |
| 24 | 25.0 | 17.8 | 20.3 | 20.0 | 19.0 | 13.9 | 16.2 | 17.2 | 21.5 | 21.0 | 5.5 |
| 22 | 23.4 | 19.1 | 20.3 | 20.7 | 20.5 | 15.4 | 16.4 | 17.2 | 21.0 | 22.0 | 5.7 |
| 41 | 457 | 412 | 443 | 439 | 447 | 357 | 337 | 386 | 472 | 482 | 140 |
| 28 | 0.008 | 0.009 | 0.009 | 0.010 | 0.009 | 0.011 | 0.009 | 0.009 | 0.004 | 0.076 | 0.003 |
| 10 | 3.2 | 4.0 | 3.3 | 4.0 | 3.9 | 4.2 | 4.0 | 4.3 | 4.3 | 2.9 | |
| 40 | 426 | 313 | 307 | 362 | 314 | 225 | 266 | 262 | | 482 | |

Table 49: Provided are the values of each of the parameters (as described above) measured in maize accessions (Seed ID) under low nitrogen fertilization. Growth conditions are specified in the experimental procedure section.

TABLE 50

Measured parameters in Maize accessions under low Nitrogen fertilization

| Corr. ID | Line 1 | 2 | 3 | 4 | 5 | 6 | 7 | 8 | 9 | 10 | 11 |
|---|---|---|---|---|---|---|---|---|---|---|---|
| 15 | 1.59 | 1.43 | 1.53 | 1.95 | 1.48 | 1.60 | 1.58 | 1.28 | 1.51 | 1.52 | 0.43 |
| 7 | 6.61 | 7.97 | 9.63 | 9.22 | 7.63 | 7.21 | 7.92 | 29.00 | 7.80 | 9.78 | 2.41 |
| 32 | 0.14 | 0.16 | 0.19 | 0.19 | 0.14 | 0.15 | 0.15 | 0.16 | 0.14 | 0.20 | 0.05 |
| 29 | 1080 | 1260 | 1550 | 1500 | 1140 | 1160 | 1210 | 1250 | 1150 | 1590 | 383 |
| 17 | 306 | 271 | 291 | 252 | 260 | 227 | 272 | 249 | 279 | 270 | 171 |
| 13 | 158 | 136 | 128 | 133 | 138 | 100 | 130 | 115 | 144 | 114 | 62 |
| 11 | 15.0 | 11.6 | 13.5 | 11.6 | 11.8 | 11.9 | 12.6 | 11.7 | 12.4 | 13.2 | 9.3 |
| 38 | 2.8 | 2.4 | 2.7 | 2.8 | 2.7 | 2.6 | 3.0 | 2.6 | 2.7 | 2.8 | 2.3 |
| 1 | 20.6 | 21.0 | 20.2 | 20.1 | 20.1 | 18.5 | 19.1 | 18.2 | 20.1 | 21.2 | 17.8 |
| 5 | 46.7 | 48.2 | 48.3 | 49.9 | 52.9 | 47.4 | 49.6 | 48.6 | 52.4 | 50.0 | 42.6 |
| 3 | 18.4 | 18.4 | 19.8 | 18.8 | 16.2 | 16.0 | 15.3 | 15.7 | 16.8 | 19.6 | 14.1 |
| 19 | 14.2 | 15.2 | 15.0 | 15.7 | 16.0 | 15.9 | 15.6 | 14.5 | 16.4 | 15.7 | 14.4 |
| 33 | 60.2 | 57.9 | 58.8 | 59.5 | 58.5 | 64.0 | 56.4 | 60.0 | 58.3 | 61.7 | 53.1 |
| 35 | 59.3 | 57.6 | 58.4 | 59.2 | 58.2 | 62.7 | 61.0 | 59.9 | 57.5 | 61.9 | 49.6 |
| 25 | 7.2 | 8.4 | 10.3 | 10.0 | 7.6 | 7.7 | 8.1 | 8.3 | 7.6 | 10.6 | 2.6 |
| 23 | 18.4 | 21.9 | 26.5 | 25.3 | 19.7 | 18.5 | 19.8 | 20.9 | 19.9 | 25.9 | 7.7 |
| 21 | 18.0 | 21.8 | 26.3 | 25.1 | 19.5 | 18.0 | 21.4 | 20.8 | 19.7 | 25.7 | 7.2 |
| 42 | 417 | 528 | 583 | 541 | 428 | 444 | 407 | 477 | 446 | 562 | 168 |
| 27 | 0.011 | 0.010 | 0.010 | 0.013 | 0.010 | 0.011 | 0.011 | 0.009 | 0.010 | 0.010 | 0.003 |
| 9 | 2.92 | 3.15 | 3.33 | 2.87 | 2.79 | 3.76 | 3.50 | 5.02 | | 3.16 | |
| 39 | 342 | 408 | 465 | 522 | 440 | 313 | 346 | 288 | | 501 | |

Table 50: Provided are the values of each of the parameters (as described above) measured in maize accessions (Seed ID) under low nitrogen fertilization. Growth conditions are specified in the experimental procedure section.

Example 13

Production of Maize 60K Transcriptome Oligonucleotide Micro-Arrays

Genes Under Differential Display Associating with Agronomical Nitrogen Use Efficiency.

Two maize commercial hybrids and 2 maize inbred lines were grown in 5 repetitive plots in the field under six different N fertilization regimes. Maize seeds were planted and plants were grown in the field using commercial fertilization and irrigation protocols (485 cubic meters of irrigation per dunam, 30 units of 21% uran (N fertilization) per entire growth period—Normal conditions 100% Nitrogen). In addition, the rest of 5 Nitrogen treatments included: 140% of Normal, 50%, 30%, 10% and 0%. In order to define association between the levels of RNA expression with yield components, biomass related parameters and NUE various indices including Agronomical NUE, 2 maize hybrids and 1 maize inbred line were selected for RNA expression analysis. The genes either up- or down-regulated under certain N fertilization with highest Agronomical NUE or yield or biomass parameters was considered as associated with Agronomical NUE, NUE and yield.

Analyzed Maize Tissues—

At total 3 maize lines were sampled at V12 developmental stage (tasseling) and R3 (milky) developmental stage. Plant tissues [leaves, lower and upper internodes, flower] were sampled and RNA was extracted as described above. Each micro-array expression information tissue type has received a Set ID as summarized in Table 51 below.

TABLE 51

Maize transcriptome expression sets

| Expression Set | Set ID |
|---|---|
| Leaf at V12 | A |
| Upper internode at V12 | B |

TABLE 51-continued

Maize transcriptome expression sets

| Expression Set | Set ID |
|---|---|
| Upper internode at V12 | C |
| Flower at V12 | D |
| Leaf at R3 | E |
| Upper internode at R3 | F |
| Upper internode at R3 | G |

Table 51: Provided are the maize transcriptome expression sets

The following parameters were collected either by sampling 6 plants per plot or by measuring the parameter across all the plants within the plot.

Grain Weight (Yield) Per Plant (kg.)—

At the end of the experiment all ears from plots were collected. All ears from the plot were separately threshed and grains were weighted, all additional ears were threshed together and weighted as well. The average grain weight per ear was calculated by dividing the total grain weight by number of total ears per plot (based on plot).

Agronomical NUE (Agronomical Nitrogen Use Efficiency)

Agronomical NUE coefficient measures the ability of plant to efficiently use the each additional unit of Nitrogen added as fertilizer and was calculated using the following formula:

$$\text{Agronomical } NUE = \frac{\text{Yield per plant}(Kg.)^{X \text{ Nitrogen Fertilization}} - \text{Yield per plant}(Kg.)^{0\% \text{ Nitrogen Fertilization}}}{\text{Fertilizer}^X} \quad \text{Formula XX}$$

Ear Weight Per Plant (Gr.)—

At the end of the experiment (when ears were harvested) total and 6 selected ears per plots within blocks were collected separately. The collected ears (total or and 6) were weighted (gr.) separately and divided by the plant number in order to obtain the average ear weight per plant.

Average Dry Weight—

At the end of the experiment (when inflorescence were dry) all vegetative material from plots were collected and 6 plant from each plot were weighed.

Cob Width [Cm]—

The width of the cob without grains was measured using a caliper.

Total dry matter=total weight of the vegetative portion above ground (including ears, excluding roots).

Filled/Whole Ear—

Was calculated as the length of the ear with grains out of the total ear length.

Ear Row Num—

The number of rows in each ear was counted.

Stalk Width [cm]—

The diameter of the stalk was measured in the internode located below the main ear. Measurement was performed in 6 plants per each plot.

Leaf area index [LAI]=total leaf area of all plants in a plot. Measurement was performed using a Leaf area-meter.

1000 Grain Weight—

At the end of the experiment all seeds from all plots were collected and weighed and the weight of 1000 was calculated.

Grain Area ($cm^2$)—

At the end of the growing period the grains were separated from the ear. A sample of ~200 grains were weighted, photographed and images were processed using the below described image processing system. The grain area was measured from those images and was divided by the number of grains.

Grain Length and Grain Width (Mm)—

At the end of the growing period the grains were separated from the ear. A sample of ~200 grains were weighted, photographed and images were processed using the below described image processing system. The sum of grain lengths/or width (longest axis) was measured from those images and was divided by the number of grains.

Grain Perimeter (cm)—

At the end of the growing period the grains were separated from the ear. A sample of ~200 grains were weighted, photographed and images were processed using the below described image processing system. The sum of grain perimeter was measured from those images and was divided by the number of grains.

Ear Area ($cm^2$)—

At the end of the growing period 6 ears were photographed and images were processed using the below described image processing system. The Ear area was measured from those images and was divided by the number of Ears.

Ear Filled Grain Area ($cm^2$)—

At the end of the growing period 6 ears were photographed and images were processed using the below described image processing system. The Ear filled grain area was the ear area with grains out of the total ear area and was measured from those images and was divided by the number of Ears.

Ear Length, Width and Perimeter (Cm)—

At the end of the growing period 6 ears were photographed and images were processed using the below described image processing system. The Ear length, width and perimeter was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Example 14

Production of Tomato Transcriptome and High Throughput Correlation Analysis Using 44K Tomato Oligonucleotide Micro-Array In order to produce a high throughput correlation analysis between NUE related phenotypes and gene expression, the present inventors utilized a Tomato oligonucleotide microarray, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 Tomato genes and transcripts. In order to define correlations between the levels of RNA expression with NUE, ABST, yield components or vigor related parameters various plant characteristics of 18 different Tomato varieties were analyzed. Among them, 10 varieties encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of Tomato Varieties Across Ecotypes Grown Under Low Nitrogen, Drought and Regular Growth Conditions Experimental Procedures:

10 Tomato varieties were grown in 3 repetitive blocks, each containing 6 plants per plot were grown at net house. Briefly, the growing protocol was as follows:

1. Regular Growth Conditions:

Tomato varieties were grown under normal conditions (4-6 Liters/$m^2$ of water per day and fertilized with NPK as recommended in protocols for commercial tomato production).

2. Low Nitrogen Fertilization Conditions:

Tomato varieties were grown under normal conditions (4-6 Liters/$m^2$ per day and fertilized with NPK as recommended in protocols for commercial tomato production) until flower stage. At this time, Nitrogen fertilization was stopped.

3. Drought Stress:

Tomato variety was grown under normal conditions (4-6 Liters/$m^2$ per day) until flower stage. At this time, irrigation was reduced to 50% compared to normal conditions. Plants were phenotyped on a daily basis following the standard descriptor of tomato (Table 53). Harvest was conducted while 50% of the fruits were red (mature). Plants were separated to the vegetative part and fruits, of them, 2 nodes were analyzed for additional inflorescent parameters such as size, number of flowers, and inflorescent weight. Fresh weight of all vegetative material was measured. Fruits were separated to colors (red vs. green) and in accordance with the fruit size (small, medium and large). Next, analyzed data was saved to text files and processed using the JMP statistical analysis software (SAS institute). Data parameters collected are summarized in Table 53, hereinbelow.

Analyzed Tomato Tissues—

Two tissues at different developmental stages [flower and leaf], representing different plant characteristics, were sampled and RNA was extracted as described above. For convenience, each micro-array expression information tissue type has received a Set ID as summarized in Table 52 below.

TABLE 52

Tomato transcriptome expression sets

| Expression Set | Set ID |
|---|---|
| Leaf grown under Normal Conditions | A |
| Leaf grown under 50% Irrigation | B |
| Flower grown under Normal Conditions | C |
| Flower grown under 50% Irrigation | D |
| Leaf grown under Low Nitrogen | E |
| Flower grown under Low Nitrogen | F |

Table 52: Provided are the identification (ID) letters of each of the tomato expression sets.

Table 53 provides the tomato correlated parameters (Vectors). The average for each of the measured parameter was calculated using the JMP software and values are summarized in Tables 54-59 below. Subsequent correlation analysis was conducted. Results were integrated to the database.

TABLE 53

Tomato correlated parameters (vectors)

| Correlation set | Correlation ID |
|---|---|
| Average red fruit weight (Normal) [gr.] | 1 |
| Average red fruit weight (Low N) [gr.] | 2 |
| Average red fruit weight Drought [gr.] | 3 |
| Flower cluster weight Drought/Low N) [gr.] | 4 |
| Fruit yield/Plant (Normal) [gr.] | 5 |
| Fruit Yield/Plant (Drought) [gr.] | 6 |
| Fruit Yield/Plant (Low N) [gr.] | 7 |
| FW ratio (Drought/Normal) | 8 |
| FW ratio (Low N/Normal) | 9 |
| FW/Plant (Normal) [gr.] | 10 |
| FW/Plant (Low N) [gr.] | 11 |
| FW/Plant Drought [gr.] | 12 |
| HI (Low N) | 13 |
| HI (Normal) | 14 |
| Leaflet Length [cm] (Low N) | 15 |
| Leaflet Length [cm] (Normal) | 16 |
| Leaflet Width (Low N) | 17 |
| Leaflet Width (Normal) | 18 |
| No. of flowers (Normal) [number] | 19 |
| No. of flowers (Low N) [number] | 20 |
| NUE [yield/SPAD] (Low N) | 21 |
| NUE [yield/SPAD] (Normal) | 22 |
| NUE2 [total biomass/SPAD] (Low N) | 23 |
| NUE2 [total biomass/SPAD] (Normal) | 24 |
| Num. of flowers (Drought) [number] | 25 |
| Ratio Num. Flowers Low N/Normal | 26 |
| NUpE [biomass/SPAD] (Low N) | 27 |
| NUpE [biomass/SPAD] (Normal) | 28 |
| Ratio of Cluster Weight (Low N/Normal) | 29 |
| Ratio of Flower Cluster Weight (Drought/Normal) | 30 |
| Ratio of Fruit Yield (Drought/Normal) | 31 |
| Ratio of Fruits (Drought/NUE) | 32 |
| Ratio of Fruits (Low N/Normal) | 33 |
| Ratio of Number of Flowers (Drought/Normal) | 34 |
| Ratio of Number of Flowers (Drought/NUE) | 35 |
| Ratio of RWC (Low N/Normal) | 36 |
| Ratio of SPAD (Low N/Normal) | 37 |
| Ratio of SPAD 100% RWC (NUE/Normal) | 38 |

TABLE 53-continued

Tomato correlated parameters (vectors)

| Correlation set | Correlation ID |
|---|---|
| Red fruit weight Drought/Normal | 39 |
| RWC (Normal) [%] | 40 |
| RWC Drought [%] | 41 |
| RWC Drought/Normal | 42 |
| RWC under low N [%] | 43 |
| SLA [leaf area/plant biomass] (Low N) | 44 |
| SLA [leaf area/plant biomass] (Normal) | 45 |
| SPAD (Normal) [SPAD unit] | 46 |
| SPAD 100% RWC (Normal) [SPAD unit] | 47 |
| SPAD 100% RWC (Low N) [SPAD unit] | 48 |
| SPAD NUE [SPAD unit] | 49 |
| Total Leaf Area [cm$^2$] (Low N) | 50 |
| Total Leaf Area [cm$^2$] (Normal) | 51 |
| Weight flower clusters (Low N) [gr.] | 52 |
| Weight flower clusters (Drought) [gr.] | 53 |
| Weight Flower clusters (Normal) [gr.] | 54 |
| Weight of 100 green fruits (Normal) | 55 |
| Weight of 100 green fruits (Low N) | 56 |
| Weight of 100 red fruits (Normal) | 57 |
| Weight of 100 red fruits (Low N) | 58 |
| Yield/SLA (Low N) | 59 |
| Yield/SLA (Normal) | 60 |
| Yield/total leaf area (Low N) | 61 |
| Yield/total leaf area (Normal) | 62 |

Table 53. Provided are the tomato correlated parameters. "gr." = grams; "FW" = fresh weight; "NUE" = nitrogen use efficiency; "RWC" = relative water content; "NUpE" = nitrogen uptake efficiency; "SPAD" = chlorophyll levels; "HI" = harvest index (vegetative weight divided on yield); "SLA" = specific leaf area (leaf area divided by leaf dry weight).

Fruit Yield (Grams)—

At the end of the experiment [when 50% of the fruit were ripe (red)] all fruits from plots within blocks A-C were collected. The total fruits were counted and weighted. The average fruits weight was calculated by dividing the total fruit weight by the number of fruits.

Yield/SLA and Yield/Total Leaf Area—

Fruit yield divided by the specific leaf area or the total leaf area gives a measurement of the balance between reproductive and vegetative processes.

Plant Fresh Weight (grams)—

At the end of the experiment [when 50% of the fruit were ripe (red)] all plants from plots within blocks A-C were collected. Fresh weight was measured (grams).

Inflorescence Weight (grams)—

At the end of the experiment [when 50% of the fruits were ripe (red)] two inflorescence from plots within blocks A-C were collected. The inflorescence weight (gr.) and number of flowers per inflorescence were counted.

SPAD—

Chlorophyll content was determined using a Minolta SPAD 502 chlorophyll meter and measurement was performed at time of flowering. SPAD meter readings were done on young fully developed leaf. Three measurements per leaf were taken per plot.

Water Use Efficiency (WUE)—

Can be determined as the biomass produced per unit transpiration. To analyze WUE, leaf relative water content was measured in control and transgenic plants. Fresh weight (FW) was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to the following Formula I [(FW−DW/TW−DW)×100] as described above.

Plants that maintain high relative water content (RWC) compared to control lines were considered more tolerant to drought than those exhibiting reduced relative water content.

Experimental Results

TABLE 54

Measured parameters in Tomato accessions under drought conditions

| Seed ID/Corr. ID | 41 | 42 | 25 | 53 | 34 | 35 | 30 | 4 |
|---|---|---|---|---|---|---|---|---|
| 612 | 72.1 | 0.99 | 16.7 | 0.37 | 2.94 | 0.88 | 0.32 | 0.69 |
| 613 | 74.5 | 0.97 | 6.5 | 0.41 | 0.34 | 1.22 | 1.19 | 1.11 |
| 614 | 65.3 | 1.02 | 15.7 | 0.33 | 2.47 | 1.74 | 0.47 | 1.06 |
| 616 | 72.2 | 1.08 | 20.3 | 0.29 | 2.65 | 1.56 | 0.01 | 0.82 |
| 617 | 66.1 | 1.21 | 11.7 | 0.55 | 1.21 | 1.09 | 1.25 | 1.16 |
| 618 | 68.3 | 0.88 | 25.3 | 0.31 | 3.04 | 1.52 | 0.03 | 1.25 |
| 620 | 78.1 | 1.34 | 29.7 | 0.45 | 5.95 | 4.96 | 0.56 | 1.52 |
| 621 | 18.5 | 0.28 | 17.3 | 0.56 | 2.08 | 1.08 | 0.96 | 1.19 |
| 622 | 73.2 | 1.13 | 14.7 | 0.30 | 1.47 | 0.98 | 0.42 | 0.76 |
| 623 | 62.5 | 0.83 | 29.7 | 0.32 | 4.24 | 4.94 | 0.38 | 1.04 |
| 624 | 67.2 | 1.01 | 15.0 | 0.31 | 1.67 | 0.88 | 0.36 | 0.38 |
| 625 | 75.8 | 1.20 | 10.3 | 0.31 | 1.29 | 0.80 | 0.62 | 0.78 |
| 626 | 62.8 | 1.11 | 18.3 | 8.36 | 3.44 | 2.12 | 8.20 | 24.10 |
| 627 | 70.7 | 1.97 | 12.0 | 0.29 | 1.50 | 1.29 | 0.41 | 0.67 |
| 628 | 55.8 | 0.72 | 20.3 | 0.34 | 2.65 | 1.61 | 0.91 | 0.97 |
| 629 | 75.2 | 0.75 | 12.7 | 0.44 | 1.41 | 1.90 | 0.67 | 0.99 |
| 630 | 63.7 | 1.01 | 12.7 | 0.27 | 1.19 | 1.36 | 0.38 | 0.95 |
| 631 | 62.3 | 0.83 | 11.3 | 0.43 | 1.26 | 1.42 | 1.31 | 0.91 |

Table 54: Provided are the values of each of the parameters (as described above) measured in Sorghum accessions (Seed ID) under drought growth conditions. Growth conditions are specified in the experimental procedure section.

TABLE 55

Additional Measured parameters in Tomato accessions under drought conditions

| Seed ID/Corr. ID | 6 | 12 | 3 | 31 | 32 | 8 | 39 |
|---|---|---|---|---|---|---|---|
| 612 | 0.47 | 2.62 | 0.009 | 0.57 | 1.15 | 1.72 | 0.19 |
| 613 | 0.48 | 1.09 | 0.195 | 1.41 | 0.73 | 0.34 | 24.40 |
| 614 | 0.63 | 1.85 | 0.209 | 1.27 | 1.32 | 0.61 | 25.40 |
| 616 | 0.35 | 2.22 | 0.005 | 2.88 | 0.76 | 2.63 | 0.02 |
| 617 | 2.04 | 2.63 | 0.102 | 4.20 | 1.51 | 1.18 | 20.30 |
| 618 | 0.25 | 2.71 | 0.002 | 0.55 | 0.71 | 1.36 | 0.04 |
| 620 | 0.05 | 3.41 | 0.035 | 0.09 | 5.06 | 4.02 | 0.15 |
| 621 | 0.45 | 2.11 | 0.006 | 1.03 | 0.89 | 1.01 | 0.02 |
| 622 | 0.29 | 1.95 | 0.005 | 1.39 | 0.67 | 0.61 | 0.86 |
| 623 | 1.02 | 1.76 | 0.005 | 3.28 | 2.17 | 0.64 | 0.74 |
| 624 | 0.60 | 1.72 | 0.005 | 0.91 | 0.38 | 0.95 | 0.09 |
| 625 | 0.49 | 1.92 | 0.012 | 2.62 | 1.27 | 0.51 | 1.72 |
| 626 | 0.27 | 2.21 | 0.005 | 0.32 | 0.84 | 1.17 | 0.17 |
| 627 | 0.68 | 3.73 | 0.006 | 2.48 | 1.51 | 1.94 | 0.02 |
| 628 | 0.14 | 0.75 | 0.303 | 0.41 | 0.98 | 0.35 | 10.50 |
| 629 | 0.53 | 1.76 | 0.138 | 1.62 | 1.34 | 1.06 | 27.90 |
| 630 | 0.55 | 0.63 | 0.041 | 1.76 | 0.38 | 0.21 | 11.80 |
| 631 | 0.41 | 1.11 | 0.089 | 1.42 | 0.84 | 0.48 | 9.98 |

Table 55: Provided are the values of each of the parameters (as described above) measured in Tomato accessions (Seed ID) under drought conditions. Growth conditions are specified in the experimental procedure section.

TABLE 56

Measured parameters in Tomato accessions under low nitrogen conditions

| Seed ID/Corr. ID | 7 | 11 | 2 | 33 | 9 | 49 | 43 | 48 | 37 | 38 | 36 | 20 | 52 | 26 |
|---|---|---|---|---|---|---|---|---|---|---|---|---|---|---|
| 612 | 0.41 | 4.04 | 0.024 | 0.492 | 2.65 | 38.4 | 74.1 | 28.5 | 0.77 | 0.79 | 1.0 | 19.0 | 0.53 | 3.35 |
| 613 | 0.66 | 1.21 | 0.191 | 1.93 | 0.38 | 39.4 | 99.1 | 39.0 | 1.06 | 1.37 | 1.3 | 5.3 | 0.37 | 0.28 |
| 614 | 0.48 | 2.25 | 0.006 | 0.97 | 0.74 | 47.5 | 69.5 | 33.0 | 0.85 | 0.92 | 1.1 | 9.0 | 0.31 | 1.42 |
| 616 | 0.46 | 2.54 | 0.005 | 3.80 | 3.01 | 37.0 | 63.2 | 23.4 | 0.80 | 0.75 | 0.9 | 13.0 | 0.35 | 1.70 |
| 617 | 1.35 | 1.85 | 0.096 | 2.78 | 0.83 | 44.6 | 77.4 | 34.5 | 0.93 | 1.31 | 1.4 | 10.7 | 0.47 | 1.10 |
| 618 | 0.35 | 3.06 | 0.004 | 0.78 | 1.54 | 41.7 | 77.9 | 32.5 | 0.96 | 0.97 | 1.0 | 16.7 | 0.25 | 2.00 |
| 620 | 0.01 | 3.13 | 0.006 | 0.02 | 3.70 | 34.4 | 80.5 | 27.7 | 0.80 | 1.11 | 1.4 | 6.0 | 0.29 | 1.20 |
| 621 | 0.51 | 2.54 | 0.007 | 1.16 | 1.22 | 50.0 | 67.4 | 33.7 | 0.94 | 0.95 | 1.0 | 16.0 | 0.47 | 1.92 |
| 622 | 0.44 | 1.84 | 0.006 | 2.07 | 0.58 | 44.7 | 67.2 | 30.0 | 0.76 | 0.79 | 1.0 | 15.0 | 0.40 | 1.50 |
| 623 | 0.47 | 1.52 | 0.013 | 1.51 | 0.55 | 53.7 | 66.1 | 35.5 | 1.05 | 0.92 | 0.9 | 6.0 | 0.30 | 0.86 |
| 624 | 1.59 | 1.91 | 0.021 | 2.41 | 1.06 | 35.7 | 69.6 | 24.8 | 0.89 | 0.94 | 1.1 | 17.0 | 0.82 | 1.89 |
| 625 | 0.39 | 1.86 | 0.005 | 2.03 | 0.49 | 58.8 | 69.3 | 40.8 | 1.24 | 1.36 | 1.1 | 13.0 | 0.40 | 1.62 |
| 626 | 0.32 | 2.47 | 0.006 | 0.38 | 1.31 | 47.5 | 100.0 | 47.5 | 0.82 | 1.44 | 1.8 | 8.7 | 0.35 | 1.62 |
| 627 | 0.45 | 2.62 | 0.048 | 1.64 | 1.36 | 45.2 | 57.7 | 26.1 | 0.94 | 1.50 | 1.6 | 9.3 | 0.43 | 1.17 |
| 628 | 0.14 | 1.08 | 0.357 | 0.41 | 0.51 | 39.0 | 90.8 | 35.4 | 0.89 | 1.05 | 1.2 | 12.7 | 0.35 | 1.65 |
| 629 | 0.40 | 1.17 | 0.037 | 1.21 | 0.71 | 45.0 | 68.0 | 30.6 | 0.83 | 0.56 | 0.7 | 6.7 | 0.45 | 0.74 |
| 630 | 1.44 | 0.92 | 0.626 | 4.59 | 0.31 | 65.3 | 59.6 | 39.0 | 1.57 | 1.48 | 0.9 | 9.3 | 0.28 | 0.88 |
| 631 | 0.50 | 1.09 |  | 1.70 | 0.47 | 51.9 | 72.2 | 37.5 | 0.88 | 0.84 | 1.0 | 8.0 | 0.47 | 0.89 |

Table 56: Provided are the values of each of the parameters (as described above) measured in Tomato accessions (Seed ID) under low nitrogen growth conditions. Growth conditions are specified in the experimental procedure section.

TABLE 57

Additional measured parameters in Tomato accessions under low nitrogen conditions

| Seed ID/Corr. ID | 29 | 21 | 27 | 13 | 23 | 50 | 15 | 17 | 56 | 44 | 61 | 59 | 58 |
|---|---|---|---|---|---|---|---|---|---|---|---|---|---|
| 612 | 0.46 | 0.014 | 0.14 | 0.09 | 0.16 | 566 | 6.4 | 3.5 | 0.87 | 140 | 0.0007 | 0.003 | 1.1 |
| 613 | 1.07 | 0.017 | 0.03 | 0.35 | 0.05 | 385 | 5.9 | 2.0 | 3.66 | 317 | 0.0017 | 0.002 | 6.9 |

TABLE 57-continued

Additional measured parameters in Tomato accessions under low nitrogen conditions

| Seed ID/Corr. ID | 29 | 21 | 27 | 13 | 23 | 50 | 15 | 17 | 56 | 44 | 61 | 59 | 58 |
|---|---|---|---|---|---|---|---|---|---|---|---|---|---|
| 614 | 0.44 | 0.014 | 0.07 | 0.18 | 0.08 | 295 | 3.7 | 1.8 | 0.57 | 131 | 0.0016 | 0.004 | 0.6 |
| 616 | 0.01 | 0.020 | 0.11 | 0.15 | 0.13 | 378 | 5.4 | 2.6 | 0.37 | 149 | 0.0012 | 0.003 | 0.5 |
| 617 | 1.08 | 0.039 | 0.05 | 0.42 | 0.09 | 476 | 7.0 | 3.5 | 3.40 | 258 | 0.0028 | 0.005 | 7.2 |
| 618 | 0.02 | 0.011 | 0.09 | 0.10 | 0.11 | 197 | 3.7 | 1.7 | 0.68 | 64 | 0.0018 | 0.006 | 0.4 |
| 620 | 0.37 | 0.000 | 0.11 | 0.00 | 0.11 | 453 | 4.4 | 1.9 | 0.45 | 145 | 0.0000 | 0.000 | |
| 621 | 0.81 | 0.015 | 0.08 | 0.17 | 0.09 | 626 | 6.7 | 3.5 | 0.47 | 246 | 0.0008 | 0.002 | 0.6 |
| 622 | 0.55 | 0.015 | 0.06 | 0.19 | 0.08 | 748 | 6.7 | 3.3 | 0.54 | 406 | 0.0006 | 0.001 | 0.7 |
| 623 | 0.36 | 0.013 | 0.04 | 0.24 | 0.06 | 454 | 4.4 | 2.5 | 0.39 | 299 | 0.0010 | 0.002 | 0.6 |
| 624 | 0.95 | 0.064 | 0.08 | 0.45 | 0.14 | 165 | 3.9 | 2.6 | 0.97 | 86 | 0.0097 | 0.019 | 1.3 |
| 625 | 0.80 | 0.010 | 0.05 | 0.17 | 0.06 | 338 | 5.3 | 2.6 | 0.91 | 182 | 0.0012 | 0.002 | 1.3 |
| 626 | 0.34 | 0.007 | 0.05 | 0.12 | 0.06 | 396 | 6.3 | 3.6 | 0.36 | 160 | 0.0008 | 0.002 | 0.5 |
| 627 | 0.61 | 0.017 | 0.10 | 0.15 | 0.12 | 236 | 5.1 | 2.6 | 0.35 | 90 | 0.0019 | 0.005 | 0.6 |
| 628 | 0.94 | 0.004 | 0.03 | 0.12 | 0.03 | 175 | 4.7 | 2.5 | 0.57 | 161 | 0.0008 | 0.001 | 0.9 |
| 629 | 0.68 | 0.013 | 0.04 | 0.25 | 0.05 | 442 | 6.8 | 3.4 | 4.38 | 379 | 0.0009 | 0.001 | 6.2 |
| 630 | 0.40 | 0.037 | 0.02 | 0.61 | 0.06 | 489 | 7.1 | 3.3 | 2.02 | 531 | 0.0030 | 0.003 | 3.7 |
| 631 | 1.44 | 0.013 | 0.03 | 0.31 | 0.04 | 708 | 8.2 | 3.7 | 8.13 | 651 | 0.0007 | 0.001 | 11.3 |

Table 57: Provided are the values of each of the parameters (as described above) measured in Tomato accessions (Seed ID) under low nitrogen growth conditions. Growth conditions are specified in the experimental procedure section.

TABLE 58

Measured parameters in Tomato accessions under normal conditions

| Seed ID/Corr. ID | 5 | 10 | 1 | 46 | 40 | 47 | 19 | 54 | 22 | 28 |
|---|---|---|---|---|---|---|---|---|---|---|
| 612 | 0.83 | 1.53 | 0.05 | 49.7 | 72.8 | 36.2 | 5.7 | 1.2 | 0.017 | 0.031 |
| 613 | 0.34 | 3.17 | 0.01 | 37.2 | 76.5 | 28.4 | 19.3 | 0.3 | 0.009 | 0.085 |
| 614 | 0.49 | 3.02 | 0.01 | 55.8 | 64.3 | 35.9 | 6.3 | 0.7 | 0.009 | 0.054 |
| 616 | 0.12 | 0.84 | 0.29 | 46.4 | 67.1 | 31.1 | 7.7 | | 0.003 | 0.018 |
| 617 | 0.49 | 2.24 | 0.01 | 48.2 | 54.8 | 26.4 | 9.7 | 0.4 | 0.010 | 0.046 |
| 618 | 0.45 | 1.98 | 0.05 | 43.4 | 77.6 | 33.7 | 8.3 | | 0.011 | 0.046 |
| 620 | 0.53 | 0.85 | 0.23 | 42.9 | 58.2 | 25.0 | 5.0 | 0.8 | 0.012 | 0.020 |
| 621 | 0.44 | 2.09 | 0.29 | 53.3 | 66.5 | 35.5 | 8.3 | 0.6 | 0.008 | 0.039 |
| 622 | 0.21 | 3.21 | 0.01 | 58.5 | 64.7 | 37.9 | 10.0 | 0.7 | 0.004 | 0.055 |
| 623 | 0.31 | 2.75 | 0.01 | 51.1 | 75.2 | 38.4 | 7.0 | 0.8 | 0.006 | 0.054 |
| 624 | 0.66 | 1.81 | 0.06 | 40.0 | 66.2 | 26.5 | 9.0 | 0.9 | 0.017 | 0.045 |
| 625 | 0.19 | 3.77 | 0.01 | 47.6 | 63.2 | 30.1 | 8.0 | 0.5 | 0.004 | 0.079 |
| 626 | 0.85 | 1.89 | 0.03 | 57.9 | 56.8 | 32.9 | 5.3 | 1.0 | 0.015 | 0.033 |
| 627 | 0.27 | 1.93 | 0.26 | 48.3 | 36.0 | 17.4 | 8.0 | 0.7 | 0.006 | 0.040 |
| 628 | 0.35 | 2.14 | 0.03 | 43.6 | 77.6 | 33.8 | 7.7 | 0.4 | 0.008 | 0.049 |
| 629 | 0.33 | 1.65 | 0.00 | 54.5 | 100.0 | 54.5 | 9.0 | 0.7 | 0.006 | 0.030 |
| 630 | 0.31 | 3.01 | 0.00 | 41.6 | 63.2 | 26.3 | 10.7 | 0.7 | 0.008 | 0.072 |
| 631 | 0.29 | 2.29 | 0.01 | 59.1 | 75.1 | 44.4 | 9.0 | 0.3 | 0.005 | 0.039 |

Table 58: Provided are the values of each of the parameters (as described above) measured in Tomato accessions (Seed ID) under normal growth conditions. Growth conditions are specified in the experimental procedure section.

TABLE 59

Additional measured parameters in Tomato accessions under normal conditions

| Seed ID/Corr. ID | 14 | 24 | 51 | 16 | 18 | 55 | 57 | 45 | 62 | 60 |
|---|---|---|---|---|---|---|---|---|---|---|
| 612 | 0.35 | 0.05 | | | | | | | | |
| 613 | 0.10 | 0.09 | | | | | | | | |
| 614 | 0.14 | 0.06 | 426 | 6.3 | 3.7 | 0.6 | 0.82 | 141 | 0.0012 | 0.0035 |
| 616 | 0.13 | 0.02 | 582 | 8.0 | 4.8 | 3.1 | 2.46 | 690 | 0.0002 | 0.0002 |
| 617 | 0.18 | 0.06 | 291 | 5.6 | 3.4 | 0.2 | 0.50 | 130 | 0.0017 | 0.0037 |
| 618 | 0.19 | 0.06 | 594 | 7.7 | 4.6 | 2.6 | 2.76 | 299 | 0.0008 | 0.0015 |
| 620 | 0.38 | 0.03 | 948 | 7.9 | 4.4 | 6.3 | 5.32 | 1120 | 0.0006 | 0.0005 |
| 621 | 0.17 | 0.05 | 233 | 6.2 | 3.2 | 5.8 | 5.24 | 112 | 0.0019 | 0.0039 |
| 622 | 0.06 | 0.06 | 341 | 6.2 | 3.4 | 0.4 | 0.61 | 106 | 0.0006 | 0.0020 |
| 623 | 0.10 | 0.06 | 339 | 5.7 | 3.1 | 0.3 | 0.66 | 123 | 0.0009 | 0.0025 |
| 624 | 0.27 | 0.06 | 190 | 4.4 | 2.4 | 2.0 | 2.70 | 105 | 0.0035 | 0.0063 |
| 625 | 0.05 | 0.08 | 422 | 4.4 | 2.0 | 2.5 | 0.70 | 112 | 0.0004 | 0.0017 |

TABLE 59-continued

Additional measured parameters in Tomato accessions under normal conditions

| Seed ID/Corr. ID | 14 | 24 | 51 | 16 | 18 | 55 | 57 | 45 | 62 | 60 |
|---|---|---|---|---|---|---|---|---|---|---|
| 626 | 0.31 | 0.05 | 581 | 6.8 | 3.8 | 1.4 | 2.64 | 308 | 0.0015 | 0.0028 |
| 627 | 0.12 | 0.05 | 808 | 7.4 | 3.7 | 2.0 | 4.67 | 419 | 0.0003 | 0.0007 |
| 628 | 0.14 | 0.06 | 784 | 6.7 | 3.0 | 1.4 | 2.17 | 366 | 0.0004 | 0.0009 |
| 629 | 0.17 | 0.04 | 352 | 5.9 | 3.2 | 2.3 | 0.49 | 213 | 0.0009 | 0.0015 |
| 630 | 0.09 | 0.08 | 256 | 4.2 | 2.1 | 0.5 | 0.34 | 85  | 0.0012 | 0.0037 |
| 631 | 0.11 | 0.04 | 1080 | 10.3 | 5.9 | 0.4 | 0.75 | 470 | 0.0003 | 0.0006 |

Table 59: Provided are the values of each of the parameters (as described above) measured in Tomato accessions (Seed ID) under normal growth conditions. Growth conditions are specified in the experimental procedure section.

Correlation of Early Vigor Traits Across Collection of Tomato Ecotypes Under Low Nitrogen, 300 mM NaCl, and Normal Growth Conditions—

Ten tomato hybrids were grown in 3 repetitive plots, each containing 17 plants, at a net house under semi-hydroponics conditions. Briefly, the growing protocol was as follows: Tomato seeds were sown in trays filled with a mix of vermiculite and peat in a 1:1 ratio. Following germination, the trays were transferred to the high salinity solution (300 mM NaCl in addition to the Full Hoagland solution), low nitrogen solution (the amount of total nitrogen was reduced in a 90% from the full Hoagland solution, final amount of 0.8 mM N), cold temperature solution (Full Hoagland at 10° C.), or at Normal growth solution (Full Hoagland containing 8 mM N solution, at 28±2° C.). Plants were grown at 28±2° C.

Full Hoagland solution consists of: $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

Analyzed Tomato Tissues—

All 10 selected Tomato varieties were sample per each treatment. Three tissues [leaves, meristems and flowers] were sampled and RNA was extracted as described above. For convenience, each micro-array expression information tissue type has received a Set ID as summarized in Table 60 below.

TABLE 60

Tomato transcriptome experimental sets

| Expression Set | Set ID |
|---|---|
| Leaves at 300 mM NaCl | A |
| Leaves at Normal conditions | B |
| Leaves at Low Nitrogen conditions | C |
| Roots at 100 mM NaCl | D |
| Roots at Normal conditions | E |
| Roots at Low Nitrogen conditions | F |

Table 60. Provided are the tomato transcriptome experimental sets.

Tomato Vigor Related Parameters— following 5 weeks of growing, plant were harvested and analyzed for Leaf number, plant height, chlorophyll levels (SPAD units), different indices of nitrogen use efficiency (NUE) and plant biomass. Next, analyzed data was saved to text files and processed using the JMP statistical analysis software (SAS institute). Data parameters collected are summarized in Table 61, herein below.

TABLE 61

Tomato correlated parameters (vectors)

| Correlation set | Correlation ID |
|---|---|
| Leaf No. NaCl [number] | 1 |
| Leaf No. Normal [number] | 2 |
| Leaf No. Low N [number] | 3 |
| Leaf No. Ratio NaCl/Normal | 4 |
| Leaf No. Ratio NaCl/Low N | 5 |
| Leaf number ratio Low N/Normal | 6 |
| NUE2 roots (Root Biomass [DW]/SPAD) Cold | 7 |
| NUE2 roots (Root Biomass [DW]/SPAD) Low N | 8 |
| NUE2 roots (Root Biomass [DW]/SPAD) NaCl | 9 |
| NUE2 roots (Root Biomass [DW]/SPAD) Normal | 10 |
| NUE roots (Roots biomass/Nitrogen concentration) Low N | 11 |
| NUE roots (Roots biomass/Nitrogen concentration) Normal | 12 |
| NUE2 shoots (shoot Biomass [DW]/SPAD) Cold | 13 |
| NUE2 shoots (shoot Biomass [DW]/SPAD) Low N | 14 |
| NUE2 shoots (shoot Biomass [DW]/SPAD) NaCl | 15 |
| NUE2 shoots (shoot Biomass [DW]/SPAD) Normal | 16 |
| NUE shoots (Shoots biomass/Nitrogen concentration) Low N | 17 |
| NUE shoots (Shoots biomass/Nitrogen concentration) Normal | 18 |
| NUE2 total biomass (Total Biomass [DW]/SPAD) Cold | 19 |
| NUE2 total biomass (Total Biomass [DW]/SPAD) Low N | 20 |
| NUE2 total biomass (Total Biomass [DW]/SPAD) NaCl | 21 |
| NUE2 total biomass (Total Biomass [DW]/SPAD) Normal | 22 |
| NUE total biomass (Total biomass/Nitrogen concentration) Low N | 23 |
| NUE total biomass (Total biomass/Nitrogen concentration) Normal | 24 |
| Plant biomass NaCl [gr.] | 25 |
| Plant height NaCl [cm] | 26 |
| Plant height Normal [cm] | 27 |
| Plant height Low N [cm] | 28 |
| Plant Height Ratio NaCl/Normal | 29 |
| Plant Height Ratio NaCl/Low N | 30 |
| Plant Height Ratio Low N/Normal | 31 |
| Ratio Shoot Biomass/Root Biomass Normal | 32 |
| Ratio Shoot Biomass/Root Biomass Low N | 33 |
| Root Biomass reduction compared to normal [%] Low N | 34 |
| Shoot Biomass reduction compared to normal [%] Low N | 35 |
| SPAD Cold [SPAD unit] | 36 |
| SPAD NaCl [SPAD unit] | 37 |
| SPAD Normal [SPAD unit] | 38 |
| SPAD Low N [SPAD unit] | 39 |
| Ratio SPAD Low N/Normal | 40 |

Table 61. Provided are the tomato correlated parameters,. "NUE" = nitrogen use efficiency; "DW" = dry weight; "cm" = centimeter.

Experimental Results 10 different Tomato varieties were grown and characterized for parameters as described above. The average for each of the measured parameter was calculated using the JMP software and values are summarized in Tables 62-64 below. Subsequent correlation analysis was conducted. Follow, results were integrated to the database.

TABLE 62

Measured parameters in Tomato accessions under low nitrogen conditions

| Corr. ID/Line | 1139 | 2078 | 2958 | 5077 | 5080 | 5084 | 5085 | 5088 | 5089 | 5092 | 5113 |
|---|---|---|---|---|---|---|---|---|---|---|---|
| 28 | 36.8 | 39.9 | 34.4 | 47.0 | 46.4 | 45.4 | 47.7 | 39.3 | 41.8 | 41.0 | |
| 27 | 45.3 | 47.8 | 40.8 | 55.3 | 56.2 | 48.7 | 55.8 | 37.4 | 49.6 | 46.3 | |
| 39 | 34.6 | 24.9 | 28.6 | 31.6 | 29.7 | 31.8 | 30.3 | 30.3 | 31.3 | 28.8 | |
| 6 | 0.85 | 0.90 | 0.98 | 1.09 | 0.88 | 1.02 | 0.87 | 1.06 | 0.91 | 1.12 | |
| 31 | 0.81 | 0.83 | 0.84 | 0.85 | 0.83 | 0.93 | 0.85 | 1.05 | 0.84 | 0.88 | |
| 40 | 1.01 | 0.98 | 1.02 | 1.00 | 0.98 | 0.98 | 0.93 | 1.05 | 1.01 | 0.99 | |
| 3 | 5.6 | 6.2 | 7.2 | 6.8 | 5.6 | 6.6 | 5.1 | 5.9 | 5.6 | 6.3 | |
| 14 | 0.004 | 0.004 | 0.003 | 0.007 | 0.005 | 0.005 | 0.012 | 0.007 | 0.007 | 0.007 | 0.006 |
| 8 | 0.001 | 0.001 | 0.000 | 0.001 | 0.001 | 0.001 | 0.001 | 0.001 | 0.001 | 0.001 | 0.001 |
| 20 | 0.005 | 0.005 | 0.003 | 0.008 | 0.005 | 0.006 | 0.013 | 0.008 | 0.008 | 0.008 | 0.007 |
| 539 | 10.9 | 11.5 | 11.4 | 10.4 | 11.2 | 8.9 | 7.9 | 8.0 | 10.3 | 8.6 | 14.5 |
| 33 | 5.0 | 6.4 | 11.4 | 9.5 | 11.6 | 8.2 | 10.4 | 10.5 | 8.2 | 8.0 | 3.9 |
| 35 | 75.4 | 62.2 | 55.1 | 49.7 | 63.2 | 82.7 | 66.9 | 108. | 55.4 | 54.4 | 59.7 |
| 34 | 62.6 | 144.0 | 54.2 | 70.5 | 59.7 | 96.1 | 107.0 | 112.0 | 81.6 | 32.2 | 87.5 |
| 17 | 35.4 | 38.4 | 24.1 | 65.0 | 46.7 | 46.7 | 120.0 | 60.1 | 66.3 | 56.5 | 60.3 |
| 11 | 7.0 | 7.7 | 2.5 | 7.0 | 5.0 | 8.0 | 15.1 | 9.0 | 8.8 | 7.3 | 15.9 |
| 23 | 58.5 | 69.7 | 63.8 | 69.3 | 71.1 | 60.5 | 73.9 | 68.8 | 66.7 | 70.8 | 49.7 |

Table 62: Provided are the values of each of the parameters (as described above) measured in Tomato accessions (Line) under low nitrogen growth conditions. Growth conditions are specified in the experimental procedure section.

TABLE 63

Measured parameters in Tomato accessions under normal conditions

| Corr. ID/Line | 1139 | 2078 | 2958 | 5077 | 5080 | 5084 | 5085 | 5088 | 5089 | 5092 | 5113 |
|---|---|---|---|---|---|---|---|---|---|---|---|
| 2 | 6.6 | 6.9 | 7.3 | 6.2 | 6.3 | 6.4 | 5.9 | 5.6 | 6.1 | 5.7 | |
| 27 | 45.3 | 47.8 | 40.8 | 55.3 | 56.2 | 48.7 | 55.8 | 37.4 | 49.6 | 46.3 | |
| 38 | 34.3 | 25.3 | 28.1 | 31.4 | 30.2 | 32.4 | 32.6 | 28.8 | 30.9 | 29.0 | |
| 16 | 0.005 | 0.006 | 0.005 | 0.014 | 0.008 | 0.005 | 0.017 | 0.007 | 0.011 | 0.012 | 0.009 |
| 10 | 0.001 | 0.001 | 0.001 | 0.001 | 0.001 | 0.001 | 0.001 | 0.001 | 0.001 | 0.003 | 0.002 |
| 22 | 0.006 | 0.007 | 0.006 | 0.016 | 0.009 | 0.006 | 0.019 | 0.008 | 0.012 | 0.014 | 0.011 |
| 38 | 9.3 | 10.2 | 8.9 | 8.4 | 9.8 | 8.6 | 6.6 | 7.0 | 8.7 | 7.4 | 9.4 |
| 32 | 5.4 | 12.7 | 10.0 | 15.4 | 8.8 | 7.5 | 12.6 | 8.0 | 14.3 | 4.8 | 6.3 |
| 18 | 4.7 | 6.2 | 4.4 | 13.1 | 7.4 | 5.7 | 17.9 | 5.6 | 12.0 | 10.4 | 10.1 |
| 12 | 1.1 | 0.5 | 0.5 | 1.0 | 0.8 | 0.8 | 0.9 | 0.8 | 1.1 | 2.3 | 1.8 |
| 24 | 7.5 | 9.1 | 8.6 | 8.9 | 7.2 | 7.9 | 9.1 | 7.9 | 8.6 | 8.7 | 6.2 |

Table 63: Provided are the values of each of the parameters (as described above) measured in Tomato accessions (Line) under normal growth conditions. Growth conditions are specified in the experimental procedure section.

TABLE 64

Measured parameters in Tomato accessions under salinity conditions

| Corr. ID/Line | 1139 | 2078 | 2958 | 5077 | 5080 | 5084 | 5085 | 5088 | 5089 | 5092 | 5113 |
|---|---|---|---|---|---|---|---|---|---|---|---|
| 1 | 3.6 | 3.9 | 5.0 | 4.0 | 3.6 | 4.4 | 3.2 | 3.7 | 4.0 | 4.3 | |
| 26 | 5.6 | 6.5 | 8.5 | 8.6 | 8.9 | 7.6 | 8.6 | 5.6 | 5.8 | 9.4 | |
| 25 | 0.36 | 0.44 | 0.26 | 0.71 | 0.46 | 0.54 | 0.66 | 0.40 | 0.52 | 0.45 | |
| 4 | 0.54 | 0.57 | 0.68 | 0.64 | 0.56 | 0.68 | 0.54 | 0.67 | 0.65 | 0.75 | |
| 5 | 0.64 | 0.63 | 0.69 | 0.59 | 0.64 | 0.67 | 0.62 | 0.63 | 0.72 | 0.68 | |
| 29 | 0.12 | 0.14 | 0.21 | 0.15 | 0.16 | 0.16 | 0.15 | 0.15 | 0.12 | 0.20 | |
| 30 | 0.15 | 0.16 | 0.25 | 0.18 | 0.19 | 0.17 | 0.18 | 0.14 | 0.14 | 0.23 | |
| 15 | 0.00051 | 0.00072 | 0.00067 | 0.00117 | 0.00172 | 0.00098 | 0.00117 | 0.00075 | 0.00101 | 0.00102 | 0.00069 |
| 37 | 11.4 | 10.4 | 11.6 | 10.8 | 10.8 | 7.0 | 9.2 | 8.5 | 10.4 | 8.8 | 12.4 |
| 9 | 0.00006 | 0.00005 | 0.00011 | 0.00010 | 0.00007 | 0.00009 | 0.00010 | 0.00008 | 0.00009 | | 0.00005 |
| 21 | 0.0072 | 0.00063 | 0.00081 | 0.00142 | 0.00178 | 0.00107 | 0.00126 | 0.00083 | 0.00111 | | 0.00069 |

Table 64: Provided are the values of each of the parameters (as described above) measured in Tomato accessions (Line) under salinity growth conditions. Growth conditions are specified in the experimental procedure section.

Example 15

Gene Cloning and Generation of Binary Vectors for Plant Expression

To validate their role in improving yield, selected genes were over-expressed in plants, as follows.

Cloning Strategy

Selected genes from those presented in Examples 1-14 hereinabove were cloned into binary vectors for the generation of transgenic plants. For cloning, the full-length open reading frames (ORFs) were identified. EST clusters and in some cases mRNA sequences were analyzed to identify the entire open reading frame by comparing the results of several translation algorithms to known proteins from other plant species.

In order to clone the full-length cDNAs, reverse transcription (RT) followed by polymerase chain reaction (PCR; RT-PCR) was performed on total RNA extracted from leaves, roots or other plant tissues, growing under normal/limiting or stress conditions. Total RNA extraction, production of cDNA and PCR amplification was performed using standard protocols described elsewhere (Sambrook J., E. F. Fritsch, and T. Maniatis. 1989. Molecular Cloning. A Laboratory Manual, 2nd Ed. Cold Spring Harbor Laboratory Press, New York.) which are well known to those skilled in the art. PCR products were purified using PCR purification kit (Qiagen).

Usually, 2 sets of primers were prepared for the amplification of each gene, via nested PCR (if required). Both sets of primers were used for amplification on cDNA. In case no product was obtained, a nested PCR reaction was performed. Nested PCR was performed by amplification of the gene using external primers and then using the produced PCR product as a template for a second PCR reaction, where the internal set of primers were used. Alternatively, one or two of the internal primers were used for gene amplification, both in the first and the second PCR reactions (meaning only 2-3 primers are designed for a gene). To facilitate further cloning of the cDNAs, an 8-12 base pairs (bp) extension was added to the 5' of each internal primer. The primer extension includes an endonuclease restriction site. The restriction sites were selected using two parameters: (a) the restriction site does not exist in the cDNA sequence; and (b) the restriction sites in the forward and reverse primers were designed such that the digested cDNA was inserted in the sense direction into the binary vector utilized for transformation.

PCR products were digested with the restriction endonucleases (New England BioLabs Inc) according to the sites designed in the primers. Each digested PCR product was inserted into a high copy vector pUC19 (New England BioLabs Inc], or into plasmids originating from this vector. In some cases the undigested PCR product was inserted into pCR-Blunt II-TOPO (Invitrogen) or directly into the binary vector. The digested products and the linearized plasmid vector were ligated using T4 DNA ligase enzyme (Roche, Switzerland).

Sequencing of the inserted genes was performed, using the ABI 377 sequencer (Applied Biosystems). In some cases, after confirming the sequences of the cloned genes, the cloned cDNA was introduced into a modified pGI binary vector containing the At6669 promoter (e.g., pQFNc) and the NOS terminator (SEQ ID NO: 6066) via digestion with appropriate restriction endonucleases.

Several DNA sequences of the selected genes were synthesized by GeneArt [Hypertext Transfer Protocol://World Wide Web (dot) geneart (dot) com/]. Synthetic DNA was designed in silico. Suitable restriction enzymes sites were added to the cloned sequences at the 5' end and at the 3' end to enable later cloning into the desired binary vector.

The pPI plasmid vector was constructed by inserting a synthetic poly-(A) signal sequence, originating from pGL3 basic plasmid vector (Promega, GenBank Accession No. U47295; nucleotides 4658-4811) into the HindIII restriction site of the binary vector pBI101.3 (Clontech, GenBank Accession No. U12640). pGI is similar to pPI, but the original gene in the backbone is GUS-Intron and not GUS.

The modified pGI vector (e.g., pQFN, pQFNc, pQYN_6669, pQNa_RP, pQFYN or pQXNc) is a modified version of the pGI vector in which the cassette is inverted between the left and right borders so the gene and its corresponding promoter are close to the right border and the NPTII gene is close to the left border.

At6669, the new *Arabidopsis thaliana* promoter sequence (SEQ ID NO:3714) was inserted in the modified pGI binary vector, upstream to the cloned genes, followed by DNA ligation and binary plasmid extraction from positive *E. coli* colonies, as described above. Colonies were analyzed by PCR using the primers covering the insert which were designed to span the introduced promoter and gene. Positive plasmids were identified, isolated and sequenced.

In case genomic DNA was cloned, the genes were amplified by direct PCR on genomic DNA extracted from leaf tissue using the DNAeasy kit (Qiagen Cat. No. 69104).

Selected genes cloned by the present inventors are provided in Table 65 below.

TABLE 65

Genes cloned in High copy number plasmids or in binary vectors and the primers used for cloning of the genes

| Gene Name | High copy plasmid | Organism | Primers used SEQ ID NOs: | Polyn. SEQ ID NO: | Polyp. SEQ ID NO: |
|---|---|---|---|---|---|
| LNU521 | pMA-RQ_LNU521_GA | | | 259 | 470 |
| LNU522 | pUC19c_LNU522 | ARABIDOPSIS *Arabidopsis thaliana* | 6612, 6066, 6268, 6460 | 260 | 471 |
| LNU523 | pMA-RQ_LNU523_GA | | | 261 | 472 |
| LNU524 | pUC19c_LNU524 | ARABIDOPSIS *Arabidopsis thaliana* | 6613, 6067, 6269, 6461 | 262 | 473 |
| LNU526 | pUC19c_LNU526 | ARABIDOPSIS *Arabidopsis thaliana* | 6270, 6068, 6270, 6068 | 263 | 704 |
| LNU527 | pUC19c_LNU527 | ARABIDOPSIS *Arabidopsis thaliana* | 6614, 6069, 6271, 6462 | 264 | 475 |
| LNU528 | pUC19c_LNU528 | BARLEY *Hordeum vulgare* L. | 6272, 6070, 6272, 6463 | 265 | 476 |
| LNU529 | pUC19c_LNU529 | BARLEY *Hordeum vulgare* L. | 6273, 6071, 6273, 6071 | 266 | 477 |
| LNU530 | pUC19c_LNU530 | BARLEY *Hordeum vulgare* L. | 6615, 6072, 6274, 6464 | 267 | 478 |
| LNU531 | pUC19c_LNU531 | BARLEY *Hordeum vulgare* L. | 6616, 6073, 6275, 6465 | 268 | 479 |
| LNU532 | pUC19c_LNU532 | BARLEY *Hordeum vulgare* L. | 6617, 6074, 6276, 6466 | 269 | 480 |
| LNU533 | pUC19c_LNU533 | BARLEY *Hordeum vulgare* L. | 6618, 6075, 6277, 6467 | 270 | 705 |

TABLE 65-continued

Genes cloned in High copy number plasmids or in binary vectors and the primers used for cloning of the genes

| Gene Name | High copy plasmid | Organism | Primers used SEQ ID NOs: | Polyn. SEQ ID NO: | Polyp. SEQ ID NO: |
|---|---|---|---|---|---|
| LNU534 | pUC19c_LNU534 | BARLEY *Hordeum vulgare* L. | 6278, 6076, 6278, 6076 | 271 | 482 |
| LNU536 | pUC19c_LNU536 | BARLEY *Hordeum vulgare* L. | 6619, 6077, 6279, 6468 | 272 | 483 |
| LNU537 | pUC19c_LNU537 | BARLEY *Hordeum vulgare* L. | 6280, 6078, 6280, 6469 | 273 | 484 |
| LNU539 | pUC19c_LNU539 | BARLEY *Hordeum vulgare* L. | 6281, 6079, 6281, 6079 | 274 | 485 |
| LNU540 | pUC19c_LNU540 | BARLEY *Hordeum vulgare* L. | 6282, 6080, 6282, 6080 | 275 | 486 |
| LNU542 | pUC19c_LNU542 | BARLEY *Hordeum vulgare* L. | 6283, 6081, 6283, 6081 | 276 | 487 |
| LNU543 | pUC19c_LNU543 | BARLEY *Hordeum vulgare* L. | 6620, 6082, 6284, 6082 | 277 | 706 |
| LNU544 | pUC19c_LNU544 | BARLEY *Hordeum vulgare* L. | 6621, 6083, 6285, 6470 | 278 | 489 |
| LNU545 | pUC19_LNU545 | BARLEY *Hordeum vulgare* L. | 6622, 6084, 6286, 6471 | 279 | 707 |
| LNU546 | pQFNc_LNU546 | BARLEY *Hordeum vulgare* L. | 6287, 6085, 6287, 6085 | 280 | 708 |
| LNU547 | pUC19c_LNU547 | BARLEY *Hordeum vulgare* L. | 6623, 6086, 6288, 6472 | 281 | 492 |
| LNU548 | pUC19c_LNU548 | BARLEY *Hordeum vulgare* L. | 6624, 6087, 6289, 6473 | 282 | 493 |
| LNU549 | pQFNc_LNU549 | BARLEY *Hordeum vulgare* L. | 6625, 6088, 6290, 6474 | 283 | 494 |
| LNU550 | pUC19c_LNU550 | BARLEY *Hordeum vulgare* L. | 6291, 6089, 6291, 6089 | 284 | 495 |
| LNU553 | pUC19c_LNU553 | BARLEY *Hordeum vulgare* L. | 6626, 6090, 6292, 6475 | 285 | 709 |
| LNU554 | pUC19c_LNU554 | BARLEY *Hordeum vulgare* L. | 6627, 6091, 6293, 6476 | 286 | 498 |
| LNU555 | pUC19c_LNU555 | BARLEY *Hordeum vulgare* L. | 6628, 6092, 6294, 6477 | 287 | 499 |
| LNU556 | pQFNc_LNU556 | BARLEY *Hordeum vulgare* L. | 6629, 6093, 6295, 6478 | 288 | 710 |
| LNU557 | pUC19c_LNU557 | BARLEY *Hordeum vulgare* L. | 6296, 6094, 6296, 6094 | 289 | 711 |
| LNU558 | pUC19c_LNU558 | BARLEY *Hordeum vulgare* L. | 6630, 6095 | 290 | 502 |
| LNU559 | pUC19c_LNU559 | BARLEY *Hordeum vulgare* L. | 6631, 6096, 6297, 6479 | 291 | 503 |
| LNU560 | pUC19c_LNU560 | BARLEY *Hordeum vulgare* L. | 6632, 6097, 6298, 6480 | 292 | 504 |
| LNU561 | pUC19c_LNU561 | BARLEY *Hordeum vulgare* L. | 6633, 6098, 6299, 6481 | 293 | 712 |
| LNU562 | pUC19c_LNU562 | BARLEY *Hordeum vulgare* L. | 6634, 6099, 6300, 6482 | 294 | 713 |
| LNU563 | pUC19c_LNU563 | BARLEY *Hordeum vulgare* L. | 6301, 6100, 6301, 6483 | 295 | 507 |
| LNU564 | pUC19c_LNU564 | BARLEY *Hordeum vulgare* L. | 6635, 6101, 6302, 6484 | 296 | 508 |
| LNU565 | pQFNc_LNU565 | BARLEY *Hordeum vulgare* L. | 6636, 6102, 6303, 6485 | 297 | 509 |
| LNU566 | pUC19c_LNU566 | BARLEY *Hordeum vulgare* L. | 6637, 6103, 6304, 6486 | 298 | 714 |
| LNU567 | pUC19c_LNU567 | BARLEY *Hordeum vulgare* L. | 6638, 6104, 6305, 6487 | 299 | 511 |
| LNU568 | pUC19c_LNU568 | BARLEY *Hordeum vulgare* L. | 6306, 6105, 6306, 6488 | 300 | 715 |
| LNU569 | pQFNc_LNU569 | BARLEY *Hordeum vulgare* L. | 6307, 6106, 6307, 6489 | 301 | 716 |
| LNU570 | pUC19c_LNU570 | BARLEY *Hordeum vulgare* L. | 6639, 6107, 6308, 6490 | 302 | 514 |
| LNU571 | pUC19c_LNU571 | BARLEY *Hordeum vulgare* L. | 6640, 6108, 6309, 6491 | 303 | 717 |
| LNU572 | pUC19c_LNU572 | BARLEY *Hordeum vulgare* L. | 6641, 6109, 6310, 6492 | 304 | 718 |
| LNU573 | pQFNc_LNU573 | BARLEY *Hordeum vulgare* L. | 6311, 6110, 6311, 6110 | 305 | 517 |
| LNU574 | pQFNc_LNU574 | BARLEY *Hordeum vulgare* L. | 6642, 6111, 6312, 6493 | 306 | 719 |
| LNU575 | pUC19c_LNU575 | BARLEY *Hordeum vulgare* L. | 6643, 6112, 6313, 6494 | 307 | 519 |
| LNU576 | pUC19c_LNU576 | BARLEY *Hordeum vulgare* L. | 6644, 6113, 6314, 6495 | 308 | 720 |
| LNU577 | pUC19c_LNU577 | BARLEY *Hordeum vulgare* L. | 6645, 6114, 6315, 6496 | 309 | 721 |
| LNU580 | pUC19c_LNU580 | BARLEY *Hordeum vulgare* L. | 6316, 6115, 6316, 6497 | 310 | 524 |
| LNU581 | pUC19c_LNU581 | BRACHYPODIUM *Brachypodium distachyon* | 6646, 6116 | 311 | 525 |
| LNU582 | pUC19c_LNU582 | BRACHYPODIUM *Brachypodium distachyon* | 6647, 6117, 6317, 6498 | 312 | 526 |
| LNU583 | pQFNc_LNU583p | BRACHYPODIUM *Brachypodium distachyon* | 6648, 6118 | 313 | 722 |
| LNU584 | pUC19c_LNU584 | BRACHYPODIUM *Brachypodium distachyon* | 6318, 6119, 6318, 6119 | 314 | 528 |
| LNU585 | pQFNc_LNU585 | BRACHYPODIUM *Brachypodium distachyon* | 6319, 6120, 6319, 6120 | 315 | 529 |
| LNU587 | pUC19c_LNU587 | FOXTAIL *Setaria italica* | 6649, 6121, 6320, 6499 | 316 | 530 |
| LNU588 | pUC19c_LNU588 | FOXTAIL *Setaria italica* | 6650, 6122, 6321, 6500 | 317 | 531 |
| LNU589 | pUC19c_LNU589 | FOXTAIL *Setaria italica* | 6651, 6123, 6322, 6501 | 318 | 532 |
| LNU590 | pUC19c_LNU590 | FOXTAIL *Setaria italica* | 6652, 6124, 6323, 6502 | 319 | 723 |
| LNU591 | pQFNc_LNU591 | FOXTAIL *Setaria italica* | 6653, 6125, 6324, 6503 | 320 | 534 |
| LNU592 | pUC19c_LNU592 | MAIZE *Zea mays* L. | 6654, 6126, 6325, 6504 | 321 | 535 |
| LNU593 | pMA-RQ_LNU593_GA | | | 322 | 536 |
| LNU594 | pUC19c_LNU594 | MAIZE *Zea mays* L. | 6655, 6127, 6326, 6505 | 323 | 537 |
| LNU595 | pUC19c_LNU595 | MAIZE *Zea mays* L. | 6656, 6128, 6327, 6506 | 324 | 724 |
| LNU596 | pUC19c_LNU596 | MAIZE *Zea mays* L. | 6657, 6129, 6328, 6507 | 325 | 539 |
| LNU597 | pQFNc_LNU597 | MAIZE *Zea mays* L. | 6658, 6130, 6329, 6508 | 326 | 725 |
| LNU598 | pUC19c_LNU598 | MAIZE *Zea mays* L. | 6659, 6131, 6330, 6509 | 327 | 726 |
| LNU600 | pUC19c_LNU600 | MAIZE *Zea mays* L. | 6660, 6132, 6331, 6510 | 328 | 727 |
| LNU601 | pUC19c_LNU601 | MAIZE *Zea mays* L. | 6661, 6133, 6332, 6511 | 329 | 728 |
| LNU602 | pUC19c_LNU602 | MAIZE *Zea mays* L. | 6662, 6134, 6333, 6512 | 330 | 729 |
| LNU603 | pMA-RQ_LNU603_GA | | | 331 | 545 |
| LNU604 | pUC19c_LNU604 | MAIZE *Zea mays* L. | 6663, 6135, 6334, 6513 | 332 | 546 |
| LNU605 | pUC19c_LNU605 | MAIZE *Zea mays* L. | 6664, 6136, 6335, 6514 | 333 | 730 |
| LNU606 | pUC19c_LNU606 | MAIZE *Zea mays* L. | 6665, 6137, 6336, 6515 | 334 | 548 |
| LNU607 | pUC19c_LNU607 | MAIZE *Zea mays* L. | 6337, 6138, 6337, 6138 | 335 | 549 |
| LNU608 | pUC19c_LNU608 | MAIZE *Zea mays* L. | 6338, 6139, 6338, 6139 | 469 | — |
| LNU609 | pUC19c_LNU609 | MAIZE *Zea mays* L. | 6339, 6140, 6339, 6140 | 336 | 731 |
| LNU610 | pUC19c_LNU610 | MAIZE *Zea mays* L. | 6666, 6141, 6340, 6516 | 337 | 551 |
| LNU611 | pUC19_LNU611 | MAIZE *Zea mays* L. | 6667, 6142, 6341, 6517 | 338 | 732 |

TABLE 65-continued

Genes cloned in High copy number plasmids or in binary vectors and the primers used for cloning of the genes

| Gene Name | High copy plasmid | Organism | Primers used SEQ ID NOs: | Polyn. SEQ ID NO: | Polyp. SEQ ID NO: |
|---|---|---|---|---|---|
| LNU612 | pUC19c_LNU612 | MAIZE *Zea mays* L. | 6342, 6143, 6342, 6143 | 339 | 553 |
| LNU613 | pMA-RQ_LNU613_GA | | | 340 | 554 |
| LNU614 | pUC19d_LNU614 | MAIZE *Zea mays* L. | 6668, 6144, 6343, 6518 | 341 | 555 |
| LNU615 | pQFNc_LNU615 | MAIZE *Zea mays* L. | 6669, 6145, 6344, 6519 | 342 | 556 |
| LNU616 | pUC19d_LNU616 | MAIZE *Zea mays* L. | 6670, 6146, 6345, 6146 | 343 | 557 |
| LNU617 | pUC19c_LNU617 | MAIZE *Zea mays* L. | 6671, 6147, 6346, 6520 | 344 | 733 |
| LNU618 | pUC19c_LNU618 | MAIZE *Zea mays* L. | 6672, 6148, 6347, 6521 | 345 | 734 |
| LNU619 | pUC19c_LNU619 | MAIZE *Zea mays* L. | 6673, 6149, 6348, 6522 | 346 | 735 |
| LNU620 | pUC19c_LNU620 | MAIZE *Zea mays* L. | 6674, 6150, 6349, 6523 | 347 | 736 |
| LNU621 | pUC19c_LNU621 | MAIZE *Zea mays* L. | 6675, 6151, 6350, 6524 | 348 | 562 |
| LNU622 | pUC19c_LNU622 | MAIZE *Zea mays* L. | 6351, 6152, 6351, 6152 | 349 | 563 |
| LNU623 | pUC19c_LNU623 | MAIZE *Zea mays* L. | 6676, 6153, 6352, 6525 | 350 | 564 |
| LNU624 | pUC19c_LNU624 | MAIZE *Zea mays* L. | 6353, 6154, 6353, 6154 | 351 | 565 |
| LNU625 | pUC19c_LNU625 | MAIZE *Zea mays* L. | 6677, 6155, 6354, 6526 | 352 | 737 |
| LNU626 | pUC19c_LNU626 | MAIZE *Zea mays* L. | 6355, 6156, 6355, 6156 | 353 | 567 |
| LNU627 | pUC19c_LNU627 | MAIZE *Zea mays* L. | 6678, 6157, 6356, 6527 | 354 | 738 |
| LNU628 | pQFNc_LNU628 | MAIZE *Zea mays* L. | 6679, 6158, 6357, 6528 | 355 | 569 |
| LNU629 | pUC19c_LNU629 | MAIZE *Zea mays* L. | 6358, 6159, 6358, 6529 | 356 | 570 |
| LNU630 | pUC19c_LNU630 | MAIZE *Zea mays* L. | 6680, 6160, 6359, 6530 | 357 | 571 |
| LNU631 | pUC19c_LNU631 | MAIZE *Zea mays* L. | 6681, 6161, 6360, 6531 | 358 | 572 |
| LNU632 | pUC19c_LNU632 | MAIZE *Zea mays* L. | 6361, 6162, 6361, 6162 | 359 | 573 |
| LNU634 | pUC19c_LNU634 | MAIZE *Zea mays* L. | 6682, 6163, 6362, 6532 | 360 | 574 |
| LNU635 | pUC19_LNU635 | MAIZE *Zea mays* L. | 6363, 6164, 6363, 6164 | 361 | 739 |
| LNU636_H1 | pMA_LNU636_H1_GA | | | 468 | 683 |
| LNU637 | pUC19c_LNU637 | MAIZE *Zea mays* L. | 6683, 6165, 6364, 6533 | 362 | 740 |
| LNU638 | pUC19c_LNU638 | MAIZE *Zea mays* L. | 6365, 6166, 6365, 6166 | 363 | 696 |
| LNU639 | pUC19c_LNU639 | MAIZE *Zea mays* L. | 6684, 6167, 6366, 6534 | 364 | 579 |
| LNU640 | pUC19c_LNU640 | MAIZE *Zea mays* L. | 6685, 6168, 6367, 6535 | 365 | 741 |
| LNU641 | pQFNc_LNU641 | MAIZE *Zea mays* L. | 6368, 6169, 6368, 6169 | 366 | 581 |
| LNU642 | pUC19c_LNU642 | MAIZE *Zea mays* L. | 6686, 6170, 6369, 6536 | 367 | 742 |
| LNU643 | pUC19c_LNU643 | MAIZE *Zea mays* L. | 6687, 6171, 6370, 6537 | 368 | 583 |
| LNU644 | pUC19c_LNU644 | RICE *Oryza sativa* L. | 6371, 6172, 6371, 6172 | 369 | 743 |
| LNU645 | pUC19c_LNU645 | RICE *Oryza sativa* L. | 6688, 6173, 6372, 6538 | 370 | 585 |
| LNU646 | pUC19c_LNU646 | RICE *Oryza sativa* L. | 6373, 6174, 6373, 6174 | 371 | 586 |
| LNU647 | pUC19_LNU647 | RICE *Oryza sativa* L. | 6689, 6175, 6374, 6539 | 372 | 587 |
| LNU648 | pUC19c_LNU648 | RICE *Oryza sativa* L. | 6690, 6176, 6375, 6540 | 373 | 588 |
| LNU649 | pUC19c_LNU649 | SORGHUM *Sorghum bicolor* | 6376, 6177, 6376, 6541 | 374 | 589 |
| LNU650 | pUC19c_LNU650 | SORGHUM *Sorghum bicolor* | 6691, 6178, 6377, 6542 | 375 | 590 |
| LNU651 | pQFNc_LNU651 | SORGHUM *Sorghum bicolor* | 6692, 6179, 6378, 6543 | 376 | 591 |
| LNU652 | pUC19c_LNU652 | SORGHUM *Sorghum bicolor* | 6693, 6180, 6379, 6544 | 377 | 744 |
| LNU653 | pUC19c_LNU653 | SORGHUM *Sorghum bicolor* | 6694, 6181, 6380, 6545 | 378 | 593 |
| LNU654 | pUC19c_LNU654 | SORGHUM *Sorghum bicolor* | 6695, 6182, 6381, 6546 | 379 | 594 |
| LNU655 | pQFNc_LNU655 | SORGHUM *Sorghum bicolor* | 6382, 6183, 6382, 6547 | 380 | 745 |
| LNU656 | pUC19c_LNU656 | SORGHUM *Sorghum bicolor* | 6383, 6184, 6383, 6548 | 381 | 596 |
| LNU657 | pUC19c_LNU657 | SORGHUM *Sorghum bicolor* | 6696, 6185, 6384, 6549 | 382 | 597 |
| LNU658 | pUC19c_LNU658 | SORGHUM *Sorghum bicolor* | 6697, 6186, 6385, 6550 | 383 | 598 |
| LNU659 | pUC19c_LNU659 | SORGHUM *Sorghum bicolor* | 6698, 6187, 6386, 6551 | 384 | 599 |
| LNU660 | pUC19c_LNU660 | SORGHUM *Sorghum bicolor* | 6699, 6188, 6387, 6552 | 385 | 600 |
| LNU661 | pQFNc_LNU661 | SORGHUM *Sorghum bicolor* | 6388, 6189, 6388, 6189 | 386 | 746 |
| LNU662 | pUC19c_LNU662 | SORGHUM *Sorghum bicolor* | 6389, 6190, 6389, 6553 | 387 | 602 |
| LNU663 | pUC19c_LNU663 | SORGHUM *Sorghum bicolor* | 6700, 6191, 6390, 6554 | 388 | 603 |
| LNU664 | pQFNc_LNU664 | SORGHUM *Sorghum bicolor* | 6701, 6192 | 389 | 747 |
| LNU665 | TopoB_LNU665 | SORGHUM *Sorghum bicolor* | 6702, 6193, 6391, 6555 | 390 | 605 |
| LNU666 | pUC19c_LNU666 | SORGHUM *Sorghum bicolor* | 6703, 6194, 6392, 6556 | 391 | 748 |
| LNU667 | pMA-RQ_LNU667_GA | | | 392 | 607 |
| LNU668 | pUC19c_LNU668 | SORGHUM *Sorghum bicolor* | 6704, 6195, 6393, 6557 | 393 | 608 |
| LNU669 | pUC19c_LNU669 | SORGHUM *Sorghum bicolor* | 6705, 6196, 6394, 6558 | 394 | 609 |
| LNU670 | pUC19c_LNU670 | SORGHUM *Sorghum bicolor* | 6706, 6197, 6395, 6559 | 395 | 610 |
| LNU671 | pUC19c_LNU671 | SORGHUM *Sorghum bicolor* | 6707, 6198 | 396 | 611 |
| LNU672 | pUC19_LNU672 | SORGHUM *Sorghum bicolor* | 6708, 6199, 6396, 6560 | 397 | 612 |
| LNU673 | pUC19c_LNU673 | SORGHUM *Sorghum bicolor* | 6397, 6200, 6397, 6561 | 398 | 613 |
| LNU674 | pUC19c_LNU674 | SORGHUM *Sorghum bicolor* | 6398, 6201, 6398, 6201 | 399 | 614 |
| LNU675 | pUC19c_LNU675 | SORGHUM *Sorghum bicolor* | 6399, 6202, 6399, 6202 | 400 | 615 |
| LNU676 | pUC19c_LNU676 | SORGHUM *Sorghum bicolor* | 6709, 6203, 6400, 6562 | 401 | 616 |
| LNU677 | pUC19c_LNU677 | SORGHUM *Sorghum bicolor* | 6710, 6204, 6401, 6563 | 402 | 617 |
| LNU679 | pUC19c_LNU679 | SORGHUM *Sorghum bicolor* | 6402, 6205, 6402, 6564 | 403 | 618 |
| LNU680 | pUC19c_LNU680 | SORGHUM *Sorghum bicolor* | 6711, 6206, 6403, 6565 | 404 | 619 |
| LNU682 | pUC19d_LNU682 | SORGHUM *Sorghum bicolor* | 6712, 6207, 6404, 6566 | 405 | 620 |
| LNU683 | pQFNc_LNU683 | SORGHUM *Sorghum bicolor* | 6713, 6208 | 406 | 621 |
| LNU684 | pMA-RQ_LNU684_GA | | | 407 | 622 |
| LNU685 | pUC19c_LNU685 | SORGHUM *Sorghum bicolor* | 6714, 6209, 6405, 6567 | 408 | 623 |
| LNU686 | pUC19c_LNU686 | SORGHUM *Sorghum bicolor* | 6715, 6210, 6406, 6568 | 409 | 624 |
| LNU687 | pUC19c_LNU687 | SORGHUM *Sorghum bicolor* | 6716, 6211, 6407, 6569 | 410 | 625 |
| LNU688 | pQFNc_LNU688 | SORGHUM *Sorghum bicolor* | 6408, 6212, 6408, 6212 | 411 | 749 |

TABLE 65-continued

Genes cloned in High copy number plasmids or in binary vectors and the primers used for cloning of the genes

| Gene Name | High copy plasmid | Organism | Primers used SEQ ID NOs: | Polyn. SEQ ID NO: | Polyp. SEQ ID NO: |
|---|---|---|---|---|---|
| LNU689 | pUC19_LNU689 | SORGHUM Sorghum bicolor | 6717, 6213, 6409, 6570 | 412 | 627 |
| LNU690 | pUC19c_LNU690 | SORGHUM Sorghum bicolor | 6718, 6214, 6410, 6571 | 413 | 750 |
| LNU691 | pUC19c_LNU691 | SORGHUM Sorghum bicolor | 6719, 6215, 6411, 6215 | 414 | 629 |
| LNU692 | pUC19c_LNU692 | SORGHUM Sorghum bicolor | 6720, 6216, 6412, 6572 | 415 | 630 |
| LNU693 | pQFNc_LNU693 | SORGHUM Sorghum bicolor | 6721, 6217, 6413, 6573 | 416 | 751 |
| LNU694 | pUC19c_LNU694 | SORGHUM Sorghum bicolor | 6722, 6218, 6414, 6574 | 417 | 632 |
| LNU695 | pQFNc_LNU695 | SORGHUM Sorghum bicolor | 6415, 6219, 6415, 6575 | 418 | 633 |
| LNU696 | pUC19c_LNU696 | SORGHUM Sorghum bicolor | 6723, 6220, 6416, 6576 | 419 | 634 |
| LNU697 | pQFNc_LNU697 | SORGHUM Sorghum bicolor | 6724, 6221, 6417, 6577 | 420 | 752 |
| LNU698 | pUC19c_LNU698 | SORGHUM Sorghum bicolor | 6725, 6222, 6418, 6578 | 421 | 636 |
| LNU699 | pUC19c_LNU699 | SORGHUM Sorghum bicolor | 6726, 6223 | 422 | 637 |
| LNU700 | pUC19c_LNU700 | SORGHUM Sorghum bicolor | 6727, 6224, 6419, 6579 | 423 | 638 |
| LNU701 | pUC19c_LNU701 | SORGHUM Sorghum bicolor | 6728, 6225 | 424 | 639 |
| LNU702 | pUC19c_LNU702 | SORGHUM Sorghum bicolor | 6729, 6226, 6420, 6580 | 425 | 753 |
| LNU703 | pUC19c_LNU703 | SORGHUM Sorghum bicolor | 6421, 6227, 6421, 6227 | 426 | 641 |
| LNU704 | pUC19c_LNU704 | SORGHUM Sorghum bicolor | 6730, 6228, 6422, 6581 | 427 | 642 |
| LNU705 | pUC19c_LNU705 | SORGHUM Sorghum bicolor | 6731, 6229, 6423, 6582 | 428 | 643 |
| LNU706 | pQFNc_LNU706 | SORGHUM Sorghum bicolor | 6732, 6230, 6424, 6583 | 429 | 644 |
| LNU707 | pUC19c_LNU707 | SORGHUM Sorghum bicolor | 6733, 6231, 6425, 6584 | 430 | 645 |
| LNU708 | pUC19c_LNU708 | SORGHUM Sorghum bicolor | 6734, 6232, 6426, 6585 | 431 | 754 |
| LNU709 | pUC19c_LNU709 | SOYBEAN Glycine max | 6735, 6233, 6427, 6586 | 432 | 647 |
| LNU710 | pUC19c_LNU710 | SOYBEAN Glycine max | 6736, 6234, 6428, 6587 | 433 | 648 |
| LNU711 | pUC19c_LNU711 | SOYBEAN Glycine max | 6737, 6235, 6429, 6588 | 434 | 649 |
| LNU712 | pUC19c_LNU712 | TOMATO Lycopersicum ND | 6738, 6236, 6430, 6589 | 435 | 755 |
| LNU713 | pUC19c_LNU713 | TOMATO Lycopersicum ND | 6739, 6237, 6431, 6590 | 436 | 651 |
| LNU714 | pUC19c_LNU714 | TOMATO Lycopersicum ND | 6740, 6238, 6432, 6591 | 437 | 652 |
| LNU715 | pMA-T_LNU715_GA | | | 438 | 653 |
| LNU716 | pQFNc_LNU716 | TOMATO Lycopersicum ND | 6741, 6239, 6433, 6592 | 439 | 654 |
| LNU718 | pUC19c_LNU718 | TOMATO Lycopersicum ND | 6742, 6240, 6434, 6593 | 440 | 655 |
| LNU719 | pUC19d_LNU719 | TOMATO Lycopersicum ND | 6743, 6241, 6435, 6594 | 441 | 656 |
| LNU720 | pUC19c_LNU720 | TOMATO Lycopersicum ND | 6744, 6242, 6436, 6595 | 442 | 756 |
| LNU721 | pUC19c_LNU721 | TOMATO Lycopersicum ND | 6437, 6243, 6437, 6596 | 443 | 658 |
| LNU722 | pUC19c_LNU722 | TOMATO Lycopersicum ND | 6745, 6244, 6438, 6597 | 444 | 659 |
| LNU723 | pUC19c_LNU723 | TOMATO Lycopersicum ND | 6746, 6245, 6439, 6598 | 445 | 660 |
| LNU724 | pUC19c_LNU724 | TOMATO Lycopersicum ND | 6747, 6246, 6440, 6246 | 446 | 757 |
| LNU725 | TopoB_LNU725 | TOMATO Lycopersicum ND | 6441, 6247, 6441, 6247 | 447 | 662 |
| LNU726 | pUC19c_LNU726 | TOMATO Lycopersicum ND | 6442, 6248, 6442, 6248 | 448 | 663 |
| LNU727 | pQFNc_LNU727 | TOMATO Lycopersicum ND | 6748, 6249, 6443, 6599 | 449 | 664 |
| LNU728 | pUC19c_LNU728 | TOMATO Lycopersicum ND | 6749, 6250 | 450 | 665 |
| LNU729 | pUC19c_LNU729 | TOMATO Lycopersicum ND | 6750, 6251, 6444, 6600 | 451 | 666 |
| LNU730 | pUC19c_LNU730 | TOMATO Lycopersicum ND | 6445, 6252, 6445, 6252 | 452 | 667 |
| LNU732 | pUC19c_LNU732 | TOMATO Lycopersicum ND | 6446, 6253, 6446, 6601 | 453 | 668 |
| LNU733 | pUC19c_LNU733 | TOMATO Lycopersicum ND | 6751, 6254, 6447, 6602 | 454 | 669 |
| LNU734 | pQFNc_LNU734 | TOMATO Lycopersicum ND | 6448, 6255, 6448, 6603 | 455 | 670 |
| LNU735 | pUC19c_LNU735 | TOMATO Lycopersicum ND | 6449, 6256, 6449, 6256 | 456 | 758 |
| LNU736 | pUC19c_LNU736 | TOMATO Lycopersicum ND | 6752, 6257, 6450, 6604 | 457 | 672 |
| LNU738 | pQFNc_LNU738 | TOMATO Lycopersicum ND | 6753, 6258, 6451, 6605 | 458 | 673 |
| LNU739 | pUC19c_LNU739 | TOMATO Lycopersicum ND | 6452, 6259, 6452, 6259 | 459 | 674 |
| LNU740 | pUC19c_LNU740 | TOMATO Lycopersicum ND | 6754, 6260, 6453, 6606 | 460 | 675 |
| LNU741 | pUC19c_LNU741 | TOMATO Lycopersicum ND | 6755, 6261, 6454, 6261 | 461 | 676 |
| LNU742 | pQFNc_LNU742 | WHEAT Triticum aestivum L. | 6756, 6262 | 462 | 677 |
| LNU744 | pUC19d_LNU744 | WHEAT Triticum aestivum L. | 6757, 6263, 6455, 6607 | 463 | 678 |
| LNU745 | pUC19c_LNU745 | WHEAT Triticum aestivum L. | 6758, 6264, 6456, 6608 | 464 | 759 |
| LNU746 | pUC19d_LNU746 | WHEAT Triticum aestivum L. | 6759, 6265, 6457, 6609 | 465 | 760 |
| LNU747 | pUC19c_LNU747 | WHEAT Triticum aestivum L. | 6760, 6266, 6458, 6610 | 466 | 761 |
| LNU748 | pUC19c_LNU748 | WHEAT Triticum aestivum L. | 6761, 6267, 6459, 6611 | 467 | 762 |

Table 65. "Polyn."—Polynucleotide; "Polyp."—polypeptide. For cloning of each gene at least 2 primers were used: Forward (Fwd) or Reverse (Rev). In some cases, 4 primers were used: External forward (EF), External reverse (ER), nested forward (NF) or nested reverse (NR). The sequences of the primers used for cloning the genes are provided in the sequence listing. Some genes were synthetically produced by GeneArt (marked as "GA").

Example 16

Transforming *Agrobacterium Tumefaciens* Cells with Binary Vectors Harboring Putative Genes The above described binary vectors were used to transform *Agrobacterium* cells. Two additional binary constructs, having only the At6669, or no additional promoter were used as negative controls.

The binary vectors were introduced to *Agrobacterium tumefaciens* GV301, or LB4404 competent cells (about $10^9$ cells/mL) by electroporation. The electroporation was performed using a MicroPulser electroporator (Biorad), 0.2 cm cuvettes (Biorad) and EC-2 electroporation program (Biorad). The treated cells were cultured in LB liquid medium at 28° C. for 3 hours, then plated over LB agar supplemented with gentamycin (50 mg/L; for *Agrobacterium* strains GV301) or streptomycin (300 mg/L; for *Agrobacterium* strain LB4404) and kanamycin (50 mg/L) at 28° C. for 48 hours. *Abrobacterium* colonies, which were developed on the selective media, were further analyzed by PCR using the primers designed to span the inserted sequence in the pPI plasmid. The resulting PCR products were isolated and sequenced as described in Example 15 above, to verify that the correct polynucleotide sequences of the invention were properly introduced to the *Agrobacterium* cells.

Example 17

Transformation of *Arabidopsis Thaliana* Plants with the Polynucleotides of the Invention

*Arabidopsis thaliana* Columbia plants ($T_0$ plants) were transformed using the Floral Dip procedure described by Clough and Bent, 1998 (Floral dip: a simplified method for *Agrobacterium*-mediated transformation of *Arabidopsis thaliana*. Plant J 16:735-43) and by Desfeux et al., 2000 (Female Reproductive Tissues Are the Primary Target of *Agrobacterium*-Mediated Transformation by the *Arabidopsis* Floral-Dip Method. Plant Physiol, July 2000, Vol. 123, pp. 895-904), with minor modifications. Briefly, $T_0$ Plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hour light/dark cycles. The $T_0$ plants were ready for transformation six days before anthesis.

Single colonies of *Agrobacterium* carrying the binary constructs, were generated as described in Examples 15-16 above. Colonies were cultured in LB medium supplemented with kanamycin (50 mg/L) and gentamycin (50 mg/L). The cultures were incubated at 28° C. for 48 hours under vigorous shaking and then centrifuged at 4000 rpm for 5 minutes. The pellets comprising the *Agrobacterium* cells were re-suspended in a transformation medium containing half-strength (2.15 g/L) Murashige-Skoog (Duchefa); 0.044 µM benzylamino purine (Sigma); 112 µg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an *Agrobacterium* suspension, such that the above ground plant tissue is submerged for 3-5 seconds. Each inoculated $T_0$ plant was immediately placed in a plastic tray, then covered with clear plastic dome to maintain humidity and was kept in the dark at room temperature for 18 hours, to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry. Seeds were harvested from plants and kept at room temperature until sowing.

For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochloride and 0.05% triton for 5 minutes. The surface-sterilized seeds were thoroughly washed in sterile distilled water then placed on culture plates containing half-strength Murashige-Skoog (Duchefa); 2% sucrose; 0.8% plant agar; 50 mM kanamycin; and 200 mM carbenicylin (Duchefa). The culture plates were incubated at 4° C. for 48 hours, then transferred to a growth room at 25° C. for an additional week of incubation. Vital $T_1$ *Arabidopsis* plants were transferred to fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 18

Evaluating Transgenic *Arabidopsis* Nue Under Low or Normal Nitrogen Conditions Using In Vitro (Tissue Culture) Assays Assay 1: Plant Growth Under Low and Favorable Nitrogen Concentration Levels Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing ½ MS media (15 mM N) for the normal nitrogen concentration treatment and 0.75 mM nitrogen for the low nitrogen concentration treatments. For experiments performed in $T_2$ lines, each plate contained 5 seedlings of the same transgenic event, and 3-4 different plates (replicates) for each event. For each polynucleotide of the invention at least four-five independent transformation events were analyzed from each construct. For experiments performed in $T_1$ lines, each plate contained 5 seedlings of 5 independent transgenic events and 3-4 different plates (replicates) were planted. In total, for $T_1$ lines, 20 independent events were evaluated. Plants expressing the polynucleotides of the invention were compared to the average measurement of the control plants (empty vector or GUS reporter gene under the same promoter) used in the same experiment.

Digital Imaging—

A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) and located in a darkroom, was used for capturing images of plantlets sawn in agar plates.

The image capturing process was repeated every 3-4 days starting at day 1 till day 10 (see for example the images in FIGS. 3A-B). An image analysis system was used, which consists of a personal desktop computer (Intel P4 3.0 GHz processor) and a public domain program—ImageJ 1.39 [Java based image processing program which is developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling Analysis—

Using the digital analysis seedling data was calculated, including leaf area, root coverage and root length.

The relative growth rate for the various seedling parameters was calculated according to the following formulas XXI, V (described above) and XXII.

Relative growth rate of leaf area=Regression coefficient of leaf area along time course.   Formula XXI Relative growth rate of root length=Regression coefficient of root length along time course.   Formula XXII At the end of the experiment, plantlets were removed from the media and weighed for the determination of plant fresh weight. Plantlets were then dried for 24 hours at 60° C., and weighed again to measure plant dry weight for later statistical analysis. Growth rate was determined by comparing the leaf area coverage, root coverage and root length, between each couple of sequential photographs, and results were used to resolve the effect of the gene introduced on plant vigor under optimal conditions. Similarly, the effect of the gene introduced on biomass accumulation, under optimal conditions, was determined by comparing the plants' fresh and dry weight to that of control plants (containing an empty vector or the GUS reporter gene under the same promoter). From every construct created, 3-5 independent transformation events were examined in replicates.

Statistical Analyses—

To identify genes conferring significantly improved plant vigor or enlarged root architecture, the results obtained from the transgenic plants were compared to those obtained from control plants that were grown under identical growth conditions. To identify outperforming genes and constructs, results from the independent transformation events tested were analyzed separately. To evaluate the effect of a gene event over a control the data was analyzed by Student's t-test and the p value was calculated. Results were considered significant if p≤0.1. The JMP statistics software package was used (Version 5.2.1, SAS Institute Inc., Cary, N.C., USA).

Experimental Results:

The genes presented in the following Tables were cloned under the regulation of a constitutive promoter (At6669). Evaluation of the effect of transformation in a plant of each gene was carried out by testing the performance of different number of transformation events. Some of the genes were evaluated in more than one tissue culture assay. The results obtained in these second experiments were significantly positive as well. Event with p-value<0.1 was considered statistically significant.

The genes presented in Tables 66-69 showed a significant improvement in plant NUE since they produced larger plant biomass (plant fresh and dry weight; leaf area, root length and root coverage) in T2 generation (Tables 66-67) or T1 generation (Tables 68-69) when grown under limiting nitrogen growth conditions, compared to control plants that were grown under identical growth conditions. Plants producing larger root biomass have better possibilities to absorb larger amount of nitrogen from soil.

TABLE 66

Genes showing improved plant performance at nitrogen deficient conditions (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LNU741 | 71248.4 | — | — | — | 74.5 | 0.12 | 16 |
| LNU741 | 71248.5 | — | — | — | 75.1 | 0.15 | 17 |
| LNU741 | 71249.3 | — | — | — | 71.5 | 0.27 | 12 |
| LNU740 | 71242.6 | — | — | — | 73.4 | 0.14 | 15 |
| LNU732 | 71222.4 | — | — | — | 72.1 | 0.24 | 13 |
| LNU732 | 71224.5 | 4.8 | 0.03 | 35 | 74.8 | 0.16 | 17 |
| LNU732 | 71226.6 | — | — | — | 77.9 | 0.16 | 22 |
| LNU728 | 71209.5 | 5.0 | 0.07 | 39 | 81.3 | 0.05 | 27 |
| LNU728 | 71210.2 | — | — | — | 71.4 | 0.25 | 12 |
| LNU726 | 71204.1 | — | — | — | 71.5 | 0.26 | 12 |
| LNU725 | 71199.1 | — | — | — | 84.8 | 0.09 | 32 |
| LNU714 | 71181.2 | — | — | — | 75.0 | 0.26 | 17 |
| LNU714 | 71183.3 | — | — | — | 81.3 | 0.07 | 27 |

TABLE 66-continued

Genes showing improved plant performance at nitrogen deficient conditions (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LNU712 | 71147.1 | 4.3 | 0.22 | 21 | 82.1 | 0.09 | 28 |
| LNU712 | 71147.4 | — | — | — | 84.2 | 0.01 | 32 |
| LNU711 | 71137.2 | — | — | — | 74.9 | 0.10 | 17 |
| LNU711 | 71137.5 | — | — | — | 71.8 | 0.27 | 12 |
| LNU711 | 71139.3 | 4.9 | 0.17 | 37 | 77.9 | 0.06 | 22 |
| LNU711 | 71139.4 | — | — | — | 82.0 | 0.02 | 28 |
| CONT. | — | 3.6 | — | — | 64.0 | — | — |
| LNU646 | 72145.1 | — | — | — | 75.2 | 0.28 | 15 |
| LNU646 | 72148.2 | 4.0 | 0.09 | 25 | 73.4 | 0.25 | 13 |
| LNU646 | 72150.2 | 3.7 | 0.15 | 16 | — | — | — |
| LNU638 | 72142.3 | 3.8 | 0.28 | 18 | 78.3 | 0.14 | 20 |
| LNU638 | 72143.3 | 6.0 | 0.05 | 91 | 111.2 | L | 71 |
| LNU638 | 72144.1 | 5.2 | 0.05 | 65 | 89.8 | 0.09 | 38 |
| LNU637 | 71669.5 | — | — | — | 75.1 | 0.16 | 15 |
| LNU637 | 71669.6 | 4.1 | 0.05 | 30 | 78.1 | 0.18 | 20 |
| LNU637 | 71669.8 | 4.8 | L | 50 | 79.6 | 0.09 | 22 |
| LNU615 | 72285.1 | 5.0 | L | 57 | — | — | — |
| LNU601 | 72127.2 | — | — | — | 75.2 | 0.22 | 15 |
| LNU601 | 72129.1 | 3.7 | 0.17 | 17 | — | — | — |
| LNU601 | 72131.3 | 4.2 | 0.10 | 34 | 79.0 | 0.18 | 21 |
| LNU601 | 72131.4 | 5.5 | 0.01 | 72 | 99.3 | 0.02 | 53 |
| LNU546 | 72584.2 | 3.8 | 0.13 | 20 | — | — | — |
| LNU546 | 72586.1 | 4.6 | 0.04 | 45 | 79.9 | 0.03 | 23 |
| LNU546 | 72587.3 | 4.3 | 0.21 | 35 | 82.2 | 0.17 | 26 |
| LNU546 | 72588.1 | — | — | — | 78.8 | 0.19 | 21 |
| CONT. | — | 3.2 | — | — | 65.1 | — | — |
| LNU735 | 71872.2 | 5.1 | L | 36 | 92.6 | L | 42 |
| LNU735 | 71873.5 | — | — | — | 82.8 | 0.08 | 27 |
| LNU718 | 71504.6 | 4.8 | 0.12 | 28 | 87.8 | 0.05 | 34 |
| LNU718 | 71506.4 | — | — | — | 75.8 | 0.22 | 16 |
| LNU718 | 71507.2 | — | — | — | 77.0 | 0.17 | 18 |
| LNU713 | 71862.1 | 4.7 | 0.11 | 26 | 91.5 | 0.04 | 40 |
| LNU713 | 71863.2 | 4.9 | 0.02 | 30 | 85.3 | 0.04 | 30 |
| LNU713 | 71864.1 | 4.4 | 0.19 | 17 | 84.7 | 0.04 | 30 |
| LNU713 | 71865.2 | — | — | — | 78.4 | 0.13 | 20 |
| LNU713 | 71867.1 | 4.3 | 0.16 | 16 | 88.3 | 0.02 | 35 |
| LNU689 | 71778.2 | 4.8 | 0.05 | 27 | 90.9 | 0.04 | 39 |
| LNU689 | 71779.6 | 4.5 | 0.09 | 22 | 90.6 | 0.02 | 39 |
| LNU689 | 71783.3 | — | — | — | 76.7 | 0.19 | 17 |
| LNU601 | 72127.2 | 4.3 | 0.22 | 14 | 78.9 | 0.13 | 21 |
| LNU601 | 72131.3 | — | — | — | 84.0 | 0.05 | 29 |
| CONT. | — | 3.7 | — | — | 65.4 | — | — |
| LNU706 | 71342.1 | 4.8 | 0.17 | 16 | 97.8 | 0.09 | 23 |
| LNU706 | 71343.1 | 5.6 | 0.09 | 36 | 105.8 | 0.16 | 33 |
| LNU706 | 71343.2 | 4.8 | 0.22 | 16 | — | — | — |
| LNU703 | 71490.5 | 4.9 | 0.26 | 17 | — | — | — |
| LNU695 | 71303.2 | 6.5 | 0.04 | 57 | 110.6 | L | 39 |
| LNU674 | 71428.2 | 6.1 | 0.10 | 46 | 117.3 | 0.07 | 47 |
| LNU672 | 71420.3 | 8.0 | L | 92 | 116.1 | L | 46 |
| LNU672 | 71421.6 | 5.2 | 0.09 | 27 | 99.0 | 0.02 | 24 |
| LNU652 | 71376.6 | — | — | — | 92.6 | 0.29 | 16 |
| LNU652 | 71380.1 | 6.5 | L | 56 | 124.4 | L | 56 |
| LNU632 | 71370.1 | 5.0 | 0.10 | 22 | 95.0 | 0.05 | 19 |
| LNU632 | 71372.6 | 8.0 | 0.02 | 93 | 126.7 | 0.04 | 59 |
| LNU624 | 71364.2 | 5.2 | 0.08 | 25 | 94.2 | 0.21 | 18 |
| LNU624 | 71366.1 | 5.1 | 0.30 | 23 | — | — | — |
| CONT. | — | 4.2 | — | — | 79.5 | — | — |
| LNU706 | 71342.1 | 5.1 | L | 48 | 92.7 | L | 64 |
| LNU706 | 71343.1 | 5.0 | L | 45 | 84.9 | 0.02 | 51 |
| LNU706 | 71343.2 | — | — | — | 71.9 | 0.11 | 28 |
| LNU706 | 71344.5 | 5.0 | 0.14 | 44 | 94.3 | 0.02 | 67 |
| LNU703 | 71490.2 | — | — | — | 80.7 | 0.18 | 43 |
| LNU703 | 71490.5 | — | — | — | 70.9 | 0.10 | 26 |
| LNU703 | 71491.3 | — | — | — | 73.8 | 0.20 | 31 |
| LNU703 | 71492.6 | — | — | — | 70.2 | 0.19 | 24 |
| LNU695 | 71302.3 | — | — | — | 68.7 | 0.19 | 22 |
| LNU695 | 71302.4 | — | — | — | 83.8 | 0.08 | 49 |
| LNU695 | 71303.2 | 4.6 | 0.28 | 32 | 83.7 | 0.11 | 49 |
| LNU687 | 71472.4 | — | — | — | 92.1 | 0.08 | 63 |
| LNU687 | 71474.1 | — | — | — | 79.9 | 0.05 | 42 |
| LNU687 | 71474.3 | — | — | — | 70.8 | 0.12 | 25 |
| LNU687 | 71476.3 | 6.7 | L | 94 | 121.0 | L | 115 |

TABLE 66-continued

Genes showing improved plant performance at nitrogen deficient conditions (T2 generation)

| Gene Name | Event # | Dry Weight [mg] Ave. | P-Val. | % Incr. | Fresh Weight [mg] Ave. | P-Val. | % Incr. |
|---|---|---|---|---|---|---|---|
| LNU674 | 71425.1 | — | — | — | 74.9 | 0.07 | 33 |
| LNU674 | 71427.1 | — | — | — | 74.8 | 0.15 | 33 |
| LNU674 | 71427.5 | — | — | — | 73.1 | 0.07 | 30 |
| LNU674 | 71428.2 | 4.3 | 0.22 | 24 | — | — | — |
| LNU672 | 71420.3 | 7.6 | 0.08 | 118 | 140.6 | 0.10 | 149 |
| LNU672 | 71421.3 | — | — | — | 85.0 | 0.01 | 51 |
| LNU672 | 71421.4 | — | — | — | 72.0 | 0.18 | 28 |
| LNU672 | 71421.6 | — | — | — | 76.9 | 0.06 | 36 |
| LNU652 | 71376.6 | 5.2 | 0.07 | 50 | 93.9 | 0.05 | 67 |
| LNU652 | 71378.1 | 4.2 | 0.10 | 21 | 95.2 | L | 69 |
| LNU652 | 71378.3 | — | — | — | 84.2 | L | 49 |
| LNU652 | 71380.1 | — | — | — | 87.3 | 0.01 | 55 |
| LNU652 | 71381.1 | — | — | — | 71.6 | 0.17 | 27 |
| LNU632 | 71370.1 | — | — | — | 68.7 | 0.28 | 22 |
| LNU632 | 71370.2 | 4.2 | 0.08 | 20 | 71.7 | 0.09 | 27 |
| LNU632 | 71371.1 | — | — | — | 68.5 | 0.22 | 22 |
| LNU632 | 71372.3 | — | — | — | 83.0 | 0.13 | 47 |
| LNU632 | 71372.4 | — | — | — | 79.4 | 0.03 | 41 |
| LNU624 | 71364.1 | — | — | — | 70.5 | 0.12 | 25 |
| LNU624 | 71364.2 | 4.3 | 0.14 | 26 | 76.5 | 0.03 | 36 |
| LNU624 | 71364.3 | 5.0 | L | 44 | 73.6 | 0.08 | 31 |
| LNU624 | 71367.1 | 4.6 | 0.02 | 33 | 78.0 | 0.02 | 38 |
| LNU624 | 71369.2 | 4.1 | 0.29 | 19 | 86.6 | 0.10 | 54 |
| CONT. | — | 3.5 | — | — | 56.4 | — | — |
| LNU741 | 71248.4 | 5.9 | L | 102 | 104.2 | L | 50 |
| LNU741 | 71249.3 | 3.7 | 0.16 | 28 | — | — | — |
| LNU740 | 71240.2 | 3.5 | 0.22 | 20 | — | — | — |
| LNU740 | 71242.4 | 4.5 | L | 56 | 86.8 | L | 25 |
| LNU732 | 71222.2 | 3.8 | 0.16 | 30 | — | — | — |
| LNU732 | 71222.4 | 5.1 | L | 75 | 97.4 | L | 40 |
| LNU732 | 71224.5 | 4.0 | 0.11 | 39 | 84.8 | 0.13 | 22 |
| LNU732 | 71226.3 | 3.5 | 0.22 | 21 | — | — | — |
| LNU728 | 71209.3 | — | — | — | 73.8 | 0.28 | 6 |
| LNU728 | 71210.2 | 4.1 | 0.03 | 40 | — | — | — |
| LNU728 | 71214.3 | 5.4 | 0.21 | 85 | 106.6 | 0.25 | 53 |
| LNU728 | 71214.6 | 3.5 | 0.18 | 21 | — | — | — |
| LNU725 | 71198.4 | 3.7 | 0.14 | 27 | — | — | — |
| LNU725 | 71199.1 | 4.0 | 0.03 | 39 | — | — | — |
| LNU725 | 71199.4 | 3.4 | 0.22 | 16 | — | — | — |
| LNU725 | 71201.1 | 4.0 | L | 36 | — | — | — |
| LNU725 | 71201.5 | 4.1 | 0.03 | 41 | 78.6 | 0.29 | 13 |
| LNU714 | 71181.2 | 4.5 | 0.13 | 55 | 99.9 | L | 44 |
| LNU714 | 71181.3 | 4.5 | 0.01 | 55 | — | — | — |
| LNU714 | 71182.1 | 4.0 | 0.11 | 36 | — | — | — |
| LNU714 | 71183.2 | 4.3 | L | 47 | 78.1 | 0.28 | 12 |
| LNU712 | 71144.2 | 6.2 | L | 114 | 110.6 | 0.04 | 59 |
| LNU712 | 71144.3 | 4.9 | 0.04 | 68 | 89.0 | L | 28 |
| LNU712 | 71147.4 | 5.7 | L | 97 | 109.6 | 0.01 | 58 |
| LNU711 | 71137.1 | 3.5 | 0.24 | 19 | — | — | — |
| CONT. | — | 2.9 | — | — | 69.6 | — | — |
| LNU709 | 71498.3 | 5.0 | L | 45 | 97.5 | 0.02 | 27 |
| LNU709 | 71498.4 | 4.6 | 0.04 | 33 | 108.8 | 0.21 | 42 |
| LNU709 | 71501.3 | 5.5 | 0.08 | 59 | — | — | — |
| LNU693 | 71546.2 | 4.8 | 0.18 | 37 | 91.0 | 0.27 | 19 |
| LNU693 | 71547.5 | 4.4 | 0.04 | 26 | 86.2 | 0.26 | 12 |
| LNU693 | 71548.6 | 5.0 | L | 43 | — | — | — |
| LNU676 | 71095.2 | — | — | — | 92.4 | 0.10 | 21 |
| LNU671 | 71091.2 | 4.9 | 0.01 | 40 | — | — | — |
| LNU671 | 71091.5 | 5.1 | 0.19 | 47 | — | — | — |
| LNU671 | 71094.5 | 4.8 | 0.10 | 38 | 86.7 | 0.19 | 13 |
| LNU671 | 71094.6 | 4.0 | 0.30 | 15 | — | — | — |
| LNU659 | 71850.1 | 4.7 | 0.02 | 34 | 90.4 | 0.12 | 18 |
| LNU659 | 71855.5 | 5.4 | 0.01 | 55 | 96.4 | 0.05 | 26 |
| LNU654 | 71556.1 | 5.9 | 0.09 | 68 | 103.8 | 0.10 | 35 |
| LNU654 | 71557.3 | 4.8 | 0.04 | 37 | 99.7 | 0.19 | 30 |
| LNU654 | 71559.2 | 5.2 | 0.15 | 50 | — | — | — |
| LNU607 | 71592.1 | 4.2 | 0.13 | 20 | — | — | — |
| LNU607 | 71595.1 | 4.6 | 0.01 | 33 | 86.0 | 0.29 | 12 |
| LNU603 | 71612.1 | 4.5 | 0.14 | 29 | — | — | — |
| LNU603 | 71612.3 | 4.1 | 0.26 | 17 | 90.5 | 0.09 | 18 |
| LNU521 | 71598.3 | 4.8 | 0.02 | 38 | 86.9 | 0.25 | 13 |
| LNU521 | 71601.3 | 4.5 | 0.12 | 29 | 85.3 | 0.28 | 11 |
| CONT. | — | 3.5 | — | — | 76.6 | — | — |
| LNU742 | 71552.2 | 4.3 | L | 49 | 81.6 | 0.18 | 19 |
| LNU742 | 71552.4 | 3.9 | 0.04 | 33 | 85.3 | 0.02 | 25 |
| LNU742 | 71554.2 | 5.0 | L | 70 | 100.8 | L | 47 |
| LNU742 | 71555.2 | 3.6 | 0.08 | 23 | 75.4 | 0.22 | 10 |
| LNU734 | 71646.5 | 5.6 | 0.10 | 92 | 103.7 | 0.07 | 52 |
| LNU734 | 71648.2 | 4.0 | 0.07 | 38 | 90.6 | 0.02 | 32 |
| LNU734 | 71648.3 | 6.0 | 0.03 | 105 | 119.6 | L | 75 |
| LNU734 | 71648.5 | 4.5 | 0.14 | 53 | 96.7 | 0.08 | 41 |
| LNU734 | 71649.1 | 4.2 | L | 45 | 102.2 | L | 50 |
| LNU715 | 71642.2 | 4.6 | 0.04 | 56 | 97.8 | 0.07 | 43 |
| LNU715 | 71643.1 | 5.1 | 0.01 | 75 | 108.4 | L | 59 |
| LNU715 | 71643.2 | 6.0 | L | 107 | 115.7 | L | 69 |
| LNU715 | 71643.3 | 4.9 | 0.02 | 67 | 99.3 | 0.03 | 45 |
| LNU715 | 71645.3 | 5.2 | 0.01 | 76 | 113.8 | 0.01 | 66 |
| LNU567 | 70995.1 | 4.7 | 0.16 | 60 | 117.8 | 0.04 | 72 |
| LNU567 | 70995.2 | 4.9 | L | 66 | 103.9 | L | 52 |
| LNU567 | 70995.4 | 4.2 | 0.02 | 44 | 85.1 | 0.01 | 24 |
| LNU567 | 70998.3 | 4.7 | 0.12 | 60 | 100.5 | 0.01 | 47 |
| LNU567 | 70998.4 | 4.6 | L | 57 | 101.5 | L | 48 |
| CONT. | — | 2.9 | — | — | 68.4 | — | — |
| LNU722 | 71189.5 | 5.2 | 0.11 | 83 | 97.1 | 0.15 | 53 |
| LNU706 | 71340.4 | 4.0 | 0.24 | 40 | — | — | — |
| LNU706 | 71342.1 | 3.9 | 0.11 | 36 | 79.0 | 0.14 | 24 |
| LNU706 | 71343.3 | 4.5 | 0.02 | 59 | 89.2 | 0.05 | 41 |
| LNU702 | 71857.3 | 3.5 | 0.06 | 24 | — | — | — |
| LNU702 | 71859.3 | 3.7 | 0.14 | 30 | — | — | — |
| LNU693 | 71547.3 | 5.0 | 0.02 | 77 | 82.7 | 0.09 | 30 |
| LNU693 | 71548.6 | 5.4 | L | 89 | 93.5 | 0.01 | 47 |
| LNU668 | 71415.5 | 5.1 | L | 79 | 84.0 | 0.07 | 32 |
| LNU668 | 71416.3 | 4.0 | 0.05 | 41 | — | — | — |
| LNU545 | 72596.1 | 4.3 | 0.03 | 52 | — | — | — |
| LNU545 | 72597.1 | 4.5 | 0.02 | 58 | 83.1 | 0.11 | 31 |
| CONT. | — | 2.8 | — | — | 63.5 | — | — |
| LNU696 | 70600.3 | — | — | — | 91.6 | 0.30 | 9 |
| LNU696 | 70601.2 | 6.1 | 0.26 | 18 | 105.1 | 0.26 | 25 |
| LNU696 | 70601.3 | 7.4 | 0.14 | 43 | 136.8 | 0.13 | 63 |
| LNU686 | 70689.2 | 6.2 | 0.30 | 19 | 132.9 | 0.09 | 59 |
| LNU686 | 70689.4 | 5.8 | 0.20 | 12 | — | — | — |
| LNU686 | 70689.5 | — | — | — | 96.7 | 0.24 | 15 |
| LNU627 | 70490.2 | — | — | — | 94.4 | 0.12 | 13 |
| LNU627 | 70491.3 | 6.7 | 0.08 | 30 | 115.0 | 0.09 | 37 |
| LNU627 | 70491.5 | — | — | — | 97.2 | 0.02 | 16 |
| LNU627 | 70493.5 | — | — | — | 101.5 | 0.14 | 21 |
| LNU616 | 70503.2 | — | — | — | 99.9 | 0.25 | 19 |
| LNU616 | 70503.4 | — | — | — | 102.7 | 0.26 | 22 |
| LNU616 | 70504.4 | 7.7 | 0.23 | 49 | 135.7 | 0.27 | 62 |
| LNU616 | 70505.2 | — | — | — | 97.1 | 0.05 | 16 |
| LNU616 | 70505.3 | — | — | — | 95.2 | 0.23 | 14 |
| LNU595 | 70274.3 | 6.7 | 0.01 | 30 | 111.1 | L | 33 |
| LNU565 | 70624.3 | 6.6 | 0.22 | 27 | 108.7 | 0.13 | 30 |
| LNU565 | 70624.5 | 5.8 | 0.30 | 12 | — | — | — |
| LNU565 | 70626.1 | — | — | — | 94.2 | 0.19 | 12 |
| LNU565 | 70626.4 | — | — | — | 100.6 | 0.23 | 20 |
| LNU542 | 70226.3 | 6.9 | 0.20 | 33 | 129.9 | 0.07 | 55 |
| LNU542 | 70229.3 | — | — | — | 98.5 | 0.13 | 18 |
| LNU542 | 70230.2 | — | — | — | 91.5 | 0.12 | 9 |
| LNU539 | 70220.1 | — | — | — | 91.7 | 0.10 | 9 |
| LNU539 | 70221.2 | — | — | — | 96.8 | 0.13 | 15 |
| LNU539 | 70225.3 | — | — | — | 101.2 | L | 21 |
| LNU537 | 70215.4 | — | — | — | 100.9 | 0.12 | 20 |
| LNU537 | 70218.2 | — | — | — | 98.1 | 0.10 | 17 |
| CONT. | — | 5.2 | — | — | 83.8 | — | — |
| LNU688 | 72694.3 | 5.0 | 0.03 | 41 | 96.0 | 0.06 | 21 |
| LNU688 | 72694.4 | 4.6 | 0.14 | 29 | 90.6 | 0.17 | 15 |
| LNU657 | 70336.1 | 5.1 | 0.13 | 43 | 98.0 | 0.26 | 24 |
| LNU645 | 73004.1 | 4.3 | 0.29 | 20 | — | — | — |
| LNU645 | 73005.4 | 4.3 | 0.26 | 20 | — | — | — |
| LNU645 | 73006.2 | 4.5 | 0.25 | 26 | — | — | — |
| LNU645 | 73008.2 | 4.8 | 0.07 | 35 | — | — | — |
| LNU608 | 72997.2 | — | — | — | 90.0 | 0.23 | 14 |
| LNU608 | 72997.4 | 4.5 | 0.15 | 27 | — | — | — |

TABLE 66-continued

Genes showing improved plant performance at nitrogen deficient conditions (T2 generation)

| Gene Name | Event # | Dry Weight [mg] Ave. | P-Val. | % Incr. | Fresh Weight [mg] Ave. | P-Val. | % Incr. |
|---|---|---|---|---|---|---|---|
| LNU608 | 73000.1 | 4.6 | 0.14 | 29 | 91.6 | 0.23 | 16 |
| LNU554 | 70479.1 | 6.4 | 0.02 | 78 | 113.2 | 0.06 | 43 |
| LNU545 | 72598.1 | 4.6 | 0.19 | 28 | — | — | — |
| CONT. | — | 3.6 | — | — | 79.1 | — | — |
| LNU748 | 72945.1 | 5.2 | 0.13 | 89 | 97.2 | 0.07 | 69 |
| LNU748 | 72945.2 | — | — | — | 69.0 | 0.17 | 20 |
| LNU748 | 72947.2 | 3.6 | 0.08 | 33 | 79.4 | 0.02 | 38 |
| LNU748 | 72947.3 | — | — | — | 72.9 | 0.12 | 27 |
| LNU747 | 70619.4 | 4.3 | 0.01 | 60 | 66.2 | 0.27 | 15 |
| LNU746 | 72964.3 | — | — | — | 73.3 | 0.06 | 27 |
| LNU746 | 72966.2 | 4.2 | 0.15 | 54 | 79.1 | 0.16 | 37 |
| LNU688 | 72692.3 | 5.0 | 0.03 | 83 | 82.4 | 0.11 | 43 |
| LNU688 | 72694.3 | 5.3 | L | 94 | 91.4 | 0.02 | 59 |
| LNU645 | 73005.4 | 3.8 | 0.16 | 39 | — | — | — |
| LNU645 | 73006.1 | 3.3 | 0.23 | 21 | 67.8 | 0.20 | 18 |
| LNU636_H1 | 72939.3 | 5.0 | L | 85 | 88.5 | 0.03 | 54 |
| LNU636_H1 | 72942.1 | 3.6 | 0.08 | 34 | 73.2 | 0.08 | 27 |
| LNU636_H1 | 72942.2 | 3.8 | 0.11 | 39 | 86.1 | 0.01 | 50 |
| LNU608 | 72997.2 | 3.8 | 0.19 | 40 | 71.9 | 0.14 | 25 |
| LNU608 | 72997.4 | 3.7 | 0.09 | 36 | 82.8 | 0.06 | 44 |
| LNU608 | 73000.1 | — | — | — | 75.2 | 0.06 | 31 |
| LNU588 | 72992.1 | 3.9 | 0.06 | 43 | — | — | — |
| LNU585 | 72915.1 | 5.1 | 0.03 | 87 | 87.3 | 0.01 | 52 |
| LNU585 | 72917.3 | 4.3 | 0.07 | 58 | 86.1 | 0.15 | 50 |
| CONT. | — | 2.7 | — | — | 57.6 | — | — |
| LNU639 | 70869.2 | 6.8 | L | 46 | 102.2 | 0.05 | 23 |
| LNU635 | 70784.3 | 7.7 | L | 67 | 125.2 | L | 51 |
| LNU635 | 70784.4 | 6.2 | 0.22 | 34 | 108.6 | 0.15 | 31 |
| LNU580 | 70853.2 | — | — | — | 89.6 | 0.29 | 8 |
| LNU549 | 70720.2 | — | — | — | 94.3 | 0.06 | 14 |
| LNU549 | 70723.2 | 6.2 | 0.02 | 35 | 105.4 | 0.02 | 27 |
| LNU524 | 70809.1 | 6.2 | 0.10 | 34 | 104.4 | 0.22 | 26 |
| LNU524 | 70809.2 | — | — | — | 104.7 | 0.21 | 26 |
| CONT. | — | 4.6 | — | — | 82.8 | — | — |
| LNU729 | 71519.4 | 5.1 | 0.16 | 20 | 93.1 | 0.14 | 14 |
| LNU719 | 71542.3 | 8.0 | L | 86 | 123.0 | L | 51 |
| LNU719 | 71543.1 | — | — | — | 96.0 | 0.27 | 17 |
| LNU718 | 71506.2 | 6.1 | 0.04 | 43 | — | — | — |
| LNU709 | 71498.4 | 5.8 | 0.01 | 34 | 99.4 | 0.17 | 22 |
| LNU709 | 71501.3 | 5.5 | L | 28 | 104.8 | L | 28 |
| LNU693 | 71547.3 | 5.9 | 0.10 | 38 | 112.0 | 0.14 | 37 |
| LNU693 | 71548.6 | 7.4 | 0.04 | 73 | 113.8 | 0.04 | 39 |
| LNU654 | 71557.3 | 4.8 | 0.18 | 11 | — | — | — |
| LNU607 | 71592.5 | 5.6 | L | 32 | 108.6 | 0.03 | 33 |
| LNU607 | 71595.1 | 5.6 | 0.30 | 31 | — | — | — |
| LNU607 | 71595.2 | 5.2 | 0.14 | 21 | 108.3 | 0.06 | 33 |
| LNU603 | 71610.5 | 7.4 | L | 73 | 126.6 | 0.01 | 55 |
| LNU603 | 71613.6 | 5.0 | 0.15 | 16 | — | — | — |
| LNU521 | 71601.3 | 6.8 | 0.02 | 59 | 111.8 | 0.06 | 37 |
| CONT. | — | 4.3 | — | — | 81.7 | — | — |
| LNU708 | 71797.2 | 4.4 | 0.22 | 17 | 82.4 | 0.13 | 19 |
| LNU708 | 71797.3 | 4.5 | 0.03 | 20 | 82.0 | 0.21 | 18 |
| LNU708 | 71798.4 | — | — | — | 84.4 | 0.05 | 22 |
| LNU649 | 71059.1 | 4.3 | 0.25 | 15 | 87.9 | 0.05 | 27 |
| LNU649 | 71063.1 | 6.3 | 0.03 | 69 | 96.7 | 0.11 | 39 |
| LNU634 | 71016.3 | 4.5 | 0.17 | 22 | 78.5 | 0.30 | 13 |
| LNU622 | 70999.3 | 5.1 | L | 37 | 90.8 | 0.03 | 31 |
| LNU622 | 71004.2 | — | — | — | 84.0 | 0.06 | 21 |
| LNU591 | 71283.1 | 5.5 | L | 48 | 85.0 | 0.06 | 22 |
| LNU591 | 71283.3 | 4.8 | 0.04 | 29 | 88.1 | 0.02 | 27 |
| LNU591 | 71286.3 | 4.6 | 0.17 | 23 | — | — | — |
| LNU581 | 71305.2 | 4.6 | 0.03 | 23 | 87.8 | 0.03 | 26 |
| LNU581 | 71305.7 | — | — | — | 80.9 | 0.24 | 17 |
| LNU581 | 71306.1 | 5.7 | 0.03 | 54 | 93.5 | 0.14 | 35 |
| LNU574 | 71790.4 | 5.3 | 0.09 | 42 | 89.6 | 0.09 | 29 |
| LNU574 | 71791.2 | 4.5 | 0.02 | 21 | 90.0 | 0.02 | 30 |
| CONT. | — | 3.7 | — | — | 69.4 | — | — |
| LNU676 | 71097.4 | 5.6 | 0.15 | 15 | 110.1 | 0.04 | 23 |
| LNU671 | 71094.6 | — | — | — | 102.3 | 0.09 | 15 |
| LNU649 | 71062.1 | 6.6 | 0.08 | 35 | 129.2 | 0.03 | 45 |
| LNU649 | 71062.2 | — | — | — | 102.6 | 0.01 | 15 |
| LNU649 | 71064.2 | 6.7 | L | 37 | 119.5 | L | 34 |
| LNU648 | 71023.3 | 5.9 | 0.11 | 20 | 107.9 | 0.04 | 21 |
| LNU648 | 71025.2 | — | — | — | 101.2 | 0.15 | 13 |
| LNU634 | 71013.4 | 5.6 | 0.26 | 16 | 103.3 | L | 16 |
| LNU634 | 71016.3 | — | — | — | 98.2 | 0.12 | 10 |
| LNU622 | 70999.1 | 6.4 | 0.04 | 31 | 112.4 | 0.03 | 26 |
| LNU622 | 70999.3 | — | — | — | 104.0 | 0.28 | 17 |
| LNU622 | 71003.4 | 5.9 | 0.12 | 21 | 110.3 | 0.09 | 24 |
| LNU591 | 71283.3 | 5.7 | 0.30 | 17 | 110.0 | 0.21 | 23 |
| LNU581 | 71305.7 | — | — | — | 104.8 | 0.16 | 17 |
| LNU581 | 71306.1 | — | — | — | 100.3 | 0.24 | 12 |
| LNU567 | 70998.1 | 5.5 | 0.23 | 13 | 99.3 | 0.04 | 11 |
| LNU567 | 70998.3 | — | — | — | 99.9 | 0.07 | 12 |
| CONT. | — | 4.9 | — | — | 89.2 | — | — |
| LNU735 | 71872.2 | 5.0 | L | 60 | — | — | — |
| LNU735 | 71873.1 | 5.0 | 0.07 | 60 | 95.6 | 0.10 | 43 |
| LNU735 | 71873.2 | 5.9 | 0.03 | 86 | 115.0 | 0.15 | 73 |
| LNU735 | 71873.5 | 4.8 | 0.29 | 51 | — | — | — |
| LNU713 | 71862.1 | 5.5 | L | 75 | 99.1 | L | 49 |
| LNU713 | 71867.1 | 4.4 | 0.02 | 39 | 89.2 | 0.03 | 34 |
| LNU689 | 71778.2 | — | — | — | 84.6 | 0.19 | 27 |
| LNU689 | 71778.3 | 5.2 | 0.03 | 65 | 103.3 | 0.02 | 55 |
| LNU689 | 71779.6 | 4.3 | 0.05 | 37 | 85.5 | 0.03 | 28 |
| LNU689 | 71783.3 | 4.5 | 0.15 | 41 | 83.5 | 0.20 | 25 |
| LNU688 | 72692.3 | — | — | — | 88.2 | 0.26 | 32 |
| LNU688 | 72692.4 | 4.9 | 0.04 | 56 | 82.9 | 0.18 | 24 |
| LNU669 | 70388.2 | 4.6 | 0.16 | 46 | 86.0 | 0.07 | 29 |
| LNU669 | 70391.1 | 4.2 | 0.02 | 35 | 82.6 | 0.08 | 24 |
| LNU669 | 70393.1 | 5.0 | 0.02 | 60 | 83.5 | 0.15 | 25 |
| LNU669 | 70393.2 | 4.0 | L | 27 | 87.6 | L | 31 |
| LNU669 | 70393.3 | 4.9 | 0.15 | 56 | 87.9 | 0.16 | 32 |
| LNU615 | 72283.2 | 4.7 | 0.11 | 50 | 83.1 | 0.09 | 25 |
| LNU615 | 72287.3 | 3.5 | 0.21 | 10 | — | — | — |
| LNU611 | 72698.2 | 4.9 | L | 55 | 89.2 | L | 34 |
| LNU611 | 72699.2 | 4.5 | 0.21 | 43 | 80.8 | 0.24 | 21 |
| LNU611 | 72702.3 | 3.7 | 0.30 | 17 | 82.4 | 0.17 | 24 |
| LNU546 | 72584.3 | 5.1 | 0.02 | 63 | 95.1 | L | 43 |
| LNU546 | 72586.1 | 4.9 | 0.07 | 56 | 86.4 | 0.06 | 30 |
| LNU546 | 72587.3 | 3.8 | 0.29 | 21 | — | — | — |
| LNU546 | 72588.1 | — | — | — | 85.1 | 0.29 | 28 |
| LNU533 | 71826.1 | 5.2 | 0.05 | 64 | 81.2 | 0.10 | 22 |
| LNU533 | 71828.2 | 3.7 | 0.25 | 17 | 79.3 | 0.22 | 19 |
| CONT. | — | 3.1 | — | — | 66.7 | — | — |
| LNU710 | 70712.5 | 6.2 | 0.10 | 50 | 109.9 | 0.10 | 27 |
| LNU710 | 70712.6 | 6.1 | 0.05 | 49 | — | — | — |
| LNU710 | 70715.2 | 7.0 | 0.06 | 72 | 109.6 | 0.05 | 27 |
| LNU710 | 70716.1 | 5.2 | 0.01 | 28 | 103.5 | 0.17 | 20 |
| LNU705 | 70604.2 | 5.5 | 0.02 | 34 | 99.4 | 0.14 | 15 |
| LNU705 | 70604.4 | 6.3 | 0.03 | 54 | 107.8 | 0.01 | 25 |
| LNU705 | 70606.2 | 6.7 | 0.02 | 63 | 120.0 | 0.02 | 39 |
| LNU705 | 70607.3 | 5.0 | 0.07 | 21 | 97.0 | 0.07 | 12 |
| LNU639 | 70871.3 | 5.1 | 0.05 | 24 | 104.9 | 0.17 | 21 |
| LNU639 | 70873.2 | 5.9 | 0.24 | 43 | — | — | — |
| LNU635 | 70784.2 | 5.3 | 0.15 | 30 | — | — | — |
| LNU635 | 70784.3 | 5.4 | 0.06 | 31 | — | — | — |
| LNU635 | 70784.4 | 6.2 | L | 52 | 110.8 | L | 28 |
| LNU635 | 70786.4 | 7.3 | 0.05 | 79 | 124.1 | 0.05 | 44 |
| LNU635 | 70787.3 | 6.0 | 0.03 | 47 | 104.1 | 0.06 | 20 |
| LNU580 | 70851.2 | 5.4 | 0.03 | 32 | 97.1 | 0.20 | 12 |
| LNU580 | 70851.4 | 5.2 | 0.02 | 27 | — | — | — |
| LNU580 | 70853.2 | 5.3 | 0.15 | 30 | 102.5 | 0.24 | 19 |
| LNU580 | 70855.3 | 5.6 | 0.07 | 37 | 113.9 | 0.07 | 32 |
| LNU580 | 70855.4 | 5.0 | 0.14 | 23 | 99.8 | 0.20 | 15 |
| LNU549 | 70719.2 | 5.0 | 0.21 | 22 | — | — | — |
| LNU549 | 70723.2 | 5.8 | L | 41 | 112.6 | L | 30 |
| LNU543 | 70826.1 | 4.5 | 0.17 | 11 | — | — | — |
| LNU543 | 70826.3 | 6.3 | 0.13 | 54 | — | — | — |
| LNU543 | 70828.4 | 6.1 | L | 48 | 97.2 | 0.25 | 12 |
| LNU524 | 70809.2 | 5.3 | 0.16 | 30 | — | — | — |
| CONT. | — | 4.1 | — | — | 86.5 | — | — |
| LNU748 | 72945.1 | 4.3 | 0.11 | 26 | 97.9 | 0.09 | 28 |
| LNU748 | 72945.2 | 5.1 | 0.01 | 47 | 96.4 | 0.12 | 26 |
| LNU748 | 72947.3 | 5.0 | L | 44 | — | — | — |

TABLE 66-continued

Genes showing improved plant performance at nitrogen deficient conditions (T2 generation)

| Gene Name | Event # | Dry Weight [mg] Ave. | P-Val. | % Incr. | Fresh Weight [mg] Ave. | P-Val. | % Incr. |
|---|---|---|---|---|---|---|---|
| LNU746 | 72962.2 | 4.8 | 0.02 | 39 | 93.9 | 0.08 | 23 |
| LNU746 | 72966.3 | 4.2 | 0.24 | 21 | 92.3 | 0.09 | 21 |
| LNU745 | 70911.1 | 4.2 | 0.14 | 20 | — | — | — |
| LNU745 | 70914.2 | 4.5 | 0.26 | 30 | — | — | — |
| LNU745 | 70914.4 | 5.1 | 0.16 | 47 | 100.8 | 0.10 | 32 |
| LNU739 | 71630.1 | 5.3 | 0.12 | 52 | 97.3 | 0.09 | 27 |
| LNU636_H1 | 72937.3 | 4.0 | 0.22 | 16 | 90.5 | 0.23 | 18 |
| LNU636_H1 | 72940.1 | 5.6 | 0.09 | 62 | — | — | — |
| LNU636_H1 | 72942.2 | 4.4 | 0.12 | 27 | — | — | — |
| LNU590 | 70263.3 | 4.6 | 0.19 | 32 | — | — | — |
| LNU590 | 70264.2 | 5.5 | 0.20 | 58 | 100.3 | 0.18 | 31 |
| LNU590 | 70267.4 | 4.0 | 0.24 | 15 | 85.9 | 0.29 | 12 |
| LNU590 | 70267.5 | 4.2 | 0.21 | 21 | — | — | — |
| LNU585 | 72915.1 | 5.3 | L | 52 | 96.4 | 0.05 | 26 |
| LNU556 | 72363.2 | 5.2 | 0.05 | 49 | 90.7 | 0.21 | 19 |
| LNU556 | 72364.2 | 5.5 | 0.14 | 60 | 103.1 | 0.07 | 35 |
| LNU545 | 72595.2 | 5.0 | L | 44 | 94.3 | 0.06 | 23 |
| LNU545 | 72598.1 | 4.5 | 0.04 | 29 | — | — | — |
| CONT. | — | 3.5 | — | — | 76.4 | — | — |
| LNU696 | 70599.4 | 4.5 | 0.06 | 33 | 86.8 | 0.12 | 17 |
| LNU696 | 70600.4 | 3.9 | 0.14 | 15 | 79.4 | 0.25 | 7 |
| LNU696 | 70601.2 | 5.2 | 0.01 | 54 | 94.0 | 0.07 | 27 |
| LNU696 | 70601.4 | 3.8 | 0.12 | 12 | — | — | — |
| LNU686 | 70689.2 | 4.5 | 0.08 | 31 | 81.7 | 0.26 | 10 |
| LNU686 | 70689.4 | 4.2 | 0.13 | 24 | 81.6 | 0.14 | 10 |
| LNU686 | 70690.1 | 4.7 | 0.15 | 39 | 97.7 | 0.15 | 32 |
| LNU686 | 70690.5 | 4.2 | 0.10 | 24 | — | — | — |
| LNU627 | 70490.4 | 4.5 | 0.06 | 32 | — | — | — |
| LNU627 | 70491.3 | 4.9 | 0.05 | 43 | 82.2 | 0.22 | 11 |
| LNU627 | 70491.5 | 5.0 | L | 47 | 104.8 | 0.25 | 42 |
| LNU627 | 70493.5 | 3.8 | 0.17 | 12 | 81.4 | 0.12 | 10 |
| LNU616 | 70503.4 | 4.2 | L | 23 | — | — | — |
| LNU616 | 70505.2 | 4.2 | 0.04 | 22 | — | — | — |
| LNU616 | 70505.3 | 3.8 | 0.23 | 12 | 86.2 | 0.15 | 16 |
| LNU595 | 70274.3 | 3.7 | 0.21 | 10 | — | — | — |
| LNU595 | 70276.1 | 5.6 | 0.05 | 65 | 100.5 | 0.06 | 36 |
| LNU565 | 70624.5 | — | — | — | 81.9 | 0.24 | 11 |
| LNU565 | 70626.1 | 4.1 | L | 21 | — | — | — |
| LNU542 | 70226.1 | 3.8 | 0.20 | 12 | — | — | — |
| LNU539 | 70220.1 | — | — | — | 84.5 | 0.15 | 14 |
| LNU539 | 70221.2 | 3.8 | 0.27 | 12 | — | — | — |
| LNU539 | 70225.2 | 4.5 | 0.13 | 32 | 89.5 | 0.08 | 21 |
| LNU539 | 70225.3 | — | — | — | 88.0 | 0.03 | 19 |
| LNU537 | 70215.4 | 4.5 | 0.16 | 32 | 91.3 | 0.24 | 23 |
| LNU537 | 70217.2 | 6.9 | 0.06 | 103 | 106.6 | 0.04 | 44 |
| LNU537 | 70217.4 | 5.6 | 0.01 | 65 | 109.2 | L | 48 |
| LNU537 | 70218.2 | 4.4 | 0.08 | 29 | 92.6 | 0.09 | 25 |
| CONT. | — | 3.4 | — | — | 74.1 | — | — |
| LNU742 | 71552.1 | 4.6 | 0.05 | 30 | — | — | — |
| LNU734 | 71646.5 | 4.9 | L | 40 | — | — | — |
| LNU734 | 71649.1 | 4.4 | 0.04 | 26 | — | — | — |
| LNU729 | 71517.4 | 4.7 | 0.15 | 34 | — | — | — |
| LNU729 | 71517.6 | 4.9 | 0.09 | 38 | — | — | — |
| LNU729 | 71518.2 | 4.5 | 0.27 | 26 | — | — | — |
| LNU729 | 71519.4 | 4.1 | 0.28 | 17 | — | — | — |
| LNU729 | 71519.6 | 6.6 | L | 88 | — | — | — |
| LNU719 | 71542.3 | 4.8 | 0.12 | 37 | — | — | — |
| LNU719 | 71543.1 | 7.1 | L | 102 | 113.8 | 0.18 | 28 |
| LNU708 | 71797.2 | 4.5 | 0.13 | 27 | — | — | — |
| LNU708 | 71798.4 | 5.5 | L | 55 | — | — | — |
| LNU708 | 71800.1 | 4.9 | 0.19 | 38 | — | — | — |
| LNU659 | 71850.2 | 4.4 | 0.05 | 26 | — | — | — |
| LNU659 | 71855.4 | 4.0 | 0.19 | 14 | — | — | — |
| LNU574 | 71790.2 | 4.6 | 0.10 | 31 | — | — | — |
| LNU574 | 71790.4 | 4.0 | 0.22 | 14 | — | — | — |
| LNU574 | 71791.2 | 4.0 | 0.23 | 14 | — | — | — |
| CONT. | — | 3.5 | — | — | 89.0 | — | — |
| LNU739 | 71630.1 | 4.1 | 0.05 | 35 | 94.0 | L | 38 |
| LNU739 | 71630.3 | 3.7 | 0.14 | 20 | 80.5 | 0.19 | 18 |
| LNU739 | 71630.4 | 3.5 | 0.01 | 16 | 89.1 | 0.07 | 30 |
| LNU739 | 71631.3 | 3.4 | 0.29 | 10 | 77.3 | 0.08 | 13 |
| LNU739 | 71633.5 | 3.4 | 0.11 | 11 | — | — | — |
| LNU715 | 71642.2 | 4.0 | 0.01 | 32 | 77.5 | 0.07 | 13 |
| LNU715 | 71643.2 | 4.2 | 0.05 | 39 | 85.3 | 0.03 | 25 |
| LNU715 | 71643.7 | 4.3 | L | 42 | 91.2 | 0.02 | 34 |
| LNU715 | 71645.3 | 4.5 | 0.04 | 49 | 97.9 | L | 43 |
| LNU653 | 70658.3 | 3.7 | 0.15 | 22 | 82.8 | 0.18 | 21 |
| LNU653 | 70659.4 | 3.4 | 0.29 | 13 | — | — | — |
| LNU638 | 72142.1 | 5.0 | 0.02 | 62 | 95.2 | L | 39 |
| LNU638 | 72142.3 | 4.0 | 0.18 | 31 | 87.5 | 0.10 | 28 |
| LNU638 | 72144.1 | 4.4 | L | 44 | 91.7 | 0.06 | 34 |
| LNU637 | 71664.2 | 3.9 | 0.01 | 26 | — | — | — |
| LNU637 | 71667.1 | 3.7 | L | 21 | 86.7 | 0.14 | 27 |
| LNU637 | 71669.5 | 5.5 | 0.02 | 82 | 94.6 | 0.02 | 39 |
| LNU637 | 71669.6 | — | — | — | 79.5 | 0.19 | 16 |
| LNU618 | 72133.2 | 5.0 | 0.01 | 62 | 104.8 | 0.06 | 53 |
| LNU618 | 72135.1 | 3.9 | L | 28 | 80.8 | 0.04 | 18 |
| LNU618 | 72135.3 | 3.4 | 0.11 | 11 | 73.6 | 0.09 | 8 |
| LNU559 | 70832.4 | 4.3 | 0.09 | 42 | 89.7 | 0.21 | 31 |
| LNU559 | 70834.1 | 4.3 | L | 41 | 87.0 | L | 27 |
| LNU559 | 70835.1 | 4.2 | L | 37 | 97.4 | 0.03 | 43 |
| CONT. | — | 3.1 | — | — | 68.3 | — | — |
| LNU688 | 72694.4 | 5.4 | 0.09 | 36 | — | — | — |
| LNU661 | 72707.2 | 5.5 | 0.11 | 39 | 99.6 | 0.28 | 12 |
| LNU611 | 72698.2 | 5.0 | 0.14 | 27 | 98.5 | 0.29 | 11 |
| LNU573 | 72592.1 | 5.0 | 0.11 | 26 | 99.5 | 0.26 | 12 |
| LNU531 | 70212.1 | 4.7 | 0.23 | 18 | — | — | — |
| LNU522 | 70803.3 | 4.9 | 0.22 | 22 | — | — | — |
| LNU522 | 70805.2 | 6.3 | 0.02 | 59 | 105.9 | 0.21 | 20 |
| CONT. | — | 4.0 | — | — | 88.6 | — | — |

Table 66:
"CONT." — Control;
"Ave." — Average;
"% Incr." = % increment;
"p-val." — p-value;
L means that p-value is less than 0.01, p < 0.1 was considered as significant.

TABLE 67

Genes showing improved plant performance at nitrogen deficient conditions (T2 generation)

| Gene name | Event # | Leaf Area [cm$^2$] Ave. | P-Val. | % Incr. | Roots Coverage [cm$^2$] Ave. | P-Val. | % Incr. | Roots Length [cm] Ave. | P-Val. | % Incr. |
|---|---|---|---|---|---|---|---|---|---|---|
| LNU741 | 71248.5 | — | — | — | 11.9 | 0.12 | 32 | 7.4 | 0.04 | 19 |
| LNU741 | 71249.3 | — | — | — | — | — | — | 7.5 | 0.09 | 20 |
| LNU741 | 71250.3 | — | — | — | 11.9 | 0.16 | 32 | 7.8 | 0.01 | 25 |
| LNU740 | 71242.6 | — | — | — | 13.3 | 0.03 | 48 | 8.1 | L | 29 |
| LNU732 | 71222.4 | — | — | — | 11.3 | 0.25 | 26 | 7.0 | 0.26 | 12 |
| LNU732 | 71224.5 | 0.4 | 0.06 | 17 | 12.7 | 0.12 | 41 | 7.4 | 0.09 | 18 |

TABLE 67-continued

Genes showing improved plant performance at nitrogen deficient conditions (T2 generation)

| Gene name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU728 | 71209.5 | 0.4 | 0.24 | 14 | 12.8 | 0.09 | 43 | 7.0 | 0.23 | 13 |
| LNU728 | 71210.2 | — | — | — | 11.7 | 0.14 | 30 | 8.0 | L | 28 |
| LNU725 | 71198.4 | — | — | — | — | — | — | 6.8 | 0.28 | 9 |
| LNU725 | 71199.1 | — | — | — | 11.3 | 0.24 | 26 | 7.5 | 0.11 | 20 |
| LNU725 | 71199.4 | — | — | — | 11.9 | 0.11 | 32 | 7.5 | 0.03 | 21 |
| LNU714 | 71183.2 | — | — | — | — | — | — | 7.0 | 0.22 | 12 |
| LNU714 | 71183.3 | 0.4 | 0.21 | 11 | — | — | — | — | — | — |
| LNU712 | 71143.3 | — | — | — | 12.2 | 0.13 | 36 | 7.1 | 0.15 | 13 |
| LNU712 | 71144.2 | — | — | — | 11.1 | 0.23 | 23 | 7.2 | 0.11 | 15 |
| LNU712 | 71144.3 | — | — | — | 11.5 | 0.25 | 27 | 7.4 | 0.06 | 18 |
| LNU712 | 71147.1 | — | — | — | 12.1 | 0.17 | 35 | 6.9 | 0.26 | 10 |
| LNU711 | 71137.5 | — | — | — | 12.0 | 0.14 | 34 | 7.4 | 0.11 | 18 |
| LNU711 | 71139.3 | 0.4 | 0.09 | 16 | 11.7 | 0.17 | 30 | — | — | — |
| CONT. | — | 0.4 | — | — | 9.0 | — | — | 6.2 | — | — |
| LNU646 | 72145.1 | 0.4 | 0.06 | 29 | 12.6 | 0.04 | 43 | 8.1 | 0.03 | 21 |
| LNU646 | 72145.3 | — | — | — | — | — | — | 7.7 | 0.05 | 15 |
| LNU646 | 72148.2 | 0.4 | 0.14 | 20 | 12.1 | 0.02 | 37 | 7.7 | 0.04 | 15 |
| LNU646 | 72150.2 | 0.4 | 0.27 | 12 | 12.9 | L | 46 | 8.0 | L | 19 |
| LNU638 | 72139.2 | — | — | — | 13.6 | 0.03 | 53 | 7.5 | 0.07 | 11 |
| LNU638 | 72142.3 | 0.4 | 0.29 | 22 | — | — | — | — | — | — |
| LNU638 | 72143.3 | 0.5 | L | 53 | 18.2 | 0.04 | 106 | 7.9 | 0.02 | 17 |
| LNU638 | 72144.1 | 0.4 | 0.01 | 36 | 13.7 | 0.05 | 54 | — | — | — |
| LNU637 | 71669.5 | 0.4 | 0.02 | 21 | 11.8 | 0.04 | 33 | 7.7 | 0.02 | 15 |
| LNU637 | 71669.6 | 0.4 | 0.04 | 25 | 14.6 | 0.05 | 65 | 8.2 | L | 22 |
| LNU637 | 71669.8 | 0.4 | 0.18 | 19 | 13.9 | 0.03 | 57 | — | — | — |
| LNU615 | 72287.1 | — | — | — | 12.5 | 0.16 | 41 | — | — | — |
| LNU601 | 72127.2 | 0.4 | 0.11 | 15 | — | — | — | 7.2 | 0.20 | 7 |
| LNU601 | 72129.2 | — | — | — | — | — | — | 7.6 | 0.07 | 13 |
| LNU601 | 72131.3 | 0.3 | 0.24 | 9 | 12.4 | 0.02 | 40 | 7.4 | 0.15 | 9 |
| LNU601 | 72131.4 | 0.5 | L | 56 | 15.8 | 0.03 | 79 | 8.1 | 0.01 | 20 |
| LNU546 | 72584.2 | 0.4 | 0.03 | 20 | 11.6 | 0.06 | 32 | 7.6 | 0.06 | 13 |
| LNU546 | 72584.3 | 0.4 | 0.22 | 16 | 10.3 | 0.29 | 17 | 7.4 | 0.21 | 10 |
| LNU546 | 72586.1 | — | — | — | 13.7 | 0.07 | 55 | — | — | — |
| LNU546 | 72587.3 | 0.4 | 0.12 | 30 | 13.4 | 0.10 | 51 | — | — | — |
| LNU546 | 72588.1 | — | — | — | 11.1 | 0.20 | 26 | 7.3 | 0.30 | 8 |
| CONT. | — | 0.3 | — | — | 8.8 | — | — | 6.7 | — | — |
| LNU735 | 71872.2 | 0.5 | 0.08 | 28 | 12.2 | 0.09 | 19 | — | — | — |
| LNU718 | 71504.6 | 0.5 | L | 47 | 11.5 | 0.28 | 12 | 7.2 | 0.28 | 5 |
| LNU718 | 71506.4 | 0.4 | 0.12 | 20 | — | — | — | — | — | — |
| LNU718 | 71507.2 | 0.4 | 0.07 | 22 | — | — | — | — | — | — |
| LNU713 | 71862.1 | 0.5 | 0.05 | 39 | — | — | — | — | — | — |
| LNU713 | 71863.2 | 0.4 | 0.11 | 21 | 12.8 | 0.03 | 25 | — | — | — |
| LNU713 | 71864.1 | 0.4 | 0.09 | 20 | 11.2 | 0.19 | 10 | — | — | — |
| LNU713 | 71865.2 | 0.4 | 0.24 | 14 | — | — | — | — | — | — |
| LNU713 | 71867.1 | 0.4 | 0.13 | 20 | — | — | — | — | — | — |
| LNU689 | 71778.2 | 0.4 | 0.16 | 23 | 12.1 | 0.30 | 18 | — | — | — |
| LNU689 | 71778.3 | 0.4 | 0.25 | 17 | — | — | — | — | — | — |
| LNU689 | 71779.6 | 0.5 | 0.02 | 43 | — | — | — | — | — | — |
| LNU601 | 72127.2 | 0.4 | 0.18 | 16 | — | — | — | — | — | — |
| LNU601 | 72131.3 | 0.4 | 0.19 | 17 | — | — | — | — | — | — |
| CONT. | — | 0.4 | — | — | 10.3 | — | — | 6.9 | — | — |
| LNU706 | 71343.1 | 0.5 | 0.11 | 23 | 14.8 | 0.27 | 25 | 8.1 | 0.10 | 12 |
| LNU706 | 71343.2 | — | — | — | — | — | — | 7.9 | 0.06 | 9 |
| LNU706 | 71344.5 | — | — | — | 13.5 | 0.21 | 15 | 8.0 | 0.06 | 10 |
| LNU703 | 71490.5 | — | — | — | 15.7 | 0.16 | 33 | 8.1 | 0.02 | 12 |
| LNU703 | 71492.6 | — | — | — | — | — | — | 8.0 | 0.04 | 10 |
| LNU695 | 71303.2 | 0.6 | 0.05 | 33 | 18.1 | 0.07 | 53 | 8.3 | 0.03 | 14 |
| LNU687 | 71474.1 | — | — | — | 13.4 | 0.29 | 14 | 8.1 | 0.13 | 12 |
| LNU687 | 71474.3 | 0.5 | 0.16 | 11 | 14.9 | 0.14 | 26 | 8.0 | 0.10 | 10 |
| LNU687 | 71474.6 | 0.5 | 0.27 | 8 | 14.0 | 0.28 | 19 | 8.0 | 0.23 | 9 |
| LNU674 | 71428.2 | — | — | — | 18.7 | 0.13 | 59 | 8.5 | L | 17 |
| LNU674 | 71429.3 | — | — | — | — | — | — | 7.8 | 0.20 | 7 |
| LNU672 | 71420.1 | — | — | — | 15.0 | 0.03 | 28 | — | — | — |
| LNU672 | 71420.3 | 0.5 | 0.04 | 27 | 19.3 | 0.01 | 64 | 8.0 | 0.15 | 11 |
| LNU672 | 71421.6 | 0.5 | L | 23 | 16.3 | L | 38 | 8.2 | 0.01 | 14 |
| LNU652 | 71378.3 | 0.5 | 0.17 | 16 | — | — | — | — | — | — |
| LNU652 | 71380.1 | 0.5 | 0.16 | 14 | 17.9 | L | 52 | 7.9 | 0.16 | 9 |
| LNU632 | 71370.1 | — | — | — | 18.0 | 0.02 | 53 | — | — | — |
| LNU632 | 71372.4 | — | — | — | — | — | — | 7.9 | 0.12 | 9 |
| LNU632 | 71372.6 | 0.6 | L | 33 | 17.5 | 0.01 | 49 | 8.2 | 0.02 | 14 |
| LNU624 | 71364.2 | 0.5 | 0.17 | 13 | — | — | — | — | — | — |
| LNU624 | 71366.1 | — | — | — | 15.1 | 0.23 | 28 | — | — | — |
| CONT. | — | 0.4 | — | — | 11.8 | — | — | 7.2 | — | — |

TABLE 67-continued

Genes showing improved plant performance at nitrogen deficient conditions (T2 generation)

| Gene name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU706 | 71342.1 | 0.5 | L | 34 | 14.3 | 0.08 | 23 | 7.7 | 0.10 | 10 |
| LNU706 | 71343.1 | 0.5 | 0.03 | 34 | — | — | — | — | — | — |
| LNU706 | 71344.5 | 0.5 | 0.10 | 38 | 16.0 | 0.13 | 38 | 7.8 | 0.29 | 11 |
| LNU695 | 71302.4 | 0.4 | 0.20 | 21 | 14.2 | 0.29 | 23 | — | — | — |
| LNU695 | 71303.2 | 0.4 | 0.08 | 27 | — | — | — | — | — | — |
| LNU687 | 71474.1 | 0.4 | 0.25 | 14 | — | — | — | — | — | — |
| LNU687 | 71476.3 | 0.6 | L | 65 | 21.4 | L | 85 | 8.1 | 0.04 | 16 |
| LNU674 | 71427.1 | 0.4 | 0.22 | 18 | — | — | — | — | — | — |
| LNU674 | 71428.2 | 0.4 | 0.16 | 16 | 15.4 | 0.16 | 33 | 7.4 | 0.29 | 6 |
| LNU672 | 71420.3 | 0.5 | 0.07 | 30 | 16.1 | 0.05 | 39 | — | — | — |
| LNU672 | 71421.4 | — | — | — | — | — | — | 8.0 | 0.03 | 14 |
| LNU672 | 71421.6 | 0.4 | 0.12 | 21 | — | — | — | — | — | — |
| LNU652 | 71376.6 | 0.5 | 0.06 | 36 | — | — | — | — | — | — |
| LNU652 | 71378.1 | 0.4 | 0.04 | 24 | 13.9 | 0.16 | 20 | — | — | — |
| LNU652 | 71378.3 | 0.4 | 0.14 | 16 | — | — | — | — | — | — |
| LNU652 | 71380.1 | 0.4 | 0.11 | 17 | 14.1 | 0.15 | 22 | — | — | — |
| LNU624 | 71364.2 | 0.4 | 0.05 | 23 | 13.9 | 0.21 | 20 | — | — | — |
| CONT. | — | 0.3 | — | — | 11.6 | — | — | 7.0 | — | — |
| LNU741 | 71248.4 | 0.5 | L | 40 | 13.9 | L | 135 | 7.3 | L | 41 |
| LNU741 | 71249.3 | — | — | — | 7.0 | 0.14 | 18 | 5.7 | 0.14 | 10 |
| LNU741 | 71249.5 | — | — | — | 8.1 | 0.27 | 37 | — | — | — |
| LNU740 | 71242.4 | — | — | — | 10.9 | L | 84 | 6.5 | L | 26 |
| LNU732 | 71222.4 | 0.4 | 0.02 | 22 | 12.8 | 0.02 | 117 | 6.3 | 0.07 | 22 |
| LNU732 | 71224.5 | 0.4 | 0.16 | 9 | 8.0 | 0.13 | 35 | — | — | — |
| LNU728 | 71210.2 | — | — | — | 6.8 | 0.18 | 15 | — | — | — |
| LNU728 | 71214.3 | — | — | — | 10.9 | 0.20 | 85 | 6.4 | 0.12 | 23 |
| LNU726 | 71203.5 | — | — | — | 7.5 | 0.15 | 26 | — | — | — |
| LNU726 | 71204.4 | — | — | — | 6.6 | 0.24 | 12 | 5.6 | 0.21 | 8 |
| LNU726 | 71205.2 | 0.4 | 0.10 | 7 | 7.5 | 0.02 | 28 | 6.3 | L | 22 |
| LNU725 | 71198.4 | 0.4 | 0.13 | 5 | — | — | — | 6.1 | 0.05 | 18 |
| LNU725 | 71199.1 | — | — | — | 8.5 | 0.05 | 44 | 6.0 | 0.05 | 17 |
| LNU725 | 71201.5 | — | — | — | 8.5 | L | 45 | 5.8 | 0.13 | 12 |
| LNU714 | 71181.2 | 0.5 | 0.05 | 29 | 12.1 | 0.02 | 105 | 6.6 | L | 29 |
| LNU714 | 71181.3 | — | — | — | 7.7 | 0.09 | 30 | 5.9 | 0.11 | 14 |
| LNU714 | 71182.1 | — | — | — | 7.2 | 0.22 | 22 | 5.8 | 0.08 | 12 |
| LNU714 | 71183.2 | — | — | — | 6.9 | 0.14 | 16 | — | — | — |
| LNU712 | 71144.2 | 0.4 | 0.28 | 13 | 11.7 | L | 98 | 6.4 | 0.05 | 23 |
| LNU712 | 71144.3 | 0.4 | 0.21 | 7 | 8.4 | 0.08 | 43 | 5.9 | 0.11 | 14 |
| LNU712 | 71147.4 | 0.4 | 0.04 | 19 | 12.6 | L | 114 | 6.5 | 0.02 | 25 |
| LNU711 | 71139.2 | — | — | — | — | — | — | 5.9 | 0.06 | 14 |
| LNU711 | 71139.3 | — | — | — | — | — | — | 5.7 | 0.24 | 10 |
| CONT. | — | 0.4 | — | — | 5.9 | — | — | 5.2 | — | — |
| LNU709 | 71498.3 | 0.4 | 0.17 | 18 | 12.5 | 0.10 | 30 | — | — | — |
| LNU693 | 71547.5 | 0.4 | 0.19 | 11 | 11.4 | 0.24 | 19 | 8.1 | 0.03 | 16 |
| LNU676 | 71095.2 | — | — | — | 12.3 | 0.03 | 28 | 7.5 | 0.13 | 8 |
| LNU676 | 71095.3 | — | — | — | — | — | — | 7.5 | 0.22 | 7 |
| LNU676 | 71095.4 | 0.4 | 0.23 | 11 | — | — | — | — | — | — |
| LNU676 | 71096.4 | — | — | — | — | — | — | 7.5 | 0.15 | 8 |
| LNU671 | 71091.5 | — | — | — | — | — | — | 7.5 | 0.27 | 7 |
| LNU671 | 71094.5 | 0.4 | 0.18 | 15 | — | — | — | — | — | — |
| LNU659 | 71853.2 | — | — | — | 11.8 | 0.05 | 24 | — | — | — |
| LNU659 | 71855.5 | — | — | — | 12.6 | 0.13 | 32 | — | — | — |
| LNU654 | 71556.1 | 0.4 | 0.09 | 27 | — | — | — | — | — | — |
| LNU654 | 71557.3 | — | — | — | 11.3 | 0.12 | 18 | — | — | — |
| LNU654 | 71561.4 | 0.4 | 0.05 | 24 | 13.0 | 0.08 | 36 | 8.1 | 0.02 | 16 |
| LNU607 | 71595.1 | 0.4 | 0.19 | 12 | 13.5 | 0.19 | 41 | — | — | — |
| LNU607 | 71595.3 | — | — | — | 11.3 | 0.30 | 18 | — | — | — |
| LNU603 | 71612.1 | 0.4 | 0.15 | 12 | — | — | — | — | — | — |
| LNU603 | 71612.3 | 0.4 | 0.02 | 22 | 12.6 | 0.04 | 31 | 8.1 | L | 16 |
| LNU521 | 71598.4 | — | — | — | 11.4 | 0.17 | 19 | 7.9 | 0.02 | 13 |
| LNU521 | 71601.3 | 0.4 | 0.16 | 12 | — | — | — | — | — | — |
| CONT. | — | 0.3 | — | — | 9.6 | — | — | 7.0 | — | — |
| LNU742 | 71552.2 | 0.5 | L | 26 | 15.5 | L | 49 | 8.1 | 0.07 | 10 |
| LNU742 | 71552.4 | 0.4 | 0.07 | 17 | 14.6 | 0.07 | 40 | — | — | — |
| LNU742 | 71554.2 | 0.5 | 0.01 | 28 | 14.7 | 0.11 | 41 | — | — | — |
| LNU742 | 71555.2 | — | — | — | 12.5 | 0.09 | 20 | — | — | — |
| LNU734 | 71646.5 | 0.5 | 0.04 | 40 | 19.2 | 0.01 | 84 | 8.2 | 0.02 | 10 |
| LNU734 | 71648.2 | 0.5 | 0.14 | 22 | — | — | — | — | — | — |
| LNU734 | 71648.3 | 0.6 | L | 48 | 20.2 | 0.02 | 94 | 8.2 | 0.02 | 11 |
| LNU734 | 71648.5 | 0.4 | 0.26 | 12 | 15.0 | 0.16 | 44 | — | — | — |
| LNU734 | 71649.1 | 0.6 | L | 55 | 17.6 | L | 69 | 8.6 | L | 17 |
| LNU715 | 71642.2 | 0.5 | 0.01 | 32 | 17.9 | 0.06 | 72 | 8.3 | 0.17 | 12 |
| LNU715 | 71643.1 | 0.5 | L | 33 | 18.0 | L | 72 | 8.0 | 0.06 | 8 |

TABLE 67-continued

Genes showing improved plant performance at nitrogen deficient conditions (T2 generation)

| Gene name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU715 | 71643.2 | 0.6 | L | 56 | 18.1 | L | 73 | 8.2 | 0.03 | 11 |
| LNU715 | 71643.3 | 0.5 | 0.03 | 36 | 16.1 | 0.08 | 55 | — | — | — |
| LNU715 | 71645.3 | 0.5 | 0.02 | 41 | 18.5 | 0.01 | 78 | 8.4 | 0.01 | 14 |
| LNU567 | 70995.1 | 0.5 | 0.11 | 38 | 14.0 | 0.13 | 34 | — | — | — |
| LNU567 | 70995.2 | 0.5 | 0.01 | 44 | 16.9 | L | 62 | 8.4 | L | 14 |
| LNU567 | 70995.4 | 0.4 | 0.12 | 12 | 13.1 | 0.08 | 26 | — | — | — |
| LNU567 | 70998.1 | 0.4 | 0.21 | 12 | 11.1 | 0.19 | 7 | — | — | — |
| LNU567 | 70998.3 | 0.5 | 0.03 | 26 | 17.0 | 0.03 | 64 | 8.1 | 0.04 | 10 |
| LNU567 | 70998.4 | 0.5 | 0.04 | 35 | 15.3 | L | 47 | 7.9 | 0.29 | 6 |
| CONT. | — | 0.4 | — | — | 10.4 | — | — | 7.4 | — | — |
| LNU706 | 71340.4 | — | — | — | 11.3 | 0.18 | 30 | — | — | — |
| LNU706 | 71342.1 | 0.4 | 0.07 | 23 | — | — | — | — | — | — |
| LNU706 | 71343.2 | 0.4 | 0.05 | 32 | 12.9 | 0.05 | 48 | 7.9 | 0.26 | 5 |
| LNU702 | 71860.2 | — | — | — | 11.2 | 0.23 | 29 | — | — | — |
| LNU693 | 71547.3 | 0.4 | 0.16 | 18 | 14.3 | 0.01 | 65 | — | — | — |
| LNU693 | 71548.6 | 0.5 | L | 43 | 14.8 | 0.03 | 71 | 8.3 | 0.05 | 10 |
| LNU668 | 71415.5 | 0.4 | 0.06 | 19 | 13.2 | 0.01 | 52 | — | — | — |
| LNU668 | 71416.3 | 0.4 | 0.18 | 14 | 12.0 | 0.06 | 38 | — | — | — |
| LNU545 | 72596.1 | — | — | — | 12.0 | 0.14 | 38 | — | — | — |
| LNU545 | 72597.1 | 0.4 | 0.04 | 35 | 13.0 | 0.05 | 50 | — | — | — |
| CONT. | — | 0.3 | — | — | 8.7 | — | — | 7.5 | — | — |
| LNU696 | 70600.3 | — | — | — | — | — | — | 6.9 | 0.11 | 7 |
| LNU696 | 70601.2 | — | — | — | 13.1 | 0.29 | 26 | 6.9 | 0.29 | 7 |
| LNU696 | 70601.3 | 0.6 | 0.04 | 28 | 14.6 | 0.08 | 40 | 7.2 | 0.03 | 12 |
| LNU686 | 70689.2 | 0.5 | 0.24 | 8 | — | — | — | — | — | — |
| LNU686 | 70689.5 | 0.6 | 0.01 | 20 | 14.8 | 0.12 | 42 | 7.4 | L | 15 |
| LNU627 | 70490.2 | 0.5 | 0.09 | 17 | — | — | — | — | — | — |
| LNU627 | 70491.3 | 0.5 | 0.11 | 14 | — | — | — | — | — | — |
| LNU627 | 70491.5 | 0.5 | 0.27 | 10 | 12.4 | 0.21 | 19 | — | — | — |
| LNU616 | 70503.2 | — | — | — | 12.1 | 0.28 | 16 | — | — | — |
| LNU616 | 70504.4 | — | — | — | 13.9 | 0.09 | 33 | 6.9 | 0.17 | 6 |
| LNU616 | 70505.2 | 0.5 | 0.23 | 10 | — | — | — | 6.9 | 0.10 | 8 |
| LNU616 | 70505.3 | 0.5 | 0.19 | 15 | — | — | — | 6.8 | 0.28 | 5 |
| LNU595 | 70274.3 | 0.6 | 0.02 | 21 | 13.2 | 0.03 | 27 | 6.9 | 0.10 | 7 |
| LNU595 | 70278.1 | 0.5 | L | 14 | — | — | — | 6.7 | 0.22 | 5 |
| LNU565 | 70624.3 | — | — | — | 12.5 | 0.19 | 20 | 6.9 | 0.14 | 7 |
| LNU565 | 70624.5 | 0.5 | 0.11 | 8 | 18.5 | L | 77 | 7.2 | 0.05 | 13 |
| LNU565 | 70626.1 | — | — | — | 13.0 | 0.13 | 25 | 6.7 | 0.25 | 5 |
| LNU565 | 70626.4 | — | — | — | — | — | — | 6.7 | 0.23 | 5 |
| LNU542 | 70226.1 | 0.5 | 0.17 | 6 | — | — | — | — | — | — |
| LNU542 | 70226.2 | 0.6 | L | 27 | 15.5 | 0.02 | 48 | 7.2 | L | 12 |
| LNU542 | 70229.3 | — | — | — | 13.3 | 0.07 | 27 | 6.8 | 0.29 | 5 |
| LNU542 | 70230.2 | 0.5 | 0.27 | 11 | — | — | — | — | — | — |
| LNU539 | 70220.1 | 0.5 | 0.09 | 8 | — | — | — | 6.8 | 0.14 | 6 |
| LNU539 | 70221.2 | 0.5 | L | 14 | — | — | — | 6.7 | 0.22 | 5 |
| LNU539 | 70225.3 | 0.5 | 0.02 | 16 | — | — | — | 6.8 | 0.20 | 5 |
| LNU537 | 70215.4 | 0.5 | 0.25 | 11 | — | — | — | 6.9 | 0.13 | 6 |
| LNU537 | 70217.2 | — | — | — | 12.5 | 0.12 | 20 | — | — | — |
| CONT. | — | 0.5 | — | — | 10.5 | — | — | 6.4 | — | — |
| LNU688 | 72692.3 | 0.5 | 0.16 | 17 | 16.7 | 0.17 | 23 | 8.5 | 0.04 | 6 |
| LNU688 | 72694.3 | — | — | — | 17.3 | 0.07 | 28 | — | — | — |
| LNU645 | 73005.4 | — | — | — | — | — | — | 8.2 | 0.25 | 3 |
| LNU608 | 72997.2 | 0.4 | 0.24 | 7 | — | — | — | 8.4 | 0.07 | 5 |
| LNU608 | 72997.3 | 0.4 | 0.14 | 11 | — | — | — | — | — | — |
| LNU608 | 72997.4 | 0.4 | 0.22 | 13 | 16.7 | 0.15 | 23 | — | — | — |
| LNU608 | 73000.1 | — | — | — | 16.8 | 0.11 | 24 | — | — | — |
| LNU554 | 70478.2 | 0.5 | 0.07 | 19 | 16.5 | 0.18 | 22 | 8.3 | 0.23 | 4 |
| LNU554 | 70479.1 | 0.6 | 0.02 | 52 | 20.3 | 0.16 | 50 | 8.4 | 0.27 | 5 |
| LNU554 | 70483.2 | — | — | — | — | — | — | 8.4 | 0.14 | 5 |
| LNU545 | 72598.1 | 0.5 | 0.19 | 17 | — | — | — | 8.3 | 0.06 | 5 |
| CONT. | — | 0.4 | — | — | 13.6 | — | — | 8.0 | — | — |
| LNU748 | 72945.1 | 0.4 | 0.11 | 40 | 15.8 | 0.20 | 46 | 8.2 | 0.18 | 10 |
| LNU748 | 72947.2 | 0.3 | 0.19 | 20 | — | — | — | — | — | — |
| LNU748 | 72947.3 | — | — | — | 15.8 | 0.17 | 45 | — | — | — |
| LNU747 | 70619.1 | 0.4 | 0.21 | 42 | — | — | — | — | — | — |
| LNU747 | 70619.4 | 0.3 | 0.23 | 20 | 14.6 | 0.09 | 35 | — | — | — |
| LNU746 | 72964.3 | 0.4 | 0.03 | 35 | 14.9 | 0.07 | 37 | 8.3 | 0.13 | 11 |
| LNU746 | 72966.2 | 0.4 | 0.21 | 27 | — | — | — | — | — | — |
| LNU746 | 72966.3 | — | — | — | — | — | — | 8.0 | 0.27 | 8 |
| LNU688 | 72692.3 | 0.4 | 0.06 | 45 | 18.0 | 0.05 | 66 | — | — | — |
| LNU688 | 72694.3 | 0.4 | L | 47 | 18.8 | L | 73 | — | — | — |
| LNU645 | 73006.1 | 0.3 | 0.28 | 16 | — | — | — | — | — | — |
| LNU636_H1 | 72939.3 | 0.4 | 0.02 | 42 | 17.8 | 0.02 | 64 | 8.4 | 0.02 | 13 |

TABLE 67-continued

Genes showing improved plant performance at nitrogen deficient conditions (T2 generation)

| Gene name | Event # | Leaf Area [cm²] Ave. | P-Val. | % Incr. | Roots Coverage [cm²] Ave. | P-Val. | % Incr. | Roots Length [cm] Ave. | P-Val. | % Incr. |
|---|---|---|---|---|---|---|---|---|---|---|
| LNU636_H1 | 72942.1 | 0.3 | 0.21 | 19 | 14.1 | 0.29 | 30 | — | — | — |
| LNU636_H1 | 72942.2 | 0.4 | 0.12 | 28 | 14.6 | 0.16 | 35 | — | — | — |
| LNU608 | 72997.2 | 0.4 | 0.23 | 22 | 14.4 | 0.10 | 33 | 8.3 | 0.05 | 11 |
| LNU608 | 72997.4 | 0.4 | 0.02 | 41 | 16.3 | 0.07 | 50 | — | — | — |
| LNU588 | 72992.1 | 0.4 | 0.24 | 23 | — | — | — | — | — | — |
| LNU585 | 72915.1 | 0.4 | 0.02 | 46 | 17.2 | 0.02 | 58 | 8.2 | 0.11 | 10 |
| LNU585 | 72917.3 | 0.4 | 0.03 | 53 | 14.2 | 0.28 | 31 | — | — | — |
| CONT. | — | 0.3 | — | — | 10.8 | — | — | 7.4 | — | — |
| LNU639 | 70869.2 | — | — | — | 10.9 | L | 47 | 6.1 | 0.11 | 11 |
| LNU635 | 70784.3 | 0.6 | L | 28 | 14.1 | L | 91 | 6.8 | L | 24 |
| LNU635 | 70784.4 | — | — | — | 10.1 | 0.23 | 36 | 6.0 | 0.23 | 9 |
| LNU580 | 70851.4 | — | — | — | — | — | — | 6.2 | 0.22 | 12 |
| LNU580 | 70853.2 | — | — | — | 8.5 | 0.17 | 15 | 6.1 | 0.11 | 12 |
| LNU549 | 70719.1 | — | — | — | — | — | — | 6.0 | 0.16 | 10 |
| LNU549 | 70723.2 | — | — | — | 12.1 | 0.01 | 64 | 6.3 | 0.07 | 14 |
| LNU524 | 70809.1 | 0.5 | 0.13 | 14 | 10.9 | 0.08 | 47 | 6.3 | 0.08 | 14 |
| LNU524 | 70809.2 | — | — | — | 9.5 | 0.09 | 29 | 6.2 | 0.05 | 12 |
| CONT. | — | 0.4 | — | — | 7.4 | — | — | 5.5 | — | — |
| LNU729 | 71519.4 | 0.5 | 0.25 | 10 | — | — | — | 7.6 | 0.24 | 4 |
| LNU719 | 71542.3 | 0.5 | 0.01 | 22 | 15.7 | L | 44 | — | — | — |
| LNU719 | 71543.8 | 0.5 | 0.27 | 11 | — | — | — | 7.7 | 0.19 | 6 |
| LNU709 | 71498.4 | — | — | — | 13.5 | 0.17 | 24 | — | — | — |
| LNU709 | 71501.3 | 0.5 | L | 20 | 15.1 | 0.02 | 39 | 8.1 | L | 12 |
| LNU693 | 71547.5 | — | — | — | — | — | — | 7.7 | 0.21 | 6 |
| LNU693 | 71548.6 | 0.5 | 0.10 | 17 | 16.1 | 0.06 | 47 | 7.9 | 0.24 | 9 |
| LNU654 | 71556.1 | 0.4 | 0.22 | 6 | — | — | — | — | — | — |
| LNU654 | 71561.4 | 0.5 | 0.21 | 10 | — | — | — | 7.6 | 0.17 | 5 |
| LNU607 | 71592.5 | 0.5 | 0.10 | 12 | 15.4 | L | 40 | 7.8 | 0.08 | 8 |
| LNU607 | 71595.1 | 0.5 | 0.12 | 24 | 16.3 | 0.16 | 49 | 7.9 | 0.22 | 9 |
| LNU607 | 71595.3 | 0.5 | 0.06 | 17 | 14.9 | L | 37 | 7.9 | 0.12 | 8 |
| LNU603 | 71610.5 | 0.5 | 0.02 | 14 | 16.7 | L | 53 | 7.7 | 0.13 | 6 |
| LNU603 | 71612.3 | 0.4 | 0.18 | 6 | — | — | — | — | — | — |
| LNU603 | 71613.2 | — | — | — | — | — | — | 7.6 | 0.15 | 5 |
| LNU603 | 71613.6 | 0.4 | 0.24 | 7 | 13.2 | 0.08 | 20 | — | — | — |
| LNU521 | 71598.3 | — | — | — | 13.1 | 0.16 | 20 | — | — | — |
| LNU521 | 71598.4 | 0.5 | 0.06 | 26 | 15.0 | 0.07 | 38 | 8.2 | L | 13 |
| LNU521 | 71599.3 | 0.5 | 0.12 | 8 | — | — | — | 7.5 | 0.26 | 4 |
| LNU521 | 71601.3 | 0.5 | 0.26 | 10 | 14.0 | 0.27 | 28 | — | — | — |
| LNU521 | 71601.5 | 0.5 | 0.29 | 10 | — | — | — | 7.7 | 0.17 | 6 |
| CONT. | — | 0.4 | — | — | 10.9 | — | — | 7.3 | — | — |
| LNU708 | 71797.2 | 0.4 | 0.02 | 18 | 11.1 | 0.08 | 48 | 6.6 | 0.30 | 5 |
| LNU708 | 71797.3 | 0.4 | 0.16 | 12 | 10.5 | 0.07 | 41 | — | — | — |
| LNU708 | 71798.4 | 0.4 | 0.05 | 21 | 12.1 | 0.02 | 62 | 7.2 | 0.05 | 14 |
| LNU708 | 71800.1 | 0.4 | 0.26 | 13 | — | — | — | — | — | — |
| LNU649 | 71059.1 | 0.4 | 0.14 | 10 | 10.1 | 0.02 | 36 | — | — | — |
| LNU649 | 71063.1 | 0.5 | 0.01 | 46 | 11.3 | 0.17 | 52 | — | — | — |
| LNU648 | 71023.3 | 0.4 | 0.21 | 9 | 9.1 | 0.05 | 22 | 7.0 | 0.02 | 11 |
| LNU648 | 71024.1 | 0.4 | 0.08 | 15 | 10.8 | 0.03 | 45 | — | — | — |
| LNU648 | 71026.1 | 0.4 | 0.20 | 11 | 9.9 | 0.23 | 32 | — | — | — |
| LNU634 | 71014.4 | 0.4 | 0.20 | 10 | 10.3 | 0.05 | 39 | 7.0 | 0.13 | 12 |
| LNU634 | 71016.3 | — | — | — | 11.5 | L | 55 | 7.4 | 0.04 | 17 |
| LNU622 | 70999.3 | 0.4 | 0.03 | 21 | 11.2 | L | 50 | 7.3 | 0.04 | 16 |
| LNU622 | 71004.2 | 0.4 | 0.02 | 21 | 13.7 | L | 84 | 7.3 | L | 16 |
| LNU591 | 71283.1 | 0.4 | 0.04 | 26 | 10.4 | 0.15 | 39 | — | — | — |
| LNU591 | 71283.3 | 0.4 | 0.22 | 11 | 9.9 | 0.03 | 33 | — | — | — |
| LNU591 | 71286.1 | — | — | — | 11.0 | 0.14 | 47 | 7.1 | 0.25 | 14 |
| LNU581 | 71305.2 | 0.4 | L | 24 | 12.4 | L | 66 | 7.4 | L | 17 |
| LNU581 | 71305.7 | 0.4 | L | 27 | 11.3 | 0.12 | 51 | — | — | — |
| LNU581 | 71306.1 | 0.4 | 0.12 | 22 | 10.7 | 0.20 | 44 | — | — | — |
| LNU574 | 71790.4 | 0.4 | L | 28 | 14.6 | L | 96 | 7.8 | L | 24 |
| LNU574 | 71791.2 | 0.4 | 0.04 | 18 | 13.1 | L | 75 | 7.1 | 0.03 | 13 |
| LNU574 | 71791.4 | — | — | — | 8.5 | 0.29 | 14 | — | — | — |
| CONT. | — | 0.4 | — | — | 7.5 | — | — | 6.3 | — | — |
| LNU676 | 71096.4 | — | — | — | — | — | — | 8.2 | 0.29 | 4 |
| LNU676 | 71097.2 | — | — | — | — | — | — | 8.2 | 0.16 | 3 |
| LNU676 | 71097.4 | — | — | — | 15.7 | 0.11 | 16 | 8.1 | 0.15 | 3 |
| LNU671 | 71091.5 | — | — | — | — | — | — | 8.3 | 0.09 | 5 |
| LNU649 | 71062.1 | 0.6 | 0.09 | 20 | — | — | — | — | — | — |
| LNU649 | 71062.2 | 0.5 | 0.12 | 8 | — | — | — | 8.1 | 0.29 | 3 |
| LNU649 | 71064.2 | 0.6 | L | 16 | 18.2 | 0.03 | 35 | — | — | — |
| LNU648 | 71023.3 | 0.6 | L | 24 | 16.8 | 0.08 | 24 | 8.3 | 0.03 | 5 |
| LNU648 | 71024.1 | — | — | — | — | — | — | 8.2 | 0.18 | 4 |
| LNU634 | 71013.4 | 0.6 | L | 20 | 15.0 | 0.23 | 11 | 8.5 | L | 7 |

TABLE 67-continued

Genes showing improved plant performance at nitrogen deficient conditions (T2 generation)

| Gene name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU622 | 70999.1 | 0.6 | 0.03 | 24 | 15.7 | 0.05 | 16 | 8.2 | 0.19 | 4 |
| LNU622 | 71003.4 | 0.6 | 0.07 | 15 | 16.4 | 0.02 | 21 | 8.1 | 0.16 | 3 |
| LNU622 | 71004.2 | — | — | — | — | — | — | 8.2 | 0.20 | 4 |
| LNU581 | 71305.7 | — | — | — | 17.0 | 0.07 | 25 | — | — | — |
| LNU567 | 70998.1 | 0.6 | 0.03 | 18 | — | — | — | 8.2 | 0.11 | 3 |
| LNU567 | 70998.3 | 0.5 | 0.04 | 11 | — | — | — | 8.5 | L | 7 |
| CONT. | — | 0.5 | — | — | 13.5 | — | — | 7.9 | — | — |
| LNU735 | 71873.2 | 0.5 | 0.02 | 22 | 17.1 | 0.05 | 23 | — | — | — |
| LNU713 | 71862.1 | 0.5 | L | 22 | 18.8 | 0.02 | 35 | — | — | — |
| LNU713 | 71867.1 | 0.4 | 0.04 | 13 | — | — | — | — | — | — |
| LNU689 | 71778.3 | — | — | — | 17.7 | 0.25 | 27 | — | — | — |
| LNU689 | 71779.6 | 0.4 | 0.23 | 12 | — | — | — | — | — | — |
| LNU689 | 71783.3 | 0.5 | 0.21 | 20 | — | — | — | — | — | — |
| LNU688 | 72692.3 | — | — | — | 19.0 | 0.18 | 37 | — | — | — |
| LNU669 | 70388.2 | 0.4 | 0.07 | 13 | — | — | — | — | — | — |
| LNU669 | 70391.1 | 0.4 | 0.01 | 13 | — | — | — | — | — | — |
| LNU669 | 70393.1 | 0.4 | 0.19 | 15 | 17.4 | 0.22 | 25 | — | — | — |
| LNU669 | 70393.2 | 0.5 | 0.13 | 19 | 15.7 | 0.19 | 13 | — | — | — |
| LNU669 | 70393.3 | 0.5 | 0.27 | 19 | — | — | — | — | — | — |
| LNU611 | 72698.2 | 0.4 | 0.10 | 14 | 17.4 | 0.05 | 25 | 8.6 | 0.05 | 4 |
| LNU546 | 72584.3 | 0.4 | 0.05 | 13 | 19.0 | L | 37 | — | — | — |
| LNU546 | 72586.1 | 0.5 | 0.14 | 21 | 18.9 | 0.19 | 36 | — | — | — |
| CONT. | — | 0.4 | — | — | 13.9 | — | — | 8.2 | — | — |
| LNU710 | 70712.5 | 0.5 | 0.07 | 27 | 14.7 | 0.05 | 53 | 7.6 | 0.26 | 9 |
| LNU710 | 70712.6 | 0.5 | 0.12 | 16 | 14.7 | L | 53 | 7.7 | 0.06 | 10 |
| LNU710 | 70715.2 | 0.5 | L | 30 | 16.6 | L | 74 | 8.1 | L | 15 |
| LNU710 | 70716.1 | 0.4 | 0.20 | 9 | 10.6 | 0.28 | 11 | — | — | — |
| LNU705 | 70604.2 | 0.5 | 0.07 | 17 | 13.0 | 0.07 | 36 | — | — | — |
| LNU705 | 70604.4 | 0.4 | 0.14 | 10 | 13.5 | 0.01 | 41 | 7.6 | 0.08 | 8 |
| LNU705 | 70606.2 | 0.6 | 0.05 | 41 | 17.4 | L | 81 | 8.0 | 0.01 | 15 |
| LNU705 | 70607.3 | 0.5 | L | 33 | 13.8 | L | 44 | 8.0 | L | 14 |
| LNU639 | 70871.3 | — | — | — | 12.3 | 0.06 | 29 | — | — | — |
| LNU639 | 70871.4 | — | — | — | 10.8 | 0.26 | 12 | — | — | — |
| LNU639 | 70873.2 | 0.5 | 0.19 | 19 | 13.6 | 0.13 | 42 | — | — | — |
| LNU635 | 70784.4 | 0.5 | 0.03 | 21 | 15.0 | L | 57 | 7.6 | 0.12 | 8 |
| LNU635 | 70786.4 | 0.6 | L | 43 | 17.6 | 0.02 | 84 | 8.2 | 0.02 | 18 |
| LNU635 | 70787.3 | 0.5 | 0.02 | 19 | 14.8 | L | 55 | 7.5 | 0.11 | 8 |
| LNU580 | 70851.2 | 0.4 | 0.17 | 13 | 11.5 | 0.20 | 21 | — | — | — |
| LNU580 | 70851.4 | 0.4 | 0.11 | 11 | — | — | — | 7.4 | 0.27 | 5 |
| LNU580 | 70853.2 | 0.5 | 0.18 | 16 | — | — | — | — | — | — |
| LNU580 | 70855.3 | 0.5 | 0.02 | 23 | 13.7 | 0.04 | 43 | 7.8 | 0.06 | 11 |
| LNU580 | 70855.4 | 0.5 | 0.04 | 21 | 13.2 | 0.03 | 37 | 7.6 | 0.27 | 8 |
| LNU549 | 70723.2 | 0.5 | 0.03 | 24 | 14.1 | 0.08 | 48 | 7.8 | 0.05 | 11 |
| LNU543 | 70826.1 | — | — | — | 12.1 | 0.04 | 26 | 7.6 | 0.06 | 8 |
| LNU543 | 70826.3 | 0.5 | 0.01 | 22 | 13.1 | L | 37 | 7.9 | 0.05 | 12 |
| LNU543 | 70827.1 | 0.4 | 0.29 | 7 | — | — | — | — | — | — |
| LNU543 | 70828.1 | — | — | — | 12.4 | 0.05 | 29 | — | — | — |
| LNU543 | 70828.4 | 0.4 | 0.19 | 11 | 13.8 | L | 44 | 7.5 | 0.27 | 7 |
| LNU524 | 70808.1 | 0.5 | 0.07 | 14 | 13.2 | 0.02 | 38 | 7.8 | 0.04 | 11 |
| LNU524 | 70809.2 | 0.5 | 0.14 | 21 | 13.9 | 0.12 | 45 | 7.9 | 0.05 | 12 |
| CONT. | — | 0.4 | — | — | 9.6 | — | — | 7.0 | — | — |
| LNU748 | 72945.1 | 0.5 | 0.12 | 16 | 18.0 | 0.03 | 42 | 8.5 | 0.02 | 12 |
| LNU748 | 72945.2 | 0.5 | L | 22 | 18.7 | 0.02 | 48 | 8.3 | 0.01 | 10 |
| LNU748 | 72947.3 | 0.5 | 0.14 | 23 | 18.4 | L | 46 | 8.5 | L | 13 |
| LNU748 | 72948.5 | — | — | — | 15.1 | 0.12 | 20 | 8.1 | 0.13 | 7 |
| LNU746 | 72962.2 | 0.5 | L | 29 | 19.0 | L | 50 | 8.5 | L | 12 |
| LNU746 | 72966.3 | 0.4 | 0.12 | 10 | 16.4 | 0.10 | 30 | 8.3 | 0.01 | 9 |
| LNU745 | 70911.1 | — | — | — | 16.4 | 0.03 | 30 | — | — | — |
| LNU745 | 70911.4 | — | — | — | 18.4 | 0.02 | 46 | — | — | — |
| LNU745 | 70914.2 | 0.5 | 0.19 | 15 | 16.1 | 0.22 | 27 | — | — | — |
| LNU745 | 70914.4 | 0.5 | 0.05 | 15 | 21.2 | 0.02 | 68 | 8.6 | L | 13 |
| LNU739 | 71630.1 | 0.5 | 0.09 | 18 | 20.5 | L | 63 | 8.6 | L | 14 |
| LNU739 | 71630.3 | — | — | — | — | — | — | 8.1 | 0.28 | 7 |
| LNU739 | 71631.3 | — | — | — | — | — | — | 8.1 | 0.16 | 7 |
| LNU636_H1 | 72937.3 | 0.5 | 0.02 | 22 | 15.7 | 0.12 | 24 | 8.6 | L | 14 |
| LNU636_H1 | 72940.1 | — | — | — | 17.7 | 0.21 | 40 | — | — | — |
| LNU636_H1 | 72942.2 | — | — | — | 17.8 | L | 41 | 8.2 | 0.05 | 9 |
| LNU590 | 70264.2 | 0.5 | 0.20 | 26 | 18.0 | 0.19 | 43 | — | — | — |
| LNU590 | 70267.4 | 0.4 | 0.08 | 11 | — | — | — | — | — | — |
| LNU590 | 70267.5 | 0.5 | 0.30 | 14 | — | — | — | 8.3 | 0.10 | 10 |
| LNU585 | 72913.3 | 0.4 | 0.16 | 13 | — | — | — | 8.2 | 0.03 | 8 |
| LNU585 | 72915.1 | 0.5 | 0.04 | 27 | 21.0 | L | 66 | 8.6 | L | 13 |
| LNU585 | 72917.3 | — | — | — | 14.8 | 0.24 | 17 | 8.4 | 0.03 | 11 |

TABLE 67-continued

Genes showing improved plant performance at nitrogen deficient conditions (T2 generation)

| Gene name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU556 | 72361.2 | — | — | — | — | — | — | 8.1 | 0.30 | 7 |
| LNU556 | 72363.2 | 0.4 | 0.28 | 12 | — | — | — | — | — | — |
| LNU556 | 72364.2 | — | — | — | 18.7 | 0.15 | 48 | 8.7 | L | 15 |
| LNU545 | 72595.2 | 0.5 | 0.05 | 22 | 18.9 | 0.06 | 49 | 8.3 | 0.03 | 9 |
| LNU545 | 72597.1 | 0.4 | 0.13 | 9 | — | — | — | — | — | — |
| LNU545 | 72598.1 | — | — | — | 14.9 | 0.13 | 18 | — | — | — |
| LNU545 | 72599.4 | — | — | — | — | — | — | 8.1 | 0.13 | 6 |
| CONT. | — | 0.4 | — | — | 12.6 | — | — | 7.6 | — | — |
| LNU696 | 70599.4 | 0.4 | L | 13 | 8.5 | 0.25 | 15 | — | — | — |
| LNU696 | 70601.2 | 0.5 | L | 25 | 11.6 | 0.04 | 56 | 7.0 | 0.01 | 12 |
| LNU686 | 70689.2 | 0.4 | 0.22 | 7 | — | — | — | — | — | — |
| LNU686 | 70689.4 | 0.4 | 0.25 | 9 | 8.7 | 0.23 | 17 | — | — | — |
| LNU686 | 70690.1 | 0.4 | 0.21 | 21 | — | — | — | — | — | — |
| LNU627 | 70491.3 | 0.4 | 0.11 | 15 | — | — | — | — | — | — |
| LNU627 | 70491.5 | 0.4 | 0.19 | 15 | 9.5 | 0.21 | 28 | — | — | — |
| LNU627 | 70493.5 | 0.4 | 0.27 | 5 | 9.4 | 0.27 | 26 | — | — | — |
| LNU616 | 70503.4 | 0.5 | L | 22 | — | — | — | — | — | — |
| LNU616 | 70504.4 | 0.4 | 0.12 | 17 | — | — | — | — | — | — |
| LNU616 | 70505.2 | 0.4 | 0.20 | 17 | — | — | — | — | — | — |
| LNU616 | 70505.3 | 0.4 | L | 15 | 8.3 | 0.29 | 11 | — | — | — |
| LNU595 | 70274.3 | 0.4 | L | 20 | — | — | — | — | — | — |
| LNU595 | 70276.1 | 0.5 | 0.04 | 27 | 12.5 | 0.07 | 68 | 7.1 | 0.09 | 13 |
| LNU595 | 70277.1 | 0.4 | 0.18 | 8 | — | — | — | — | — | — |
| LNU595 | 70278.1 | 0.4 | 0.02 | 16 | — | — | — | — | — | — |
| LNU565 | 70624.5 | 0.4 | 0.13 | 6 | 9.5 | 0.16 | 27 | — | — | — |
| LNU542 | 70226.1 | 0.4 | 0.02 | 10 | — | — | — | — | — | — |
| LNU539 | 70220.1 | 0.4 | 0.03 | 15 | 8.5 | 0.16 | 14 | — | — | — |
| LNU539 | 70221.2 | 0.4 | 0.22 | 7 | — | — | — | — | — | — |
| LNU539 | 70225.2 | 0.4 | 0.01 | 13 | 9.7 | 0.20 | 31 | — | — | — |
| LNU539 | 70225.3 | 0.5 | L | 24 | 9.8 | 0.11 | 32 | — | — | — |
| LNU537 | 70215.1 | 0.4 | 0.05 | 9 | — | — | — | — | — | — |
| LNU537 | 70215.4 | 0.4 | 0.10 | 19 | 11.6 | 0.03 | 56 | 6.8 | 0.04 | 9 |
| LNU537 | 70217.2 | 0.4 | L | 20 | 12.2 | 0.07 | 64 | — | — | — |
| LNU537 | 70217.4 | 0.4 | 0.05 | 21 | 12.0 | 0.04 | 62 | 6.7 | 0.25 | 7 |
| CONT. | — | 0.4 | — | — | 7.4 | — | — | 6.3 | — | — |
| LNU742 | 71552.1 | 0.5 | 0.12 | 20 | 17.3 | 0.02 | 30 | 8.4 | 0.12 | 6 |
| LNU734 | 71646.5 | 0.5 | 0.02 | 31 | 18.1 | 0.03 | 36 | 8.5 | 0.04 | 7 |
| LNU734 | 71648.2 | 0.5 | 0.21 | 21 | — | — | — | — | — | — |
| LNU734 | 71648.5 | 0.4 | 0.23 | 14 | — | — | — | — | — | — |
| LNU734 | 71649.1 | 0.5 | 0.02 | 29 | 18.1 | L | 37 | 8.7 | 0.01 | 10 |
| LNU729 | 71517.4 | 0.5 | 0.22 | 25 | 16.0 | 0.05 | 21 | — | — | — |
| LNU729 | 71517.6 | 0.5 | 0.06 | 28 | 16.5 | 0.11 | 25 | — | — | — |
| LNU729 | 71518.2 | 0.5 | 0.06 | 28 | 19.7 | 0.06 | 49 | — | — | — |
| LNU729 | 71519.4 | 0.5 | 0.13 | 18 | — | — | — | — | — | — |
| LNU729 | 71519.6 | 0.5 | L | 39 | 23.5 | L | 77 | 8.3 | 0.14 | 5 |
| LNU719 | 71540.3 | 0.5 | 0.24 | 19 | — | — | — | — | — | — |
| LNU719 | 71542.3 | 0.5 | 0.07 | 28 | 17.2 | 0.23 | 30 | 8.3 | 0.19 | 5 |
| LNU719 | 71543.1 | 0.6 | L | 47 | 20.6 | L | 55 | — | — | — |
| LNU719 | 71543.8 | 0.5 | 0.11 | 26 | — | — | — | 8.3 | 0.19 | 5 |
| LNU708 | 71797.2 | 0.5 | 0.10 | 20 | — | — | — | — | — | — |
| LNU708 | 71798.3 | 0.5 | 0.13 | 21 | — | — | — | — | — | — |
| LNU708 | 71798.4 | 0.5 | 0.03 | 28 | 21.9 | L | 65 | 8.3 | 0.15 | 5 |
| LNU708 | 71800.1 | 0.5 | 0.13 | 29 | — | — | — | — | — | — |
| LNU708 | 71801.5 | 0.5 | 0.06 | 27 | 16.4 | 0.25 | 24 | 8.3 | 0.17 | 5 |
| LNU659 | 71850.2 | 0.5 | 0.18 | 21 | — | — | — | — | — | — |
| LNU659 | 71855.4 | 0.4 | 0.17 | 16 | — | — | — | — | — | — |
| LNU574 | 71790.2 | 0.5 | 0.20 | 18 | 18.9 | 0.07 | 43 | — | — | — |
| LNU574 | 71790.4 | 0.4 | 0.27 | 12 | 15.3 | 0.19 | 16 | — | — | — |
| LNU574 | 71791.2 | 0.5 | 0.19 | 18 | — | — | — | 8.6 | 0.02 | 9 |
| LNU574 | 71791.4 | 0.5 | 0.07 | 23 | — | — | — | — | — | — |
| CONT. | — | 0.4 | — | — | 13.2 | — | — | 7.9 | — | — |
| LNU739 | 71630.1 | 0.5 | L | 23 | 18.5 | L | 132 | 8.4 | L | 39 |
| LNU739 | 71630.3 | 0.5 | 0.04 | 25 | 10.8 | 0.03 | 35 | 7.1 | 0.03 | 17 |
| LNU739 | 71630.4 | 0.5 | L | 16 | 10.9 | L | 37 | 7.2 | L | 18 |
| LNU739 | 71631.3 | — | — | — | 13.1 | 0.02 | 64 | 7.9 | L | 31 |
| LNU739 | 71633.5 | — | — | — | 12.6 | L | 58 | 8.1 | L | 33 |
| LNU715 | 71642.2 | 0.4 | 0.04 | 17 | 12.1 | 0.02 | 51 | 7.2 | 0.06 | 19 |
| LNU715 | 71643.1 | — | — | — | 13.8 | 0.04 | 73 | 7.7 | 0.06 | 27 |
| LNU715 | 71643.2 | 0.5 | L | 21 | 10.5 | 0.27 | 32 | 6.7 | 0.28 | 10 |
| LNU715 | 71643.3 | 0.5 | 0.09 | 24 | 11.8 | 0.02 | 48 | 7.3 | 0.07 | 21 |
| LNU715 | 71645.3 | 0.5 | L | 43 | 17.8 | L | 122 | 8.4 | L | 38 |
| LNU653 | 70658.3 | 0.4 | L | 11 | 10.8 | L | 35 | 6.7 | 0.11 | 10 |
| LNU653 | 70658.5 | — | — | — | 10.2 | 0.11 | 27 | 6.8 | 0.21 | 13 |

TABLE 67-continued

Genes showing improved plant performance at nitrogen deficient conditions (T2 generation)

| Gene name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU653 | 70659.4 | 0.4 | 0.29 | 10 | 12.4 | 0.02 | 56 | 6.9 | 0.19 | 15 |
| LNU638 | 72139.2 | — | — | — | 10.7 | 0.19 | 34 | 7.2 | 0.19 | 19 |
| LNU638 | 72142.1 | 0.5 | L | 33 | 18.9 | L | 137 | 8.4 | L | 39 |
| LNU638 | 72142.3 | 0.5 | 0.05 | 26 | 11.6 | 0.14 | 46 | — | — | — |
| LNU638 | 72144.1 | 0.5 | 0.03 | 31 | 13.7 | L | 71 | 7.1 | 0.08 | 18 |
| LNU637 | 71664.2 | 0.4 | 0.27 | 9 | 14.6 | 0.01 | 83 | 7.3 | 0.08 | 21 |
| LNU637 | 71667.1 | — | — | — | 14.7 | L | 84 | 7.1 | 0.13 | 17 |
| LNU637 | 71669.5 | 0.5 | 0.02 | 23 | 16.9 | 0.01 | 111 | 7.3 | 0.02 | 21 |
| LNU637 | 71669.6 | 0.4 | 0.26 | 6 | 9.4 | 0.14 | 18 | — | — | — |
| LNU618 | 72133.2 | 0.5 | L | 37 | 17.8 | L | 122 | 8.6 | L | 42 |
| LNU618 | 72135.1 | 0.4 | 0.12 | 11 | 10.0 | 0.14 | 25 | 6.6 | 0.25 | 8 |
| LNU618 | 72135.3 | 0.5 | 0.03 | 21 | 9.8 | 0.13 | 22 | 7.2 | 0.04 | 18 |
| LNU559 | 70832.4 | — | — | — | 14.1 | 0.11 | 76 | 7.5 | 0.07 | 24 |
| LNU559 | 70834.1 | 0.5 | 0.09 | 20 | 12.5 | 0.03 | 57 | 7.3 | 0.06 | 21 |
| LNU559 | 70835.1 | 0.5 | 0.01 | 26 | 14.9 | 0.01 | 87 | 7.9 | L | 31 |
| LNU559 | 70835.4 | 0.4 | 0.14 | 10 | 13.0 | 0.02 | 63 | 7.9 | L | 30 |
| LNU559 | 70837.2 | — | — | — | 14.8 | 0.02 | 86 | 8.3 | L | 37 |
| CONT. | — | 0.4 | — | — | 8.0 | — | — | 6.1 | — | — |
| LNU688 | 72692.3 | — | — | — | 16.8 | 0.11 | 25 | 8.8 | 0.01 | 7 |
| LNU688 | 72694.4 | 0.5 | 0.06 | 13 | 19.7 | L | 47 | — | — | — |
| LNU661 | 72707.2 | 0.5 | 0.26 | 8 | 20.9 | L | 56 | — | — | — |
| LNU611 | 72698.2 | 0.5 | 0.08 | 8 | 17.8 | L | 33 | — | — | — |
| LNU611 | 72699.1 | — | — | — | 20.8 | 0.03 | 55 | 8.5 | 0.19 | 4 |
| LNU573 | 72591.3 | — | — | — | — | — | — | 8.5 | 0.08 | 4 |
| LNU573 | 72592.1 | 0.6 | L | 26 | 18.6 | L | 38 | — | — | — |
| LNU558 | 70467.3 | — | — | — | 16.2 | 0.17 | 21 | 8.7 | 0.06 | 6 |
| LNU554 | 70479.3 | — | — | — | — | — | — | 8.6 | 0.23 | 4 |
| LNU531 | 70211.2 | — | — | — | — | — | — | 8.5 | 0.21 | 4 |
| LNU531 | 70212.1 | 0.5 | 0.16 | 13 | 16.9 | 0.02 | 26 | — | — | — |
| LNU531 | 70212.2 | — | — | — | — | — | — | 8.8 | 0.08 | 7 |
| LNU522 | 70803.3 | 0.5 | L | 24 | — | — | — | — | — | — |
| LNU522 | 70805.2 | 0.5 | 0.03 | 23 | 16.9 | 0.10 | 26 | 8.4 | 0.27 | 3 |
| CONT. | — | 0.4 | — | — | 13.4 | — | — | 8.2 | — | — |

Table 67:
CONT." — Control;
"Ave." — Average;
"% Incr." = % increment;
"p-val." — p-value;
L means that p-value is less than 0.01, p < 0.1 was considered as significant.

TABLE 68

Genes showing improved plant performance at nitrogen deficient conditions (T1 generation)

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| LNU583 | 5.7 | 0.29 | 20 | — | — | — |
| CONT. | 4.7 | — | — | — | — | — |
| LNU608 | — | — | — | 123.2 | 0.12 | 9 |
| CONT. | — | — | — | 113.1 | — | — |
| LNU611 | 5.6 | 0.03 | 34 | — | — | — |
| LNU545 | 5.0 | 0.15 | 18 | — | — | — |
| CONT. | 4.2 | — | — | — | — | — |

Table 68:
"CONT."—Control;
"Ave."—Average;
"% Incr." = % increment.
"p-val."—p-value;
L means that p-value is less than 0.01, p < 0.1 was considered as significant.

TABLE 69

Genes showing improved plant performance at nitrogen deficient conditions (T1 generation)

| Gene Name | Leaf Area [cm²] | | | Roots Coverage [cm²] | | | Roots Length [cm²] | | |
|---|---|---|---|---|---|---|---|---|---|
| | Ave. | P-Val. | % Incr. | Ave. | P-Val. | % Incr. | Ave. | P-Val. | % Incr. |
| LNU608 | — | — | — | — | — | — | 7.9 | 0.22 | 6 |
| LNU585 | — | — | — | — | — | — | 7.8 | 0.22 | 5 |
| CONT. | — | — | — | — | — | — | 7.5 | — | — |
| LNU748 | 0.5 | 0.16 | 11 | — | — | — | 7.0 | 0.12 | 24 |
| LNU611 | — | — | — | 14.5 | 0.03 | 44 | 6.6 | 0.17 | 17 |
| LNU545 | 0.5 | 0.29 | 10 | — | — | — | 6.9 | 0.20 | 22 |
| CONT. | 0.4 | — | — | 10.0 | — | — | 5.6 | — | — |

Table 69:
"CONT."—Control;
"Ave."—Average;
"% Incr." = % increment;
"p-val."—p-value;
L means that p-value is less than 0.01, p < 0.1 was considered as significant.

The genes listed in Tables 70-71 have improved plant relative growth rate (relative growth rate of the leaf area, root coverage and root length) when grown under limiting nitrogen growth conditions, compared to control plants (T2 and T1 generations) that were grown under identical growth conditions. Plants showing fast growth rate show a better plant establishment in soil under nitrogen deficient conditions. Faster growth was observed when growth rate of leaf area, root length and root coverage was measured.

TABLE 70

Genes showing improved plant growth rate at nitrogen deficient conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU741 | 71248.5 | — | — | — | 1.5 | 0.20 | 33 | 0.8 | 0.05 | 27 |
| LNU741 | 71249.3 | — | — | — | — | — | — | 0.8 | 0.07 | 26 |
| LNU741 | 71250.3 | — | — | — | 1.5 | 0.20 | 33 | 0.8 | 0.02 | 32 |
| LNU740 | 71242.6 | — | — | — | 1.7 | 0.06 | 50 | 0.9 | L | 39 |
| LNU732 | 71224.5 | — | — | — | 1.6 | 0.12 | 43 | 0.8 | 0.03 | 32 |
| LNU728 | 71209.5 | — | — | — | 1.6 | 0.10 | 43 | — | — | — |
| LNU728 | 71210.2 | — | — | — | 1.5 | 0.22 | 32 | 0.9 | L | 38 |
| LNU726 | 71204.3 | — | — | — | — | — | — | 0.7 | 0.29 | 15 |
| LNU725 | 71198.4 | — | — | — | — | — | — | 0.7 | 0.25 | 15 |
| LNU725 | 71199.1 | — | — | — | — | — | — | 0.8 | 0.13 | 22 |
| LNU725 | 71199.4 | — | — | — | 1.5 | 0.18 | 34 | 0.8 | 0.03 | 28 |
| LNU714 | 71181.2 | — | — | — | — | — | — | 0.7 | 0.25 | 16 |
| LNU714 | 71183.2 | — | — | — | — | — | — | 0.7 | 0.14 | 20 |
| LNU712 | 71143.3 | — | — | — | 1.5 | 0.16 | 36 | — | — | — |
| LNU712 | 71144.2 | — | — | — | — | — | — | 0.7 | 0.19 | 17 |
| LNU712 | 71144.3 | — | — | — | 1.4 | 0.28 | 28 | 0.8 | 0.09 | 23 |
| LNU712 | 71147.1 | — | — | — | 1.5 | 0.18 | 36 | — | — | — |
| LNU711 | 71137.2 | — | — | — | — | — | — | 0.7 | 0.27 | 15 |
| LNU711 | 71137.5 | — | — | — | 1.5 | 0.18 | 34 | 0.7 | 0.20 | 18 |
| LNU711 | 71139.3 | — | — | — | 1.4 | 0.22 | 31 | 0.7 | 0.16 | 20 |
| CONT. | — | — | — | — | 1.1 | — | — | 0.6 | — | — |
| LNU646 | 72145.1 | 0.0 | 0.04 | 32 | 1.5 | 0.02 | 44 | 0.8 | L | 27 |
| LNU646 | 72145.3 | — | — | — | — | — | — | 0.7 | 0.05 | 17 |
| LNU646 | 72148.2 | 0.0 | 0.13 | 22 | 1.5 | 0.04 | 38 | 0.7 | 0.06 | 17 |
| LNU646 | 72150.2 | — | — | — | 1.6 | 0.02 | 49 | 0.9 | L | 38 |
| LNU638 | 72139.2 | — | — | — | 1.6 | L | 54 | — | — | — |
| LNU638 | 72142.3 | 0.0 | 0.13 | 25 | — | — | — | — | — | — |
| LNU638 | 72143.3 | 0.0 | L | 48 | 2.2 | L | 107 | — | — | — |
| LNU638 | 72144.1 | 0.0 | 0.04 | 29 | 1.7 | 0.01 | 56 | — | — | — |
| LNU637 | 71669.5 | 0.0 | 0.17 | 18 | 1.5 | 0.06 | 36 | 0.8 | L | 30 |
| LNU637 | 71669.6 | 0.0 | 0.05 | 27 | 1.8 | L | 67 | 0.8 | 0.01 | 25 |
| LNU637 | 71669.8 | — | — | — | 1.7 | L | 60 | 0.7 | 0.15 | 15 |
| LNU615 | 72285.1 | — | — | — | 1.4 | 0.17 | 35 | — | — | — |
| LNU615 | 72287.1 | — | — | — | 1.5 | 0.05 | 43 | — | — | — |
| LNU601 | 72127.2 | — | — | — | — | — | — | 0.7 | 0.09 | 14 |
| LNU601 | 72129.2 | — | — | — | — | — | — | 0.8 | L | 30 |
| LNU601 | 72131.3 | — | — | — | 1.5 | 0.03 | 42 | 0.7 | 0.07 | 16 |
| LNU601 | 72131.4 | 0.1 | L | 58 | 1.9 | L | 79 | 0.7 | 0.11 | 18 |

TABLE 70-continued

Genes showing improved plant growth rate at nitrogen deficient conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU546 | 72584.2 | 0.0 | 0.14 | 19 | 1.4 | 0.08 | 33 | 0.8 | 0.02 | 21 |
| LNU546 | 72584.3 | — | — | — | — | — | — | 0.7 | 0.28 | 10 |
| LNU546 | 72586.1 | — | — | — | 1.7 | 0.01 | 57 | — | — | — |
| LNU546 | 72587.3 | 0.0 | 0.04 | 33 | 1.6 | 0.02 | 53 | — | — | — |
| LNU546 | 72588.1 | — | — | — | 1.4 | 0.16 | 28 | 0.7 | 0.16 | 14 |
| LNU533 | 71826.1 | — | — | — | 1.4 | 0.18 | 31 | — | — | — |
| CONT. | — | 0.0 | — | — | 1.1 | — | — | 0.6 | — | — |
| LNU735 | 71872.2 | 0.0 | 0.12 | 31 | 1.5 | 0.12 | 18 | — | — | — |
| LNU718 | 71504.6 | 0.1 | 0.02 | 47 | — | — | — | — | — | — |
| LNU718 | 71506.4 | 0.0 | 0.27 | 20 | — | — | — | — | — | — |
| LNU713 | 71862.1 | 0.0 | 0.10 | 33 | — | — | — | — | — | — |
| LNU713 | 71863.2 | — | — | — | 1.6 | 0.03 | 25 | — | — | — |
| LNU713 | 71864.1 | 0.0 | 0.14 | 27 | — | — | — | — | — | — |
| LNU713 | 71865.2 | 0.0 | 0.23 | 22 | — | — | — | — | — | — |
| LNU713 | 71867.1 | 0.0 | 0.18 | 26 | — | — | — | — | — | — |
| LNU689 | 71778.2 | 0.0 | 0.24 | 23 | 1.5 | 0.20 | 17 | — | — | — |
| LNU689 | 71778.3 | 0.0 | 0.24 | 23 | — | — | — | — | — | — |
| LNU689 | 71779.6 | 0.1 | 0.02 | 48 | — | — | — | — | — | — |
| LNU601 | 72127.2 | 0.0 | 0.28 | 20 | — | — | — | — | — | — |
| CONT. | — | 0.0 | — | — | 1.3 | — | — | — | — | — |
| LNU706 | 71342.1 | — | — | — | — | — | — | 0.8 | 0.17 | 12 |
| LNU706 | 71343.1 | 0.1 | 0.07 | 27 | 1.8 | 0.17 | 25 | 0.8 | 0.27 | 10 |
| LNU706 | 71343.2 | — | — | — | — | — | — | 0.8 | 0.23 | 10 |
| LNU706 | 71344.5 | — | — | — | — | — | — | 0.8 | 0.23 | 10 |
| LNU703 | 71490.2 | — | — | — | — | — | — | 0.8 | 0.28 | 8 |
| LNU703 | 71490.5 | — | — | — | 1.9 | 0.07 | 34 | 0.8 | 0.07 | 17 |
| LNU703 | 71492.6 | — | — | — | — | — | — | 0.8 | 0.02 | 19 |
| LNU695 | 71302.3 | — | — | — | — | — | — | 0.8 | 0.28 | 10 |
| LNU695 | 71303.2 | 0.1 | 0.02 | 37 | 2.2 | L | 54 | — | — | — |
| LNU687 | 71474.1 | — | — | — | — | — | — | 0.8 | 0.11 | 14 |
| LNU687 | 71474.3 | — | — | — | 1.8 | 0.13 | 26 | — | — | — |
| LNU687 | 71474.6 | — | — | — | 1.7 | 0.27 | 19 | — | — | — |
| LNU674 | 71428.2 | 0.1 | 0.21 | 22 | 2.3 | 0.01 | 59 | 0.9 | 0.03 | 21 |
| LNU674 | 71429.3 | — | — | — | — | — | — | 0.9 | 0.02 | 21 |
| LNU672 | 71420.1 | — | — | — | 1.9 | 0.08 | 28 | — | — | — |
| LNU672 | 71420.3 | 0.1 | 0.03 | 30 | 2.4 | L | 64 | — | — | — |
| LNU672 | 71421.4 | — | — | — | — | — | — | 0.8 | 0.12 | 14 |
| LNU672 | 71421.6 | 0.1 | 0.10 | 23 | 2.0 | 0.02 | 39 | 0.8 | 0.13 | 13 |
| LNU652 | 71380.1 | — | — | — | 2.2 | L | 53 | 0.8 | 0.17 | 12 |
| LNU632 | 71370.1 | — | — | — | 2.2 | L | 54 | — | — | — |
| LNU632 | 71372.4 | — | — | — | — | — | — | 0.8 | 0.11 | 14 |
| LNU632 | 71372.6 | 0.1 | 0.04 | 31 | 2.1 | L | 48 | 0.8 | 0.22 | 11 |
| LNU624 | 71364.2 | — | — | — | 1.8 | 0.25 | 22 | — | — | — |
| LNU624 | 71366.1 | — | — | — | 1.9 | 0.13 | 29 | — | — | — |
| CONT. | — | 0.0 | — | — | 1.4 | — | — | 0.7 | — | — |
| LNU706 | 71342.1 | 0.0 | 0.01 | 44 | 1.8 | 0.19 | 24 | 0.8 | 0.22 | 12 |
| LNU706 | 71343.1 | 0.0 | 0.06 | 35 | — | — | — | 0.8 | 0.26 | 12 |
| LNU706 | 71344.5 | 0.0 | 0.04 | 47 | 2.0 | 0.07 | 39 | 0.8 | 0.27 | 15 |
| LNU695 | 71301.4 | — | — | — | — | — | — | 0.8 | 0.21 | 12 |
| LNU695 | 71302.4 | 0.0 | 0.15 | 28 | 1.8 | 0.24 | 24 | 0.8 | 0.24 | 13 |
| LNU687 | 71472.4 | 0.0 | 0.27 | 20 | — | — | — | — | — | — |
| LNU687 | 71476.3 | 0.1 | L | 65 | 2.6 | L | 85 | 0.8 | 0.09 | 17 |
| LNU674 | 71427.1 | 0.0 | 0.27 | 20 | 1.8 | 0.24 | 24 | 0.8 | 0.26 | 14 |
| LNU674 | 71428.2 | — | — | — | 1.9 | 0.11 | 34 | 0.8 | 0.11 | 16 |
| LNU672 | 71420.3 | 0.0 | 0.07 | 33 | 2.0 | 0.04 | 38 | — | — | — |
| LNU672 | 71421.4 | — | — | — | — | — | — | 0.9 | L | 26 |
| LNU672 | 71421.6 | 0.0 | 0.24 | 20 | — | — | — | — | — | — |
| LNU652 | 71376.6 | 0.0 | 0.17 | 27 | 1.7 | 0.26 | 22 | — | — | — |
| LNU652 | 71378.1 | 0.0 | 0.10 | 28 | 1.7 | 0.24 | 21 | 0.8 | 0.28 | 11 |
| LNU652 | 71378.3 | 0.0 | 0.14 | 25 | — | — | — | — | — | — |
| LNU652 | 71380.1 | 0.0 | 0.15 | 24 | 1.7 | 0.24 | 22 | — | — | — |
| LNU652 | 71381.1 | — | — | — | — | — | — | 0.8 | 0.20 | 14 |
| LNU624 | 71364.2 | 0.0 | 0.12 | 27 | 1.7 | 0.27 | 21 | — | — | — |
| CONT. | — | 0.0 | — | — | 1.4 | — | — | 0.7 | — | — |
| LNU741 | 71248.4 | 0.1 | L | 45 | 1.7 | L | 135 | 0.6 | L | 39 |
| LNU741 | 71249.3 | — | — | — | 0.8 | 0.20 | 20 | 0.5 | 0.18 | 15 |
| LNU741 | 71249.5 | — | — | — | 1.0 | 0.08 | 38 | — | — | — |
| LNU740 | 71240.2 | — | — | — | — | — | — | 0.5 | 0.29 | 12 |
| LNU740 | 71242.4 | — | — | — | 1.3 | L | 84 | 0.6 | 0.05 | 22 |
| LNU732 | 71222.4 | 0.0 | 0.10 | 16 | 1.6 | L | 120 | 0.5 | 0.14 | 19 |
| LNU732 | 71224.5 | — | — | — | 0.9 | 0.06 | 34 | — | — | — |

TABLE 70-continued

Genes showing improved plant growth rate at nitrogen deficient conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU728 | 71210.2 | — | — | — | 0.8 | 0.29 | 16 | — | — | — |
| LNU728 | 71214.3 | — | — | — | 1.3 | 0.02 | 86 | 0.5 | 0.27 | 17 |
| LNU726 | 71203.5 | — | — | — | 0.9 | 0.10 | 28 | — | — | — |
| LNU726 | 71204.4 | — | — | — | — | — | — | 0.5 | 0.29 | 11 |
| LNU726 | 71205.2 | — | — | — | 0.9 | 0.06 | 29 | 0.6 | 0.03 | 25 |
| LNU725 | 71198.4 | — | — | — | 0.8 | 0.29 | 18 | 0.6 | 0.03 | 25 |
| LNU725 | 71199.1 | — | — | — | 1.0 | L | 47 | 0.6 | 0.02 | 29 |
| LNU725 | 71201.5 | — | — | — | 1.0 | L | 44 | — | — | — |
| LNU714 | 71181.2 | 0.0 | 0.06 | 27 | 1.5 | L | 106 | 0.6 | 0.05 | 22 |
| LNU714 | 71181.3 | — | — | — | 0.9 | 0.07 | 30 | 0.6 | 0.09 | 20 |
| LNU714 | 71182.1 | — | — | — | 0.9 | 0.17 | 22 | — | — | — |
| LNU712 | 71144.2 | — | — | — | 1.4 | L | 99 | 0.5 | 0.15 | 19 |
| LNU712 | 71144.3 | — | — | — | 1.0 | 0.02 | 42 | — | — | — |
| LNU712 | 71147.4 | 0.0 | 0.06 | 20 | 1.5 | L | 115 | 0.6 | 0.08 | 21 |
| LNU711 | 71139.2 | — | — | — | — | — | — | 0.6 | 0.07 | 20 |
| CONT. | — | 0.0 | — | — | 0.7 | — | — | 0.5 | — | — |
| LNU709 | 71498.3 | 0.0 | 0.23 | 20 | 1.5 | 0.11 | 30 | — | — | — |
| LNU709 | 71501.3 | — | — | — | 1.5 | 0.24 | 27 | — | — | — |
| LNU693 | 71547.5 | — | — | — | 1.4 | 0.28 | 19 | 0.9 | 0.02 | 20 |
| LNU676 | 71095.2 | — | — | — | 1.5 | 0.10 | 28 | — | — | — |
| LNU676 | 71095.3 | — | — | — | 1.4 | 0.30 | 20 | — | — | — |
| LNU676 | 71095.4 | — | — | — | — | — | — | 0.8 | 0.28 | 9 |
| LNU676 | 71096.4 | — | — | — | — | — | — | 0.8 | 0.24 | 10 |
| LNU671 | 71094.1 | — | — | — | — | — | — | 0.8 | 0.27 | 9 |
| LNU659 | 71853.2 | — | — | — | 1.5 | 0.18 | 24 | — | — | — |
| LNU659 | 71855.5 | — | — | — | 1.6 | 0.10 | 32 | — | — | — |
| LNU654 | 71556.1 | 0.0 | 0.15 | 25 | — | — | — | 0.8 | 0.25 | 10 |
| LNU654 | 71561.4 | 0.0 | 0.12 | 25 | 1.6 | 0.06 | 36 | 0.9 | 0.05 | 16 |
| LNU607 | 71595.1 | — | — | — | 1.7 | 0.07 | 41 | — | — | — |
| LNU603 | 71612.3 | 0.0 | 0.19 | 20 | 1.6 | 0.07 | 32 | 0.9 | 0.07 | 14 |
| LNU521 | 71598.4 | — | — | — | 1.4 | 0.27 | 19 | 0.8 | 0.12 | 12 |
| CONT. | — | 0.0 | — | — | 1.2 | — | — | 0.8 | — | — |
| LNU742 | 71552.2 | 0.0 | 0.01 | 27 | 1.9 | L | 51 | 0.9 | L | 21 |
| LNU742 | 71552.4 | 0.0 | 0.07 | 20 | 1.8 | L | 41 | — | — | — |
| LNU742 | 71554.2 | 0.0 | 0.05 | 23 | 1.8 | L | 42 | — | — | — |
| LNU742 | 71555.2 | — | — | — | 1.5 | 0.10 | 22 | 0.8 | 0.05 | 16 |
| LNU734 | 71646.5 | 0.1 | L | 39 | 2.4 | L | 87 | 0.8 | 0.07 | 16 |
| LNU734 | 71648.2 | 0.0 | 0.07 | 22 | — | — | — | — | — | — |
| LNU734 | 71648.3 | 0.1 | L | 50 | 2.5 | L | 97 | 0.8 | 0.05 | 17 |
| LNU734 | 71648.5 | — | — | — | 1.8 | 0.01 | 46 | 0.8 | 0.30 | 9 |
| LNU734 | 71649.1 | 0.1 | L | 61 | 2.2 | L | 71 | 0.9 | 0.02 | 22 |
| LNU715 | 71642.2 | 0.1 | L | 31 | 2.2 | L | 75 | 0.9 | 0.02 | 22 |
| LNU715 | 71643.1 | 0.1 | L | 32 | 2.2 | L | 74 | 0.8 | 0.14 | 11 |
| LNU715 | 71643.2 | 0.1 | L | 42 | 2.2 | L | 75 | 0.8 | 0.08 | 14 |
| LNU715 | 71643.3 | 0.1 | L | 45 | 2.0 | L | 56 | — | — | — |
| LNU715 | 71645.3 | 0.1 | L | 46 | 2.3 | L | 81 | 0.9 | L | 25 |
| LNU567 | 70995.1 | 0.1 | 0.06 | 33 | 1.7 | 0.02 | 34 | — | — | — |
| LNU567 | 70995.2 | 0.1 | L | 40 | 2.1 | L | 65 | 0.9 | L | 23 |
| LNU567 | 70995.4 | — | — | — | 1.6 | 0.02 | 26 | — | — | — |
| LNU567 | 70998.1 | 0.0 | 0.20 | 13 | — | — | — | — | — | — |
| LNU567 | 70998.3 | 0.0 | 0.02 | 29 | 2.1 | L | 65 | — | — | — |
| LNU567 | 70998.4 | 0.1 | L | 36 | 1.9 | L | 48 | — | — | — |
| CONT. | — | 0.0 | — | — | 1.3 | — | — | 0.7 | — | — |
| LNU722 | 71189.5 | — | — | — | — | — | — | 0.8 | 0.11 | 12 |
| LNU706 | 71340.4 | — | — | — | 1.4 | 0.10 | 32 | 0.9 | 0.03 | 18 |
| LNU706 | 71342.1 | 0.0 | 0.12 | 24 | — | — | — | — | — | — |
| LNU706 | 71343.2 | 0.0 | 0.04 | 34 | 1.6 | 0.01 | 49 | 0.8 | 0.11 | 11 |
| LNU702 | 71860.2 | — | — | — | 1.4 | 0.13 | 31 | — | — | — |
| LNU693 | 71547.3 | — | — | — | 1.8 | L | 67 | — | — | — |
| LNU693 | 71548.6 | 0.0 | L | 38 | 1.8 | L | 74 | 0.9 | L | 23 |
| LNU668 | 71415.5 | — | — | — | 1.6 | L | 55 | — | — | — |
| LNU668 | 71416.3 | — | — | — | 1.5 | 0.04 | 40 | — | — | — |
| LNU545 | 72596.1 | — | — | — | 1.5 | 0.06 | 41 | — | — | — |
| LNU545 | 72597.1 | 0.0 | 0.08 | 29 | 1.6 | 0.01 | 51 | — | — | — |
| CONT. | — | 0.0 | — | — | 1.1 | — | — | 0.7 | — | — |
| LNU696 | 70600.3 | — | — | — | — | — | — | 0.6 | 0.14 | 16 |
| LNU696 | 70601.2 | — | — | — | 1.5 | 0.20 | 24 | — | — | — |
| LNU696 | 70601.3 | 0.1 | 0.02 | 29 | 1.8 | 0.03 | 41 | 0.6 | 0.10 | 21 |
| LNU686 | 70689.2 | 0.1 | 0.21 | 12 | — | — | — | 0.6 | 0.27 | 12 |
| LNU686 | 70689.5 | 0.1 | 0.01 | 22 | 1.8 | 0.03 | 41 | — | — | — |
| LNU627 | 70490.2 | 0.1 | 0.14 | 15 | — | — | — | 0.6 | 0.16 | 16 |

TABLE 70-continued

Genes showing improved plant growth rate at nitrogen deficient conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU627 | 70491.5 | — | — | — | 1.5 | 0.18 | 20 | — | — | — |
| LNU616 | 70503.2 | — | — | — | 1.5 | 0.26 | 17 | — | — | — |
| LNU616 | 70504.4 | — | — | — | 1.7 | 0.03 | 36 | 0.6 | 0.11 | 20 |
| LNU616 | 70505.2 | 0.1 | 0.07 | 18 | — | — | — | — | — | — |
| LNU616 | 70505.3 | 0.1 | 0.04 | 23 | — | — | — | 0.6 | 0.23 | 13 |
| LNU595 | 70274.1 | — | — | — | — | — | — | 0.6 | 0.13 | 16 |
| LNU595 | 70274.3 | 0.1 | 0.05 | 17 | 1.6 | 0.07 | 26 | — | — | — |
| LNU595 | 70278.1 | 0.0 | 0.21 | 11 | — | — | — | 0.6 | 0.09 | 18 |
| LNU565 | 70623.5 | — | — | — | — | — | — | 0.6 | 0.12 | 18 |
| LNU565 | 70624.3 | — | — | — | 1.5 | 0.20 | 20 | 0.6 | 0.16 | 16 |
| LNU565 | 70624.5 | 0.1 | 0.11 | 13 | 2.2 | L | 79 | 0.6 | 0.17 | 15 |
| LNU565 | 70626.1 | — | — | — | 1.5 | 0.11 | 24 | — | — | — |
| LNU542 | 70226.2 | 0.1 | L | 22 | 1.8 | L | 48 | — | — | — |
| LNU542 | 70229.3 | — | — | — | 1.6 | 0.05 | 30 | 0.6 | 0.12 | 17 |
| LNU539 | 70220.1 | 0.0 | 0.22 | 12 | — | — | — | 0.6 | 0.22 | 13 |
| LNU539 | 70221.2 | 0.1 | 0.06 | 18 | — | — | — | — | — | — |
| LNU539 | 70225.2 | — | — | — | — | — | — | 0.6 | 0.07 | 19 |
| LNU539 | 70225.3 | 0.1 | 0.03 | 21 | — | — | — | — | — | — |
| LNU537 | 70215.4 | 0.1 | 0.23 | 12 | 1.5 | 0.27 | 20 | — | — | — |
| LNU537 | 70217.2 | — | — | — | 1.5 | 0.19 | 20 | — | — | — |
| LNU537 | 70218.2 | — | — | — | — | — | — | 0.6 | 0.17 | 15 |
| CONT. | — | 0.0 | — | — | 1.2 | — | — | 0.5 | — | — |
| LNU688 | 72692.3 | 0.0 | 0.10 | 23 | 2.1 | 0.19 | 25 | 0.9 | 0.06 | 14 |
| LNU688 | 72694.3 | — | — | — | 2.1 | 0.11 | 29 | — | — | — |
| LNU657 | 70336.1 | 0.0 | 0.26 | 15 | — | — | — | — | — | — |
| LNU645 | 73005.4 | — | — | — | — | — | — | 0.9 | L | 18 |
| LNU645 | 73006.1 | 0.0 | 0.21 | 19 | — | — | — | — | — | — |
| LNU608 | 72997.2 | — | — | — | — | — | — | 0.9 | 0.03 | 14 |
| LNU608 | 72997.3 | 0.0 | 0.13 | 18 | — | — | — | — | — | — |
| LNU608 | 72997.4 | 0.0 | 0.18 | 17 | 2.0 | 0.19 | 24 | — | — | — |
| LNU608 | 73000.1 | — | — | — | 2.1 | 0.15 | 25 | — | — | — |
| LNU588 | 72995.4 | — | — | — | — | — | — | 0.8 | 0.21 | 8 |
| LNU554 | 70478.2 | 0.0 | 0.10 | 22 | 2.0 | 0.21 | 23 | 0.8 | 0.09 | 12 |
| LNU554 | 70479.1 | 0.1 | L | 51 | 2.4 | 0.05 | 48 | — | — | — |
| LNU554 | 70483.2 | — | — | — | — | — | — | 0.8 | 0.20 | 8 |
| LNU545 | 72598.1 | 0.0 | 0.06 | 25 | — | — | — | — | — | — |
| CONT. | — | 0.0 | — | — | 1.6 | — | — | 0.8 | — | — |
| LNU748 | 72945.1 | 0.0 | 0.22 | 34 | 2.0 | 0.10 | 47 | 0.8 | 0.17 | 13 |
| LNU748 | 72947.2 | 0.0 | 0.29 | 24 | — | — | — | — | — | — |
| LNU748 | 72947.3 | — | — | — | 1.9 | 0.10 | 46 | — | — | — |
| LNU747 | 70619.1 | 0.0 | 0.20 | 39 | — | — | — | — | — | — |
| LNU747 | 70619.4 | — | — | — | 1.8 | 0.15 | 36 | — | — | — |
| LNU746 | 72964.3 | 0.0 | 0.15 | 33 | 1.8 | 0.12 | 38 | 0.8 | 0.11 | 14 |
| LNU746 | 72966.2 | — | — | — | 1.8 | 0.24 | 38 | — | — | — |
| LNU746 | 72966.3 | — | — | — | — | — | — | 0.9 | 0.15 | 14 |
| LNU688 | 72692.3 | 0.0 | 0.07 | 45 | 2.2 | 0.02 | 67 | — | — | — |
| LNU688 | 72694.3 | 0.0 | 0.02 | 53 | 2.3 | L | 74 | — | — | — |
| LNU636_H1 | 72939.3 | 0.0 | 0.08 | 41 | 2.2 | 0.01 | 64 | — | — | — |
| LNU636_H1 | 72942.1 | — | — | — | 1.7 | 0.25 | 30 | — | — | — |
| LNU636_H1 | 72942.2 | 0.0 | 0.17 | 33 | 1.8 | 0.17 | 36 | — | — | — |
| LNU608 | 72997.2 | — | — | — | 1.8 | 0.17 | 34 | 0.8 | 0.11 | 14 |
| LNU608 | 72997.4 | 0.0 | 0.08 | 41 | 2.0 | 0.06 | 51 | 0.8 | 0.27 | 10 |
| LNU585 | 72914.2 | — | — | — | — | — | — | 0.8 | 0.26 | 12 |
| LNU585 | 72915.1 | 0.0 | 0.02 | 54 | 2.1 | 0.02 | 59 | — | — | — |
| LNU585 | 72917.3 | 0.0 | 0.04 | 53 | 1.7 | 0.23 | 31 | — | — | — |
| CONT. | — | 0.0 | — | — | 1.3 | — | — | 0.7 | — | — |
| LNU639 | 70869.2 | — | — | — | 1.3 | L | 48 | — | — | — |
| LNU635 | 70784.3 | 0.1 | 0.16 | 16 | 1.7 | L | 92 | 0.6 | L | 34 |
| LNU635 | 70784.4 | — | — | — | 1.2 | 0.08 | 36 | — | — | — |
| LNU580 | 70853.2 | — | — | — | 1.0 | 0.26 | 16 | 0.5 | 0.19 | 16 |
| LNU549 | 70723.2 | — | — | — | 1.4 | L | 66 | 0.5 | 0.13 | 19 |
| LNU524 | 70809.1 | — | — | — | 1.3 | 0.01 | 48 | — | — | — |
| LNU524 | 70809.2 | — | — | — | 1.1 | 0.07 | 29 | — | — | — |
| CONT. | — | 0.0 | — | — | 0.9 | — | — | 0.5 | — | — |
| LNU729 | 71519.4 | 0.0 | 0.27 | 10 | — | — | — | — | — | — |
| LNU719 | 71542.3 | 0.0 | 0.20 | 12 | 1.9 | L | 42 | — | — | — |
| LNU719 | 71543.8 | 0.0 | 0.14 | 16 | — | — | — | 0.7 | 0.22 | 13 |
| LNU709 | 71498.4 | — | — | — | 1.6 | 0.12 | 24 | — | — | — |
| LNU709 | 71501.3 | 0.1 | L | 23 | 1.8 | 0.01 | 39 | 0.7 | 0.21 | 13 |
| LNU709 | 71501.4 | — | — | — | — | — | — | 0.7 | 0.09 | 15 |
| LNU693 | 71547.5 | — | — | — | — | — | — | 0.7 | 0.07 | 18 |

TABLE 70-continued

Genes showing improved plant growth rate at nitrogen deficient conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU693 | 71548.6 | — | — | — | 1.9 | 0.01 | 48 | 0.7 | 0.20 | 16 |
| LNU654 | 71557.3 | — | — | — | — | — | — | 0.7 | 0.23 | 12 |
| LNU654 | 71561.4 | 0.0 | 0.20 | 12 | — | — | — | — | — | — |
| LNU607 | 71592.5 | 0.0 | 0.16 | 13 | 1.8 | L | 40 | — | — | — |
| LNU607 | 71595.1 | 0.0 | 0.11 | 21 | 1.9 | 0.03 | 47 | — | — | — |
| LNU607 | 71595.3 | 0.0 | 0.16 | 14 | 1.8 | 0.02 | 37 | 0.7 | 0.18 | 14 |
| LNU603 | 71610.5 | 0.0 | 0.30 | 9 | 2.0 | L | 53 | — | — | — |
| LNU603 | 71612.3 | — | — | — | — | — | — | 0.7 | 0.18 | 13 |
| LNU603 | 71613.6 | — | — | — | 1.6 | 0.13 | 21 | — | — | — |
| LNU521 | 71598.3 | — | — | — | 1.6 | 0.17 | 20 | — | — | — |
| LNU521 | 71598.4 | 0.1 | 0.01 | 31 | 1.8 | 0.03 | 37 | — | — | — |
| LNU521 | 71601.3 | 0.0 | 0.15 | 15 | 1.7 | 0.11 | 30 | — | — | — |
| LNU521 | 71601.5 | 0.0 | 0.07 | 19 | — | — | — | 0.7 | 0.16 | 15 |
| CONT. | — | 0.0 | — | — | 1.3 | — | — | 0.6 | — | — |
| LNU708 | 71797.2 | — | — | — | 1.4 | 0.01 | 49 | — | — | — |
| LNU708 | 71797.3 | — | — | — | 1.3 | 0.04 | 43 | 0.7 | 0.21 | 13 |
| LNU708 | 71798.4 | 0.0 | 0.21 | 18 | 1.5 | L | 63 | 0.7 | 0.05 | 14 |
| LNU649 | 71059.1 | — | — | — | 1.2 | 0.04 | 36 | — | — | — |
| LNU649 | 71063.1 | 0.0 | 0.08 | 31 | 1.4 | 0.03 | 52 | — | — | — |
| LNU649 | 71064.1 | — | — | — | 1.2 | 0.23 | 26 | — | — | — |
| LNU648 | 71023.3 | — | — | — | 1.1 | 0.15 | 22 | 0.7 | 0.03 | 14 |
| LNU648 | 71024.1 | 0.0 | 0.25 | 16 | 1.3 | 0.02 | 46 | 0.7 | 0.19 | 11 |
| LNU648 | 71026.1 | — | — | — | 1.2 | 0.12 | 33 | — | — | — |
| LNU634 | 71013.4 | — | — | — | 1.2 | 0.23 | 26 | — | — | — |
| LNU634 | 71014.4 | — | — | — | 1.3 | 0.04 | 39 | 0.7 | 0.08 | 13 |
| LNU634 | 71016.3 | — | — | — | 1.4 | L | 55 | 0.7 | 0.05 | 16 |
| LNU622 | 70999.3 | 0.0 | 0.18 | 19 | 1.4 | L | 50 | 0.7 | 0.10 | 12 |
| LNU622 | 71004.2 | 0.0 | 0.18 | 19 | 1.7 | L | 86 | 0.7 | 0.06 | 13 |
| LNU591 | 71283.1 | 0.0 | 0.29 | 16 | 1.3 | 0.05 | 40 | — | — | — |
| LNU591 | 71283.3 | — | — | — | 1.2 | 0.06 | 32 | — | — | — |
| LNU591 | 71286.1 | — | — | — | 1.4 | 0.04 | 48 | 0.8 | 0.06 | 20 |
| LNU581 | 71305.2 | 0.0 | 0.16 | 20 | 1.5 | L | 68 | 0.8 | L | 27 |
| LNU581 | 71305.7 | 0.0 | 0.12 | 23 | 1.4 | 0.02 | 52 | 0.7 | 0.12 | 16 |
| LNU581 | 71306.1 | — | — | — | 1.3 | 0.05 | 44 | — | — | — |
| LNU574 | 71790.4 | 0.0 | 0.09 | 26 | 1.8 | L | 98 | 0.8 | L | 22 |
| LNU574 | 71791.2 | 0.0 | 0.20 | 19 | 1.6 | L | 76 | 0.7 | 0.05 | 14 |
| CONT. | — | 0.0 | — | — | 0.9 | — | — | 0.6 | — | — |
| LNU676 | 71097.4 | — | — | — | 1.9 | 0.11 | 17 | — | — | — |
| LNU649 | 71062.1 | 0.1 | 0.03 | 22 | — | — | — | — | — | — |
| LNU649 | 71062.2 | 0.1 | 0.28 | 9 | — | — | — | — | — | — |
| LNU649 | 71064.2 | 0.1 | 0.23 | 10 | 2.2 | L | 33 | — | — | — |
| LNU648 | 71023.3 | 0.1 | 0.03 | 19 | 2.1 | 0.02 | 25 | 0.8 | 0.18 | 11 |
| LNU634 | 71013.4 | 0.1 | 0.03 | 20 | 1.8 | 0.29 | 10 | — | — | — |
| LNU622 | 70999.1 | 0.1 | 0.05 | 19 | 1.9 | 0.11 | 15 | — | — | — |
| LNU622 | 71003.4 | 0.1 | 0.11 | 16 | 2.0 | 0.02 | 22 | — | — | — |
| LNU581 | 71305.7 | — | — | — | 2.1 | 0.02 | 25 | — | — | — |
| LNU581 | 71306.1 | — | — | — | — | — | — | 0.8 | 0.24 | 10 |
| LNU567 | 70998.1 | 0.1 | 0.13 | 14 | — | — | — | 0.8 | 0.18 | 10 |
| LNU567 | 70998.3 | 0.1 | 0.17 | 12 | — | — | — | — | — | — |
| CONT. | — | 0.0 | — | — | 1.6 | — | — | 0.8 | — | — |
| LNU735 | 71873.2 | 0.0 | 0.03 | 26 | 2.1 | 0.10 | 23 | — | — | — |
| LNU713 | 71862.1 | 0.0 | 0.06 | 22 | 2.3 | 0.03 | 34 | — | — | — |
| LNU689 | 71778.3 | — | — | — | 2.2 | 0.11 | 27 | — | — | — |
| LNU689 | 71779.6 | 0.0 | 0.25 | 15 | — | — | — | — | — | — |
| LNU689 | 71783.3 | 0.1 | 0.07 | 27 | — | — | — | — | — | — |
| LNU688 | 72692.3 | — | — | — | 2.3 | 0.05 | 37 | — | — | — |
| LNU669 | 70391.1 | 0.0 | 0.29 | 12 | — | — | — | 0.9 | 0.28 | 4 |
| LNU669 | 70393.1 | — | — | — | 2.2 | 0.13 | 26 | — | — | — |
| LNU669 | 70393.2 | 0.0 | 0.12 | 20 | — | — | — | — | — | — |
| LNU669 | 70393.3 | 0.0 | 0.19 | 20 | — | — | — | — | — | — |
| LNU611 | 72698.2 | — | — | — | 2.2 | 0.11 | 25 | 0.9 | 0.21 | 5 |
| LNU611 | 72702.4 | — | — | — | — | — | — | 0.9 | 0.19 | 5 |
| LNU546 | 72584.3 | 0.0 | 0.24 | 13 | 2.3 | 0.01 | 37 | — | — | — |
| LNU546 | 72586.1 | 0.0 | 0.16 | 19 | 2.3 | 0.06 | 36 | — | — | — |
| CONT. | — | 0.0 | — | — | 1.7 | — | — | 0.8 | — | — |
| LNU710 | 70712.5 | 0.0 | 0.27 | 18 | 1.8 | L | 53 | — | — | — |
| LNU710 | 70712.6 | — | — | — | 1.8 | L | 53 | — | — | — |
| LNU710 | 70715.2 | 0.0 | 0.16 | 21 | 2.1 | L | 74 | 0.9 | 0.07 | 17 |
| LNU705 | 70604.2 | — | — | — | 1.6 | 0.03 | 36 | — | — | — |
| LNU705 | 70604.4 | — | — | — | 1.7 | 0.01 | 40 | — | — | — |
| LNU705 | 70606.2 | 0.1 | 0.04 | 35 | 2.1 | L | 81 | — | — | — |

TABLE 70-continued

Genes showing improved plant growth rate at nitrogen deficient conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU705 | 70607.3 | 0.1 | 0.09 | 25 | 1.7 | 0.01 | 45 | 0.9 | 0.07 | 17 |
| LNU639 | 70871.3 | — | — | — | 1.5 | 0.07 | 28 | — | — | — |
| LNU639 | 70871.4 | — | — | — | — | — | — | 0.8 | 0.23 | 11 |
| LNU639 | 70873.2 | 0.0 | 0.27 | 18 | 1.7 | 0.03 | 41 | — | — | — |
| LNU635 | 70784.4 | 0.0 | 0.27 | 16 | 1.9 | L | 57 | — | — | — |
| LNU635 | 70786.4 | 0.1 | 0.01 | 38 | 2.2 | L | 85 | 0.9 | 0.06 | 19 |
| LNU635 | 70787.3 | 0.0 | 0.23 | 16 | 1.8 | L | 55 | — | — | — |
| LNU580 | 70851.2 | — | — | — | 1.4 | 0.21 | 21 | — | — | — |
| LNU580 | 70853.2 | 0.0 | 0.29 | 16 | — | — | — | — | — | — |
| LNU580 | 70855.3 | 0.0 | 0.22 | 17 | 1.7 | 0.02 | 42 | 0.8 | 0.24 | 10 |
| LNU580 | 70855.4 | — | — | — | 1.6 | 0.03 | 38 | — | — | — |
| LNU549 | 70723.2 | 0.1 | 0.10 | 24 | 1.7 | 0.01 | 48 | 0.8 | 0.20 | 12 |
| LNU543 | 70826.1 | — | — | — | 1.5 | 0.09 | 26 | — | — | — |
| LNU543 | 70826.3 | 0.0 | 0.18 | 19 | 1.6 | 0.02 | 37 | 0.8 | 0.18 | 12 |
| LNU543 | 70828.1 | — | — | — | 1.5 | 0.08 | 29 | — | — | — |
| LNU543 | 70828.4 | — | — | — | 1.7 | L | 44 | — | — | — |
| LNU524 | 70808.1 | — | — | — | 1.6 | 0.02 | 38 | — | — | — |
| LNU524 | 70809.2 | 0.0 | 0.22 | 19 | 1.7 | 0.02 | 45 | 0.8 | 0.19 | 12 |
| CONT. | — | 0.0 | — | — | 1.2 | — | — | 0.7 | — | — |
| LNU748 | 72945.1 | 0.0 | 0.27 | 14 | 2.2 | 0.01 | 42 | 0.8 | 0.26 | 10 |
| LNU748 | 72945.2 | 0.0 | 0.07 | 24 | 2.3 | L | 49 | — | — | — |
| LNU748 | 72947.2 | — | — | — | — | — | — | 0.8 | 0.26 | 8 |
| LNU748 | 72947.3 | 0.0 | 0.09 | 24 | 2.3 | L | 46 | — | — | — |
| LNU748 | 72948.5 | — | — | — | 1.9 | 0.17 | 21 | 0.9 | 0.05 | 16 |
| LNU746 | 72962.2 | 0.1 | L | 34 | 2.3 | L | 50 | 0.8 | 0.13 | 12 |
| LNU746 | 72966.3 | 0.0 | 0.27 | 13 | 2.0 | 0.07 | 29 | — | — | — |
| LNU745 | 70911.1 | — | — | — | 2.0 | 0.06 | 31 | — | — | — |
| LNU745 | 70911.4 | — | — | — | 2.3 | L | 47 | — | — | — |
| LNU745 | 70914.2 | — | — | — | 2.0 | 0.13 | 27 | — | — | — |
| LNU745 | 70914.4 | — | — | — | 2.6 | L | 69 | 0.9 | 0.01 | 18 |
| LNU739 | 71630.1 | 0.0 | 0.24 | 16 | 2.5 | L | 63 | 0.8 | 0.16 | 11 |
| LNU739 | 71631.3 | — | — | — | 1.8 | 0.29 | 20 | — | — | — |
| LNU636_H1 | 72937.3 | 0.0 | 0.05 | 24 | 1.9 | 0.10 | 25 | 0.9 | 0.06 | 16 |
| LNU636_H1 | 72940.1 | — | — | — | 2.2 | 0.06 | 40 | — | — | — |
| LNU636_H1 | 72942.2 | — | — | — | 2.2 | 0.01 | 42 | 0.9 | 0.06 | 14 |
| LNU590 | 70264.2 | 0.0 | 0.20 | 24 | 2.2 | 0.06 | 42 | — | — | — |
| LNU590 | 70267.4 | 0.0 | 0.26 | 13 | — | — | — | — | — | — |
| LNU590 | 70267.5 | 0.0 | 0.21 | 17 | — | — | — | 0.8 | 0.25 | 10 |
| LNU585 | 72913.3 | — | — | — | 1.9 | 0.21 | 22 | 0.8 | 0.09 | 13 |
| LNU585 | 72915.1 | 0.0 | 0.05 | 26 | 2.6 | L | 66 | 0.8 | 0.28 | 9 |
| LNU585 | 72917.3 | — | — | — | 1.8 | 0.26 | 17 | 0.8 | 0.16 | 12 |
| LNU556 | 72363.2 | — | — | — | 2.1 | 0.12 | 34 | — | — | — |
| LNU556 | 72364.2 | — | — | — | 2.3 | 0.03 | 47 | 0.8 | 0.21 | 10 |
| LNU545 | 72595.2 | 0.0 | 0.12 | 20 | 2.3 | L | 50 | 0.8 | 0.20 | 9 |
| LNU545 | 72598.1 | — | — | — | 1.8 | 0.21 | 19 | — | — | — |
| LNU545 | 72599.4 | — | — | — | — | — | — | 0.9 | 0.01 | 18 |
| CONT. | — | 0.0 | — | — | 1.5 | — | — | 0.7 | — | — |
| LNU696 | 70601.2 | 0.0 | 0.04 | 21 | 1.4 | L | 55 | 0.6 | 0.06 | 14 |
| LNU686 | 70689.4 | — | — | — | 1.0 | 0.26 | 16 | — | — | — |
| LNU686 | 70690.1 | 0.0 | 0.28 | 14 | 1.1 | 0.20 | 23 | — | — | — |
| LNU627 | 70491.5 | 0.0 | 0.21 | 13 | 1.1 | 0.10 | 28 | — | — | — |
| LNU627 | 70493.5 | — | — | — | 1.1 | 0.13 | 27 | — | — | — |
| LNU616 | 70503.4 | 0.0 | 0.20 | 12 | — | — | — | — | — | — |
| LNU595 | 70274.3 | 0.0 | 0.27 | 10 | — | — | — | — | — | — |
| LNU595 | 70276.1 | 0.0 | 0.07 | 20 | 1.5 | L | 67 | 0.6 | 0.14 | 12 |
| LNU565 | 70624.5 | — | — | — | 1.1 | 0.08 | 27 | — | — | — |
| LNU539 | 70225.2 | — | — | — | 1.2 | 0.11 | 29 | — | — | — |
| LNU539 | 70225.3 | — | — | — | 1.2 | 0.06 | 30 | — | — | — |
| LNU537 | 70215.4 | — | — | — | 1.4 | L | 56 | — | — | — |
| LNU537 | 70217.2 | — | — | — | 1.5 | L | 64 | — | — | — |
| LNU537 | 70217.4 | 0.0 | 0.10 | 17 | 1.5 | L | 62 | 0.6 | 0.26 | 8 |
| LNU537 | 70218.2 | — | — | — | 1.1 | 0.22 | 19 | — | — | — |
| CONT. | — | 0.0 | — | — | 0.9 | — | — | 0.6 | — | — |
| LNU742 | 71552.1 | 0.0 | 0.19 | 23 | 2.1 | 0.04 | 31 | — | — | — |
| LNU734 | 71646.5 | 0.1 | 0.03 | 38 | 2.2 | 0.01 | 37 | — | — | — |
| LNU734 | 71648.2 | 0.0 | 0.16 | 26 | — | — | — | — | — | — |
| LNU734 | 71649.1 | 0.1 | 0.04 | 35 | 2.2 | L | 37 | 0.9 | 0.07 | 12 |
| LNU729 | 71517.4 | 0.0 | 0.22 | 24 | 2.0 | 0.10 | 21 | — | — | — |
| LNU729 | 71517.6 | 0.1 | 0.10 | 29 | 2.0 | 0.08 | 26 | — | — | — |
| LNU729 | 71518.2 | 0.1 | 0.08 | 31 | 2.4 | L | 50 | — | — | — |
| LNU729 | 71519.4 | 0.0 | 0.26 | 19 | — | — | — | — | — | — |

TABLE 70-continued

Genes showing improved plant growth rate at nitrogen deficient conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU729 | 71519.6 | 0.1 | L | 44 | 2.9 | L | 77 | — | — | — |
| LNU719 | 71540.3 | 0.0 | 0.16 | 27 | — | — | — | — | — | — |
| LNU719 | 71542.3 | 0.1 | 0.06 | 34 | 2.1 | 0.08 | 31 | — | — | — |
| LNU719 | 71543.1 | 0.1 | 0.01 | 46 | 2.5 | L | 56 | — | — | — |
| LNU719 | 71543.8 | 0.1 | 0.07 | 33 | — | — | — | — | — | — |
| LNU708 | 71797.2 | 0.0 | 0.29 | 18 | — | — | — | — | — | — |
| LNU708 | 71798.3 | 0.0 | 0.17 | 25 | — | — | — | 0.9 | 0.12 | 9 |
| LNU708 | 71798.4 | 0.1 | 0.03 | 37 | 2.7 | L | 67 | — | — | — |
| LNU708 | 71800.1 | 0.1 | 0.11 | 32 | — | — | — | — | — | — |
| LNU708 | 71801.5 | 0.1 | 0.09 | 30 | 2.0 | 0.14 | 25 | — | — | — |
| LNU659 | 71850.2 | 0.0 | 0.18 | 24 | 1.9 | 0.22 | 19 | — | — | — |
| LNU659 | 71853.2 | — | — | — | — | — | — | 0.8 | 0.16 | 8 |
| LNU659 | 71855.4 | 0.0 | 0.17 | 23 | — | — | — | — | — | — |
| LNU574 | 71790.2 | — | — | — | 2.3 | 0.01 | 43 | — | — | — |
| LNU574 | 71790.4 | 0.0 | 0.29 | 18 | 1.9 | 0.24 | 16 | — | — | — |
| LNU574 | 71791.2 | 0.0 | 0.22 | 21 | — | — | — | 0.9 | 0.05 | 12 |
| LNU574 | 71791.4 | 0.0 | 0.14 | 26 | — | — | — | — | — | — |
| CONT. | — | 0.0 | — | — | 1.6 | — | — | 0.8 | — | — |
| LNU739 | 71630.1 | 0.0 | 0.02 | 25 | 2.1 | L | 134 | 0.8 | L | 41 |
| LNU739 | 71630.3 | 0.0 | 0.18 | 14 | 1.2 | L | 35 | 0.6 | 0.04 | 17 |
| LNU739 | 71630.4 | 0.0 | 0.10 | 17 | 1.2 | L | 37 | 0.6 | 0.03 | 15 |
| LNU739 | 71631.3 | — | — | — | 1.5 | L | 66 | 0.7 | L | 35 |
| LNU739 | 71633.5 | — | — | — | 1.4 | L | 59 | 0.7 | L | 31 |
| LNU715 | 71642.2 | 0.0 | 0.15 | 15 | 1.3 | L | 51 | 0.6 | 0.02 | 20 |
| LNU715 | 71643.1 | — | — | — | 1.5 | L | 76 | 0.7 | L | 31 |
| LNU715 | 71643.2 | 0.0 | 0.09 | 16 | 1.2 | 0.06 | 33 | 0.6 | 0.22 | 10 |
| LNU715 | 71643.3 | 0.0 | 0.08 | 20 | 1.3 | L | 48 | 0.6 | 0.03 | 20 |
| LNU715 | 71645.3 | 0.1 | L | 40 | 2.0 | L | 124 | 0.7 | L | 38 |
| LNU653 | 70658.3 | — | — | — | 1.2 | L | 36 | 0.6 | 0.02 | 18 |
| LNU653 | 70658.5 | — | — | — | 1.1 | 0.03 | 28 | 0.6 | 0.07 | 17 |
| LNU653 | 70659.4 | — | — | — | 1.4 | L | 57 | 0.6 | 0.10 | 15 |
| LNU638 | 72139.2 | — | — | — | 1.2 | 0.03 | 35 | 0.7 | 0.03 | 23 |
| LNU638 | 72142.1 | 0.0 | 0.01 | 26 | 2.1 | L | 140 | 0.8 | L | 40 |
| LNU638 | 72142.3 | 0.0 | 0.09 | 18 | 1.3 | 0.01 | 46 | — | — | — |
| LNU638 | 72143.3 | — | — | — | — | — | — | 0.6 | 0.21 | 11 |
| LNU638 | 72144.1 | 0.0 | L | 31 | 1.5 | L | 74 | 0.7 | L | 27 |
| LNU637 | 71664.2 | — | — | — | 1.6 | L | 86 | 0.7 | L | 30 |
| LNU637 | 71667.1 | — | — | — | 1.7 | L | 89 | 0.7 | L | 37 |
| LNU637 | 71669.5 | 0.0 | 0.07 | 19 | 1.9 | L | 113 | 0.7 | 0.01 | 22 |
| LNU637 | 71669.6 | — | — | — | 1.0 | 0.11 | 19 | 0.6 | 0.28 | 7 |
| LNU637 | 71669.7 | — | — | — | 1.0 | 0.23 | 14 | 0.6 | 0.07 | 15 |
| LNU618 | 72133.2 | 0.0 | 0.01 | 30 | 2.0 | L | 126 | 0.8 | L | 49 |
| LNU618 | 72135.1 | — | — | — | 1.1 | 0.06 | 24 | — | — | — |
| LNU618 | 72135.3 | 0.0 | 0.15 | 15 | 1.1 | 0.06 | 22 | 0.6 | 0.02 | 19 |
| LNU559 | 70832.4 | 0.0 | 0.19 | 17 | 1.6 | L | 76 | 0.7 | 0.05 | 22 |
| LNU559 | 70834.1 | 0.0 | 0.16 | 15 | 1.4 | L | 58 | 0.7 | L | 26 |
| LNU559 | 70835.1 | 0.0 | 0.04 | 22 | 1.7 | L | 89 | 0.7 | L | 34 |
| LNU559 | 70835.4 | — | — | — | 1.5 | L | 65 | 0.7 | L | 34 |
| LNU559 | 70837.2 | — | — | — | 1.6 | L | 87 | 0.8 | L | 40 |
| CONT. | — | 0.0 | — | — | 0.9 | — | — | 0.5 | — | — |
| LNU688 | 72692.3 | — | — | — | 2.0 | 0.05 | 25 | — | — | — |
| LNU688 | 72692.4 | — | — | — | — | — | — | 0.9 | 0.10 | 13 |
| LNU688 | 72694.4 | 0.1 | 0.24 | 12 | 2.4 | L | 46 | — | — | — |
| LNU661 | 72707.2 | — | — | — | 2.6 | L | 56 | — | — | — |
| LNU611 | 72698.2 | — | — | — | 2.2 | L | 32 | — | — | — |
| LNU611 | 72699.1 | — | — | — | 2.6 | L | 56 | — | — | — |
| LNU611 | 72699.2 | — | — | — | — | — | — | 0.9 | 0.29 | 7 |
| LNU573 | 72592.1 | 0.1 | 0.02 | 25 | 2.3 | L | 38 | — | — | — |
| LNU558 | 70467.3 | — | — | — | 2.0 | 0.09 | 21 | — | — | — |
| LNU531 | 70211.2 | — | — | — | — | — | — | 0.9 | L | 16 |
| LNU531 | 70212.1 | 0.1 | 0.23 | 13 | 2.1 | 0.03 | 27 | 0.9 | 0.15 | 8 |
| LNU531 | 70212.2 | — | — | — | 1.9 | 0.28 | 15 | 0.9 | 0.05 | 12 |
| LNU522 | 70803.3 | 0.1 | 0.02 | 24 | — | — | — | — | — | — |

TABLE 70-continued

Genes showing improved plant growth rate at nitrogen deficient conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU522 | 70805.2 | 0.1 | 0.04 | 24 | 2.1 | 0.03 | 26 | — | — | — |
| CONT. | | 0.0 | — | — | 1.6 | — | — | 0.8 | — | — |

Table 70:
"CONT."—Control;
"Ave."—Average;
"% Incr." = % increment;
"p-val."—p-value;
L means that p-value is less than 0.01, p < 0.1 was considered as significant.

TABLE 71

Genes showing improved plant growth rate at nitrogen deficient conditions (T1 generation)

| Gene Name | RGR Of Leaf Area | | | RGR Of Roots Coverage | | | RGR Of Root Length | | |
|---|---|---|---|---|---|---|---|---|---|
| | Ave. | P-Val. | % Incr. | Ave. | P-Val. | % Incr. | Ave. | P-Val. | % Incr. |
| LNU585 | — | — | — | — | — | — | 0.9 | 0.20 | 9 |
| CONT. | — | — | — | — | — | — | 0.8 | — | — |
| LNU748 | 0.0 | 0.26 | 15 | 1.6 | 0.29 | 27 | 0.8 | 0.09 | 26 |
| LNU611 | — | — | — | 1.8 | 0.06 | 44 | 0.8 | 0.22 | 17 |
| LNU545 | 0.0 | 0.28 | 15 | — | — | — | 0.8 | 0.14 | 22 |
| CONT. | 0.0 | — | — | 1.2 | — | — | 0.6 | — | — |

Table 71:
"CONT."—Control;
"Ave."—Average;
"% Incr." = % increment;
"p-val."—p-value;
L means that p-value is less than 0.01, p < 0.1 was considered as significant.

The genes listed in Tables 72-75 improved plant NUE when grown at standard nitrogen concentration levels. These genes produced larger plant biomass (plant fresh and dry weight; leaf area, root coverage and roots length) when grown under standard nitrogen growth conditions, compared to control plants that were grown under identical growth conditions in T2 (Tables 72-73) and T1 (Tables 74-75) generations. Larger plant biomass under these growth conditions indicates the high ability of the plant to better metabolize the nitrogen present in the medium. Plants producing larger root biomass have better possibilities to absorb larger amount of nitrogen from soil.

TABLE 72

Genes showing improved plant performance at standard nitrogen growth conditions (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LNU741 | 71248.4 | 6.2 | 0.26 | 37 | 107.9 | 0.26 | 33 |
| LNU741 | 71248.5 | 6.0 | 0.19 | 33 | — | — | — |
| LNU728 | 71209.5 | 6.1 | 0.07 | 37 | 112.3 | 0.11 | 38 |
| LNU725 | 71199.1 | — | — | — | 102.4 | 0.29 | 26 |
| LNU714 | 71183.3 | 6.3 | 0.06 | 40 | 118.0 | 0.06 | 45 |
| LNU712 | 71144.2 | 6.6 | 0.10 | 48 | 116.6 | 0.11 | 44 |
| LNU712 | 71147.1 | 5.5 | 0.28 | 22 | — | — | — |
| LNU712 | 71147.4 | 6.2 | 0.08 | 40 | 134.7 | 0.02 | 66 |
| CONT. | — | 4.5 | — | — | 81.1 | — | — |
| LNU638 | 72143.3 | 10.9 | L | 171 | 189.1 | L | 139 |
| LNU615 | 72285.1 | 8.2 | 0.01 | 106 | 147.8 | 0.01 | 86 |
| LNU615 | 72287.1 | 6.0 | 0.22 | 50 | 112.7 | 0.25 | 42 |
| LNU601 | 72131.3 | 5.8 | 0.23 | 44 | 108.0 | 0.22 | 36 |
| LNU601 | 72131.4 | 6.6 | 0.08 | 66 | 112.4 | 0.16 | 42 |
| LNU546 | 72587.3 | 5.6 | 0.30 | 40 | — | — | — |
| LNU533 | 71826.1 | 6.4 | 0.22 | 60 | 119.2 | 0.19 | 51 |
| CONT. | — | 4.0 | — | — | 79.2 | — | — |
| LNU735 | 71872.2 | — | — | — | 124.3 | 0.13 | 23 |
| LNU713 | 71862.1 | 6.5 | 0.07 | 20 | 126.2 | 0.06 | 25 |
| LNU689 | 71779.6 | 6.5 | 0.05 | 19 | 127.5 | 0.03 | 26 |
| LNU601 | 72131.3 | 6.2 | 0.19 | 15 | — | — | — |
| CONT. | — | 5.4 | — | — | 101.1 | — | — |
| LNU706 | 71342.1 | 6.7 | 0.05 | 39 | 134.6 | 0.07 | 44 |
| LNU695 | 71303.2 | — | — | — | 113.6 | 0.21 | 22 |
| LNU687 | 71474.1 | 7.7 | 0.15 | 61 | 145.3 | 0.19 | 56 |
| LNU687 | 71476.3 | 8.1 | 0.01 | 70 | 172.6 | L | 85 |
| LNU674 | 71427.5 | 6.7 | 0.08 | 40 | 130.4 | L | 40 |
| LNU674 | 71428.2 | 6.8 | 0.15 | 42 | 127.3 | 0.12 | 36 |

TABLE 72-continued

Genes showing improved plant performance at standard nitrogen growth conditions (T2 generation)

| Gene Name | Event # | Dry Weight [mg] Ave. | P-Val. | % Incr. | Fresh Weight [mg] Ave. | P-Val. | % Incr. |
|---|---|---|---|---|---|---|---|
| LNU674 | 71429.1 | — | — | — | 121.0 | 0.21 | 30 |
| LNU672 | 71420.3 | 6.6 | 0.26 | 38 | 135.2 | 0.04 | 45 |
| LNU672 | 71421.3 | — | — | — | 110.4 | 0.28 | 18 |
| LNU652 | 71380.1 | — | — | — | 110.4 | 0.15 | 18 |
| LNU632 | 71372.3 | — | — | — | 114.4 | 0.23 | 23 |
| LNU632 | 71372.4 | 6.3 | 0.08 | 31 | 124.2 | 0.09 | 33 |
| LNU624 | 71364.2 | 6.0 | 0.27 | 25 | 117.1 | 0.13 | 25 |
| CONT. | — | 4.8 | — | — | 93.4 | — | — |
| LNU706 | 71342.1 | 4.8 | 0.25 | 12 | — | — | — |
| LNU706 | 71343.1 | 5.4 | 0.16 | 28 | 100.6 | 0.16 | 33 |
| LNU706 | 71343.2 | 6.9 | 0.05 | 62 | — | — | — |
| LNU706 | 71344.5 | 5.2 | 0.27 | 22 | — | — | — |
| LNU703 | 71490.5 | 5.8 | L | 37 | 96.2 | 0.02 | 27 |
| LNU695 | 71299.2 | 4.7 | 0.28 | 10 | 98.6 | 0.07 | 31 |
| LNU695 | 71302.1 | 5.8 | 0.05 | 36 | 95.8 | 0.07 | 27 |
| LNU695 | 71302.3 | 5.5 | 0.08 | 29 | 95.0 | 0.20 | 26 |
| LNU695 | 71303.2 | 8.0 | 0.04 | 89 | 152.6 | 0.05 | 102 |
| LNU687 | 71472.4 | 4.8 | 0.28 | 12 | — | — | — |
| LNU687 | 71474.1 | 5.2 | 0.25 | 23 | — | — | — |
| LNU687 | 71474.3 | 5.7 | 0.06 | 35 | 101.6 | 0.15 | 35 |
| LNU687 | 71474.6 | 6.6 | L | 56 | 120.9 | L | 60 |
| LNU674 | 71425.1 | 5.6 | 0.03 | 33 | 102.3 | L | 35 |
| LNU674 | 71427.1 | 5.8 | 0.01 | 37 | 102.7 | 0.02 | 36 |
| LNU674 | 71428.2 | — | — | — | 118.0 | 0.17 | 56 |
| LNU672 | 71420.1 | 6.8 | L | 61 | 120.4 | L | 64 |
| LNU672 | 71420.3 | 8.3 | 0.07 | 95 | 138.1 | 0.08 | 83 |
| LNU672 | 71421.4 | 6.2 | 0.06 | 46 | 108.6 | 0.13 | 44 |
| LNU672 | 71421.6 | 5.1 | 0.20 | 20 | 94.5 | 0.08 | 25 |
| LNU652 | 71378.3 | 5.1 | 0.18 | 20 | 90.6 | 0.23 | 20 |
| LNU652 | 71380.1 | 9.8 | L | 131 | 194.1 | L | 157 |
| LNU632 | 71370.1 | 5.8 | 0.02 | 37 | 104.7 | 0.07 | 39 |
| LNU632 | 71372.6 | 7.0 | 0.21 | 66 | — | — | — |
| LNU624 | 71364.2 | 7.1 | 0.04 | 68 | 121.6 | 0.09 | 61 |
| LNU624 | 71365.1 | 5.5 | 0.27 | 30 | — | — | — |
| LNU624 | 71366.1 | — | — | — | 93.6 | 0.09 | 24 |
| LNU624 | 71367.1 | 5.6 | 0.03 | 33 | 105.1 | 0.05 | 39 |
| CONT. | — | 4.2 | — | — | 75.6 | — | — |
| LNU741 | 71248.4 | 5.3 | 0.29 | 23 | 111.7 | 0.03 | 35 |
| LNU741 | 71249.5 | 6.2 | 0.03 | 43 | 110.8 | 0.04 | 34 |
| LNU740 | 71242.4 | 7.5 | 0.02 | 71 | 136.5 | 0.02 | 65 |
| LNU732 | 71222.2 | 6.0 | 0.06 | 38 | 113.3 | 0.10 | 37 |
| LNU732 | 71222.4 | 6.6 | 0.22 | 52 | 143.6 | 0.17 | 73 |
| LNU732 | 71224.5 | 9.7 | L | 122 | 203.3 | L | 146 |
| LNU728 | 71209.3 | — | — | — | 110.1 | 0.03 | 33 |
| LNU728 | 71210.2 | 6.0 | 0.04 | 37 | 132.0 | L | 59 |
| LNU728 | 71214.3 | 7.9 | 0.25 | 81 | 163.7 | 0.15 | 98 |
| LNU726 | 71203.5 | 6.5 | 0.19 | 49 | 121.9 | L | 47 |
| LNU726 | 71204.4 | — | — | — | 112.7 | 0.09 | 36 |
| LNU725 | 71199.1 | — | — | — | 111.7 | 0.02 | 35 |
| LNU725 | 71201.5 | 8.0 | 0.03 | 83 | 143.8 | 0.04 | 74 |
| LNU714 | 71181.2 | — | — | — | 118.4 | 0.22 | 43 |
| LNU714 | 71181.6 | — | — | — | 110.7 | 0.18 | 34 |
| LNU714 | 71182.1 | 6.4 | 0.04 | 47 | 158.6 | L | 92 |
| LNU714 | 71183.2 | — | — | — | 103.2 | 0.09 | 25 |
| LNU712 | 71144.2 | — | — | — | 114.9 | 0.17 | 39 |
| LNU712 | 71144.3 | 12.1 | 0.01 | 177 | 242.5 | L | 193 |
| LNU712 | 71147.4 | 8.6 | L | 97 | 186.3 | L | 125 |
| LNU712 | 71148.2 | — | — | — | 125.4 | 0.16 | 52 |
| LNU711 | 71137.2 | — | — | — | 102.2 | 0.18 | 23 |
| LNU711 | 71139.3 | — | — | — | 103.8 | 0.10 | 25 |
| CONT. | — | 4.4 | — | — | 82.8 | — | — |
| LNU709 | 71498.3 | 7.0 | 0.05 | 51 | 139.3 | 0.06 | 58 |
| LNU709 | 71498.4 | 7.3 | 0.09 | 59 | 126.7 | 0.16 | 44 |
| LNU709 | 71501.3 | 8.0 | 0.03 | 72 | 149.0 | L | 69 |
| LNU693 | 71546.2 | 6.6 | 0.08 | 42 | — | — | — |
| LNU693 | 71547.3 | 6.6 | 0.03 | 42 | 114.4 | 0.09 | 30 |
| LNU693 | 71548.6 | 7.1 | 0.08 | 54 | 127.7 | 0.07 | 45 |
| LNU676 | 71095.2 | 6.9 | 0.06 | 50 | 115.2 | 0.13 | 31 |
| LNU676 | 71095.4 | 7.8 | 0.21 | 69 | 141.2 | 0.21 | 61 |
| LNU671 | 71091.2 | 5.9 | 0.24 | 28 | 113.4 | 0.23 | 29 |
| LNU671 | 71094.5 | 6.8 | 0.14 | 46 | 125.3 | 0.14 | 43 |
| LNU659 | 71853.2 | 6.9 | 0.25 | 50 | — | — | — |
| LNU659 | 71855.5 | 6.9 | 0.02 | 50 | 128.6 | 0.03 | 46 |
| LNU654 | 71556.1 | 8.1 | 0.09 | 75 | 145.6 | 0.13 | 66 |
| LNU654 | 71557.3 | 6.8 | L | 46 | 132.7 | L | 51 |
| LNU603 | 71612.1 | 5.4 | 0.29 | 17 | — | — | — |
| LNU521 | 71598.3 | 6.2 | 0.19 | 33 | 105.9 | 0.30 | 21 |
| CONT. | — | 4.6 | — | — | 87.9 | — | — |
| LNU742 | 71552.1 | 4.1 | 0.29 | 31 | — | — | — |
| LNU742 | 71552.2 | 4.6 | 0.04 | 46 | 88.8 | 0.22 | 30 |
| LNU742 | 71554.2 | 6.2 | 0.13 | 98 | 130.7 | 0.11 | 92 |
| LNU742 | 71555.2 | 4.0 | 0.27 | 29 | 82.4 | 0.30 | 21 |
| LNU734 | 71646.5 | 8.7 | L | 176 | 164.7 | L | 141 |
| LNU734 | 71648.2 | 5.0 | L | 60 | 100.9 | L | 48 |
| LNU734 | 71648.3 | 5.4 | 0.07 | 71 | 114.7 | 0.03 | 68 |
| LNU734 | 71648.5 | 5.5 | 0.05 | 75 | 100.6 | 0.05 | 48 |
| LNU734 | 71649.1 | — | — | — | 85.0 | 0.09 | 25 |
| LNU715 | 71642.2 | 5.0 | 0.02 | 59 | 100.5 | 0.05 | 47 |
| LNU715 | 71643.1 | 8.8 | 0.08 | 179 | 174.3 | 0.06 | 155 |
| LNU715 | 71643.2 | 6.7 | 0.07 | 113 | 131.2 | 0.07 | 92 |
| LNU715 | 71643.3 | 5.0 | 0.05 | 57 | 101.5 | 0.02 | 49 |
| LNU715 | 71645.3 | 8.1 | 0.09 | 157 | 151.5 | 0.10 | 122 |
| LNU567 | 70995.2 | 4.2 | 0.12 | 35 | 92.8 | 0.09 | 36 |
| LNU567 | 70995.4 | 6.2 | L | 98 | 125.5 | L | 84 |
| LNU567 | 70998.3 | 6.1 | L | 93 | 112.7 | 0.04 | 65 |
| LNU567 | 70998.4 | 4.2 | 0.10 | 32 | 86.3 | 0.11 | 26 |
| CONT. | — | 3.1 | — | — | 68.2 | — | — |
| LNU722 | 71185.4 | — | — | — | 69.3 | 0.24 | 18 |
| LNU722 | 71189.5 | 4.7 | L | 40 | 76.6 | 0.01 | 30 |
| LNU706 | 71343.2 | 4.9 | 0.14 | 46 | 91.9 | 0.10 | 56 |
| LNU706 | 71344.5 | 4.2 | 0.07 | 27 | 83.1 | L | 41 |
| LNU702 | 71857.3 | 4.4 | 0.27 | 33 | 76.8 | 0.06 | 31 |
| LNU702 | 71858.3 | — | — | — | 67.3 | 0.27 | 14 |
| LNU702 | 71859.3 | 6.2 | 0.04 | 85 | 112.2 | 0.10 | 91 |
| LNU702 | 71860.2 | — | — | — | 67.2 | 0.29 | 14 |
| LNU693 | 71546.3 | 4.3 | 0.05 | 30 | 74.2 | 0.24 | 26 |
| LNU693 | 71547.3 | 7.5 | L | 124 | 134.3 | L | 128 |
| LNU693 | 71548.6 | 8.2 | 0.05 | 147 | 151.5 | 0.05 | 158 |
| LNU668 | 71415.5 | 8.1 | 0.10 | 141 | 155.1 | 0.08 | 164 |
| LNU668 | 71415.6 | 5.6 | 0.06 | 68 | 103.2 | 0.01 | 76 |
| LNU668 | 71416.3 | 4.6 | 0.01 | 39 | 87.1 | 0.11 | 48 |
| LNU545 | 72596.1 | 4.9 | 0.01 | 46 | 84.5 | 0.02 | 44 |
| LNU545 | 72597.1 | 8.4 | 0.06 | 152 | 154.5 | 0.04 | 163 |
| LNU545 | 72598.1 | 4.2 | 0.06 | 24 | 76.6 | 0.03 | 30 |
| CONT. | — | 3.3 | — | — | 58.8 | — | — |
| LNU696 | 70601.2 | 10.0 | 0.24 | 55 | — | — | — |
| LNU686 | 70689.4 | 7.7 | 0.21 | 20 | — | — | — |
| LNU686 | 70689.5 | 9.4 | 0.12 | 47 | — | — | — |
| LNU627 | 70491.2 | 8.9 | 0.23 | 39 | — | — | — |
| LNU627 | 70491.5 | 9.3 | 0.02 | 45 | 177.3 | 0.04 | 36 |
| LNU616 | 70504.4 | 9.9 | 0.01 | 54 | 168.7 | 0.10 | 30 |
| LNU595 | 70274.3 | 11.3 | 0.05 | 76 | 206.7 | 0.11 | 59 |
| LNU565 | 70623.5 | 9.4 | L | 47 | 179.0 | 0.07 | 38 |
| LNU565 | 70624.5 | 7.3 | 0.19 | 14 | — | — | — |
| LNU542 | 70226.2 | 12.2 | L | 90 | 201.2 | 0.01 | 55 |
| LNU542 | 70229.3 | 9.9 | 0.25 | 54 | — | — | — |
| LNU539 | 70225.2 | 8.0 | 0.07 | 25 | — | — | — |
| LNU537 | 70215.4 | 10.9 | 0.14 | 71 | 186.1 | 0.17 | 43 |
| CONT. | — | 6.4 | — | — | 130.1 | — | — |
| LNU688 | 72692.4 | 6.6 | 0.18 | 34 | 117.7 | 0.25 | 28 |
| LNU688 | 72694.4 | 6.3 | 0.24 | 27 | — | — | — |
| LNU657 | 70334.8 | — | — | — | 120.0 | 0.28 | 30 |
| LNU657 | 70336.1 | 8.3 | 0.12 | 68 | 177.2 | 0.06 | 92 |
| LNU645 | 73004.1 | 6.6 | 0.20 | 35 | 122.8 | 0.18 | 33 |
| LNU645 | 73006.2 | 7.8 | 0.03 | 57 | 159.0 | L | 73 |
| LNU645 | 73008.2 | 9.1 | 0.04 | 84 | 167.2 | 0.05 | 81 |
| LNU608 | 72997.4 | 7.0 | 0.08 | 42 | 131.0 | 0.08 | 42 |
| LNU608 | 73000.1 | — | — | — | 124.0 | 0.12 | 35 |
| LNU588 | 72994.3 | 6.8 | 0.21 | 37 | 141.3 | 0.15 | 53 |
| LNU554 | 70478.2 | 7.1 | 0.06 | 44 | 142.7 | 0.15 | 55 |
| LNU554 | 70479.1 | 6.9 | 0.28 | 41 | — | — | — |
| LNU545 | 72598.1 | 8.3 | 0.05 | 69 | 174.3 | 0.05 | 89 |
| LNU545 | 72599.4 | 6.3 | 0.26 | 29 | 116.0 | 0.30 | 26 |
| CONT. | — | 4.9 | — | — | 92.1 | — | — |

TABLE 72-continued

Genes showing improved plant performance at standard nitrogen growth conditions (T2 generation)

| Gene Name | Event # | Dry Weight [mg] Ave. | P-Val. | % Incr. | Fresh Weight [mg] Ave. | P-Val. | % Incr. |
|---|---|---|---|---|---|---|---|
| LNU748 | 72947.2 | 5.3 | 0.16 | 46 | 101.3 | 0.27 | 40 |
| LNU748 | 72947.3 | 5.3 | 0.04 | 48 | 101.8 | 0.06 | 40 |
| LNU747 | 70619.1 | 4.7 | 0.29 | 30 | — | — | — |
| LNU747 | 70619.4 | 4.9 | 0.12 | 36 | 104.9 | 0.06 | 45 |
| LNU746 | 72964.3 | 4.9 | 0.11 | 35 | 98.8 | 0.08 | 36 |
| LNU746 | 72966.2 | 5.3 | 0.07 | 47 | 108.9 | 0.04 | 50 |
| LNU688 | 72691.3 | 7.7 | 0.16 | 112 | 124.9 | 0.23 | 72 |
| LNU688 | 72692.3 | 8.6 | 0.03 | 137 | 160.8 | 0.03 | 122 |
| LNU645 | 73005.2 | 6.1 | 0.01 | 70 | 102.5 | 0.05 | 41 |
| LNU636_H1 | 72937.3 | 5.9 | 0.19 | 62 | 104.7 | 0.29 | 44 |
| LNU636_H1 | 72942.2 | 6.0 | 0.09 | 67 | 123.5 | 0.15 | 70 |
| LNU608 | 72997.4 | 4.8 | 0.30 | 33 | — | — | — |
| LNU588 | 72992.1 | 5.0 | 0.07 | 39 | 94.4 | 0.14 | 30 |
| LNU588 | 72995.4 | 5.6 | 0.29 | 56 | 115.9 | 0.29 | 60 |
| LNU585 | 72913.3 | 6.0 | 0.11 | 65 | 113.6 | 0.18 | 57 |
| LNU585 | 72914.2 | 7.0 | 0.01 | 94 | 128.3 | 0.02 | 77 |
| LNU585 | 72915.1 | 6.2 | 0.07 | 72 | 131.9 | 0.02 | 82 |
| LNU585 | 72917.3 | 8.1 | L | 125 | 154.8 | 0.01 | 113 |
| CONT. | — | 3.6 | — | — | 72.6 | — | — |
| LNU710 | 70712.3 | 8.3 | 0.11 | 58 | 148.0 | 0.13 | 44 |
| LNU710 | 70715.1 | 9.0 | 0.19 | 71 | 138.8 | 0.17 | 82 |
| LNU710 | 70715.2 | 6.9 | 0.01 | 31 | 120.9 | 0.12 | 18 |
| LNU710 | 70716.1 | — | — | — | 117.4 | 0.22 | 14 |
| LNU705 | 70604.2 | 6.9 | 0.21 | 31 | 130.3 | 0.22 | 27 |
| LNU705 | 70607.3 | 8.3 | 0.12 | 58 | 145.0 | 0.14 | 41 |
| LNU639 | 70869.2 | 10.4 | 0.01 | 99 | 196.6 | 0.06 | 92 |
| LNU635 | 70784.2 | 6.6 | 0.07 | 26 | 124.2 | 0.26 | 21 |
| LNU635 | 70784.3 | 13.8 | L | 164 | 249.2 | L | 143 |
| LNU635 | 70786.4 | 8.2 | 0.07 | 56 | 171.8 | 0.07 | 67 |
| LNU589 | 70707.2 | 8.3 | L | 58 | 141.7 | 0.02 | 38 |
| LNU580 | 70851.4 | 7.2 | 0.08 | 38 | 144.1 | 0.11 | 40 |
| LNU549 | 70723.2 | 10.3 | 0.02 | 97 | 186.8 | 0.04 | 82 |
| LNU524 | 70809.1 | 8.2 | 0.11 | 57 | 149.4 | 0.18 | 46 |
| CONT. | — | 5.2 | — | — | 102.6 | — | — |
| LNU729 | 71517.4 | 6.6 | L | 89 | 118.0 | 0.01 | 61 |
| LNU729 | 71518.2 | 6.8 | L | 95 | 121.1 | L | 66 |
| LNU729 | 71519.4 | 6.9 | 0.11 | 98 | 125.3 | 0.10 | 71 |
| LNU719 | 71540.3 | 4.9 | 0.09 | 41 | 99.9 | 0.06 | 31 |
| LNU719 | 71542.3 | 6.5 | 0.10 | 84 | 130.5 | 0.08 | 79 |
| LNU719 | 71543.1 | 4.5 | 0.19 | 28 | 86.5 | 0.23 | 18 |
| LNU719 | 71543.8 | 5.7 | 0.01 | 62 | 99.6 | 0.06 | 36 |
| LNU718 | 71504.1 | 5.8 | 0.20 | 66 | — | — | — |
| LNU718 | 71504.6 | 5.0 | 0.13 | 41 | 98.7 | 0.18 | 35 |
| LNU718 | 71506.2 | 5.5 | 0.16 | 57 | — | — | — |
| LNU718 | 71507.2 | 5.2 | 0.07 | 50 | 94.3 | 0.30 | 29 |
| LNU709 | 71498.4 | 7.9 | 0.10 | 126 | 134.1 | 0.15 | 83 |
| LNU709 | 71499.2 | 4.8 | 0.23 | 36 | — | — | — |
| LNU709 | 71501.3 | 6.5 | 0.06 | 86 | 118.2 | 0.08 | 62 |
| LNU693 | 71546.2 | 5.5 | 0.19 | 58 | 108.5 | 0.09 | 48 |
| LNU693 | 71547.3 | 7.2 | 0.02 | 104 | 130.0 | 0.01 | 79 |
| LNU693 | 71547.5 | 5.4 | 0.03 | 55 | 91.7 | 0.19 | 26 |
| LNU693 | 71548.6 | 7.9 | 0.18 | 125 | 143.2 | 0.19 | 96 |
| LNU654 | 71557.1 | 6.7 | 0.05 | 91 | 119.2 | L | 63 |
| LNU654 | 71557.3 | 6.4 | L | 82 | 121.1 | L | 66 |
| LNU654 | 71559.2 | 4.8 | 0.14 | 36 | 91.3 | 0.15 | 25 |
| LNU654 | 71561.4 | 7.8 | 0.01 | 124 | 127.4 | 0.04 | 74 |
| LNU607 | 71592.5 | 9.8 | L | 179 | 169.0 | L | 131 |
| LNU607 | 71595.3 | 5.8 | 0.13 | 65 | 112.3 | 0.15 | 54 |
| LNU603 | 71610.5 | 9.2 | 0.02 | 164 | 183.1 | 0.02 | 151 |
| LNU603 | 71612.1 | 4.3 | 0.24 | 23 | — | — | — |
| LNU603 | 71612.3 | 5.8 | L | 66 | 109.6 | L | 50 |
| LNU603 | 71613.6 | 7.0 | L | 99 | 124.5 | L | 70 |
| LNU521 | 71598.3 | 6.5 | 0.05 | 86 | 106.3 | 0.16 | 45 |
| LNU521 | 71601.5 | 5.0 | 0.06 | 43 | — | — | — |
| CONT. | — | 3.5 | — | — | 73.1 | — | — |
| LNU708 | 71797.3 | — | — | — | 128.4 | L | 59 |
| LNU708 | 71798.4 | 5.4 | 0.16 | 30 | — | — | — |
| LNU649 | 71059.1 | — | — | — | 122.0 | 0.16 | 51 |
| LNU649 | 71063.1 | 6.3 | 0.04 | 52 | 116.1 | 0.09 | 44 |
| LNU649 | 71064.2 | 5.9 | 0.05 | 41 | 103.8 | 0.09 | 29 |
| LNU648 | 71024.4 | — | — | — | 107.7 | 0.25 | 33 |
| LNU648 | 71026.1 | 7.3 | 0.03 | 77 | 138.0 | 0.03 | 71 |
| LNU634 | 71016.3 | 5.7 | 0.05 | 37 | 114.5 | L | 42 |
| LNU622 | 71003.3 | 6.7 | 0.09 | 60 | 127.8 | 0.09 | 58 |
| LNU622 | 71004.2 | 5.8 | 0.05 | 40 | 106.2 | 0.05 | 32 |
| LNU591 | 71283.1 | 7.6 | 0.14 | 81 | 131.3 | 0.16 | 63 |
| LNU591 | 71283.3 | 6.2 | 0.01 | 50 | 106.4 | 0.03 | 32 |
| LNU591 | 71286.3 | 5.3 | 0.25 | 29 | — | — | — |
| LNU581 | 71305.7 | 6.2 | 0.16 | 50 | 120.9 | 0.10 | 50 |
| LNU581 | 71306.1 | 5.8 | 0.07 | 39 | 104.4 | 0.03 | 29 |
| LNU574 | 71790.4 | 8.2 | L | 97 | 143.0 | L | 77 |
| LNU574 | 71791.2 | 5.9 | 0.02 | 42 | 105.8 | 0.01 | 31 |
| CONT. | — | 4.2 | — | — | 80.7 | — | — |
| LNU671 | 71094.5 | 7.3 | 0.22 | 13 | 135.7 | 0.11 | 21 |
| LNU649 | 71064.2 | 9.1 | 0.08 | 41 | 162.4 | 0.05 | 45 |
| LNU622 | 70999.1 | 7.8 | 0.23 | 21 | 143.3 | 0.14 | 28 |
| LNU622 | 70999.3 | — | — | — | 136.6 | 0.16 | 22 |
| LNU622 | 71003.4 | 8.8 | 0.17 | 36 | 163.5 | 0.03 | 46 |
| LNU591 | 71283.3 | — | — | — | 132.9 | 0.28 | 18 |
| LNU581 | 71306.1 | 7.8 | 0.17 | 21 | 164.5 | L | 47 |
| CONT. | — | 6.5 | — | — | 112.3 | — | — |
| LNU735 | 71872.2 | 5.7 | 0.02 | 28 | — | — | — |
| LNU735 | 71873.2 | 8.4 | 0.19 | 88 | — | — | — |
| LNU735 | 71873.5 | 7.5 | 0.20 | 69 | 138.2 | 0.20 | 61 |
| LNU713 | 71862.1 | 6.2 | 0.05 | 38 | 115.5 | 0.10 | 35 |
| LNU689 | 71778.3 | 8.1 | 0.02 | 82 | 148.8 | L | 73 |
| LNU689 | 71779.6 | 6.7 | 0.09 | 50 | 120.4 | 0.22 | 40 |
| LNU688 | 72692.3 | 6.5 | 0.24 | 46 | 143.4 | 0.23 | 67 |
| LNU688 | 72692.4 | 7.9 | 0.13 | 77 | 135.7 | 0.13 | 58 |
| LNU669 | 70391.1 | 5.8 | 0.10 | 31 | 116.4 | 0.14 | 36 |
| LNU669 | 70393.1 | 7.6 | 0.04 | 69 | 149.6 | 0.05 | 74 |
| LNU611 | 72698.2 | 5.5 | 0.18 | 22 | — | — | — |
| LNU611 | 72702.3 | — | — | — | 99.8 | 0.21 | 16 |
| LNU546 | 72584.3 | 6.9 | 0.16 | 54 | 128.8 | 0.07 | 50 |
| LNU546 | 72586.1 | 5.7 | 0.07 | 28 | 111.0 | 0.06 | 29 |
| LNU533 | 71826.1 | 5.7 | 0.20 | 27 | 106.1 | 0.06 | 24 |
| CONT. | — | 4.5 | — | — | 85.8 | — | — |
| LNU710 | 70712.5 | 7.2 | 0.10 | 33 | 121.4 | 0.08 | 30 |
| LNU710 | 70712.6 | 7.6 | 0.11 | 40 | 137.1 | 0.02 | 47 |
| LNU710 | 70715.2 | 9.2 | L | 70 | 171.3 | L | 84 |
| LNU705 | 70604.2 | 7.2 | 0.03 | 33 | 125.2 | 0.05 | 34 |
| LNU705 | 70604.4 | 6.1 | 0.26 | 13 | 120.3 | 0.04 | 29 |
| LNU705 | 70607.3 | 7.8 | 0.12 | 44 | 135.9 | 0.15 | 46 |
| LNU639 | 70871.3 | 7.6 | 0.03 | 40 | 129.0 | 0.02 | 39 |
| LNU639 | 70872.4 | 6.6 | 0.09 | 22 | 113.4 | 0.14 | 22 |
| LNU639 | 70873.2 | — | — | — | 132.4 | 0.26 | 42 |
| LNU635 | 70784.4 | 6.8 | 0.04 | 26 | 120.6 | 0.07 | 30 |
| LNU635 | 70787.3 | 6.3 | 0.15 | 17 | 114.5 | 0.16 | 23 |
| LNU580 | 70851.2 | — | — | — | 105.2 | 0.24 | 13 |
| LNU580 | 70853.2 | — | — | — | 121.0 | 0.18 | 30 |
| LNU580 | 70855.3 | 7.8 | 0.12 | 43 | 127.4 | 0.12 | 37 |
| LNU549 | 70723.2 | — | — | — | 115.1 | 0.11 | 24 |
| LNU543 | 70826.1 | — | — | — | 114.9 | 0.16 | 23 |
| LNU543 | 70827.1 | 8.8 | 0.08 | 61 | 151.6 | 0.09 | 63 |
| LNU543 | 70828.4 | 7.8 | 0.19 | 43 | 136.3 | 0.12 | 46 |
| LNU524 | 70808.1 | 7.0 | 0.03 | 28 | 107.2 | 0.23 | 15 |
| CONT. | — | 5.4 | — | — | 93.1 | — | — |
| LNU748 | 72945.1 | 6.0 | 0.12 | 42 | — | — | — |
| LNU748 | 72945.2 | 6.6 | L | 56 | 126.8 | 0.21 | 35 |
| LNU748 | 72947.3 | 5.2 | 0.23 | 23 | — | — | — |
| LNU746 | 72962.2 | 6.7 | 0.02 | 60 | 123.7 | 0.27 | 32 |
| LNU746 | 72966.3 | 6.2 | 0.03 | 48 | — | — | — |
| LNU745 | 70911.1 | 6.2 | 0.03 | 48 | — | — | — |
| LNU745 | 70914.4 | 7.0 | 0.28 | 66 | — | — | — |
| LNU739 | 71630.1 | 5.2 | 0.30 | 25 | — | — | — |
| LNU739 | 71631.3 | 8.0 | 0.27 | 90 | — | — | — |
| LNU636_H1 | 72940.1 | 9.9 | L | 136 | 169.1 | 0.04 | 80 |
| LNU636_H1 | 72942.2 | 7.0 | 0.10 | 67 | — | — | — |
| LNU590 | 70267.4 | 6.6 | 0.20 | 57 | — | — | — |
| LNU585 | 72913.3 | 6.1 | 0.04 | 44 | — | — | — |
| LNU585 | 72915.1 | 6.2 | 0.02 | 48 | — | — | — |
| LNU556 | 72363.2 | 8.4 | 0.04 | 101 | 146.2 | 0.15 | 56 |
| LNU545 | 72595.2 | 6.7 | 0.04 | 60 | — | — | — |
| LNU545 | 72596.1 | 6.6 | 0.14 | 57 | — | — | — |

TABLE 72-continued

Genes showing improved plant performance at standard nitrogen growth conditions (T2 generation)

| Gene Name | Event # | Dry Weight [mg] Ave. | P-Val. | % Incr. | Fresh Weight [mg] Ave. | P-Val. | % Incr. |
|---|---|---|---|---|---|---|---|
| LNU545 | 72598.1 | 6.9 | 0.04 | 64 | 124.1 | 0.29 | 32 |
| CONT. | — | 4.2 | — | — | 94.0 | — | — |
| LNU696 | 70599.4 | 6.2 | 0.02 | 69 | 127.7 | L | 68 |
| LNU696 | 70600.3 | 5.9 | L | 60 | 125.5 | L | 65 |
| LNU696 | 70600.4 | 7.5 | L | 102 | 157.2 | L | 107 |
| LNU696 | 70601.2 | — | — | — | 90.8 | 0.11 | 19 |
| LNU696 | 70601.4 | 4.3 | 0.21 | 16 | 88.5 | 0.07 | 16 |
| LNU686 | 70689.2 | 5.2 | 0.08 | 39 | 99.1 | 0.22 | 30 |
| LNU686 | 70689.4 | 6.1 | 0.02 | 66 | 129.9 | 0.03 | 71 |
| LNU686 | 70689.5 | 5.0 | 0.05 | 35 | 112.3 | 0.01 | 48 |
| LNU686 | 70690.5 | 5.3 | 0.19 | 45 | 101.6 | 0.10 | 34 |
| LNU627 | 70490.2 | 6.0 | 0.09 | 64 | 106.8 | 0.14 | 40 |
| LNU627 | 70490.4 | 4.6 | 0.08 | 25 | 89.2 | 0.13 | 17 |
| LNU627 | 70491.3 | 5.6 | 0.20 | 53 | 115.2 | 0.15 | 51 |
| LNU627 | 70491.5 | 7.7 | 0.04 | 107 | 159.6 | 0.02 | 110 |
| LNU627 | 70493.5 | 5.4 | 0.03 | 46 | 120.8 | 0.02 | 59 |
| LNU616 | 70505.3 | 5.6 | L | 52 | 113.6 | L | 49 |
| LNU595 | 70274.3 | 5.1 | 0.14 | 39 | 101.3 | 0.17 | 33 |
| LNU595 | 70276.1 | 5.9 | 0.27 | 58 | 129.3 | 0.23 | 70 |
| LNU595 | 70277.1 | — | — | — | 84.0 | 0.21 | 10 |
| LNU595 | 70278.1 | 5.5 | 0.08 | 48 | 107.6 | 0.09 | 41 |
| LNU565 | 70623.5 | 5.4 | 0.01 | 47 | 108.0 | 0.02 | 42 |
| LNU565 | 70624.3 | 5.0 | 0.03 | 36 | 87.5 | 0.09 | 15 |
| LNU565 | 70624.5 | 4.9 | 0.09 | 33 | 96.5 | L | 27 |
| LNU565 | 70626.1 | 5.2 | L | 40 | 100.5 | 0.02 | 32 |
| LNU565 | 70626.4 | 5.9 | 0.03 | 59 | 109.0 | 0.03 | 43 |
| LNU542 | 70226.1 | 5.0 | 0.05 | 36 | 105.6 | 0.04 | 39 |
| LNU542 | 70226.2 | 4.2 | 0.30 | 14 | 93.3 | 0.10 | 23 |
| LNU542 | 70229.7 | 5.6 | L | 51 | 106.4 | L | 40 |
| LNU542 | 70230.2 | 6.0 | 0.06 | 62 | 108.1 | 0.09 | 42 |
| LNU542 | 70231.1 | 4.9 | 0.03 | 32 | 98.2 | L | 29 |
| LNU539 | 70220.1 | 5.4 | 0.05 | 45 | 106.6 | L | 40 |
| LNU539 | 70221.2 | 5.6 | 0.02 | 53 | 114.1 | 0.02 | 50 |
| LNU539 | 70225.3 | 5.3 | 0.06 | 45 | 113.4 | L | 49 |
| LNU537 | 70215.1 | 6.0 | 0.27 | 61 | 124.7 | 0.19 | 64 |
| LNU537 | 70215.4 | 9.3 | L | 151 | 182.1 | 0.01 | 139 |
| LNU537 | 70217.2 | 8.4 | L | 128 | 174.9 | L | 130 |
| LNU537 | 70217.4 | 6.0 | 0.09 | 64 | 119.8 | 0.12 | 57 |
| LNU537 | 70218.2 | 6.8 | L | 82 | 153.6 | L | 102 |
| CONT. | — | 3.7 | — | — | 76.1 | — | — |
| LNU742 | 71555.2 | 5.5 | 0.25 | 38 | 104.3 | 0.25 | 31 |
| LNU734 | 71646.5 | 4.7 | 0.19 | 20 | 91.2 | 0.29 | 15 |
| LNU734 | 71648.2 | 8.2 | 0.25 | 109 | 155.1 | 0.22 | 95 |
| LNU734 | 71649.1 | 5.3 | 0.10 | 34 | 94.1 | 0.25 | 18 |
| LNU729 | 71517.4 | 6.6 | 0.15 | 68 | 131.1 | 0.10 | 65 |
| LNU729 | 71517.6 | 5.1 | 0.29 | 29 | 100.0 | 0.23 | 26 |
| LNU729 | 71519.4 | 5.8 | 0.07 | 47 | 103.3 | 0.14 | 30 |
| LNU729 | 71519.6 | 7.6 | 0.15 | 93 | 133.5 | 0.18 | 68 |
| LNU719 | 71542.3 | 6.1 | 0.25 | 54 | 149.1 | 0.08 | 88 |
| LNU719 | 71543.1 | 7.3 | 0.23 | 85 | 137.1 | 0.26 | 73 |
| LNU708 | 71797.2 | 4.8 | 0.15 | 21 | — | — | — |
| LNU708 | 71798.3 | 5.0 | 0.19 | 26 | 104.7 | 0.06 | 32 |
| LNU708 | 71801.5 | 7.8 | 0.09 | 99 | 133.6 | 0.18 | 68 |
| LNU659 | 71850.2 | 5.5 | 0.11 | 41 | 98.5 | 0.13 | 24 |
| LNU659 | 71853.3 | 6.0 | 0.03 | 51 | 107.1 | 0.03 | 35 |
| LNU574 | 71791.2 | 5.3 | 0.02 | 35 | 121.6 | 0.03 | 53 |
| LNU574 | 71792.3 | 6.1 | 0.08 | 56 | 151.3 | 0.09 | 90 |
| CONT. | — | 3.9 | — | — | 79.4 | — | — |
| LNU739 | 71630.1 | 6.6 | 0.03 | 71 | 124.5 | L | 65 |
| LNU739 | 71630.4 | 5.9 | 0.01 | 50 | 130.1 | 0.18 | 72 |
| LNU739 | 71633.5 | — | — | — | 94.6 | 0.11 | 25 |
| LNU715 | 71642.2 | 6.2 | L | 61 | 126.6 | L | 67 |
| LNU715 | 71643.2 | — | — | — | 98.0 | 0.12 | 30 |
| LNU715 | 71643.3 | 4.5 | 0.28 | 16 | 86.5 | 0.15 | 14 |
| LNU715 | 71645.2 | 6.2 | 0.04 | 58 | 128.9 | 0.03 | 70 |
| LNU653 | 70658.3 | 5.8 | L | 50 | 118.2 | L | 56 |
| LNU653 | 70658.5 | — | — | — | 90.2 | 0.11 | 19 |
| LNU653 | 70659.1 | 5.0 | 0.04 | 30 | 110.6 | 0.04 | 46 |
| LNU653 | 70659.4 | 5.2 | 0.04 | 34 | 99.6 | 0.15 | 32 |
| LNU653 | 70660.2 | 4.7 | 0.20 | 20 | 92.4 | 0.16 | 22 |
| LNU638 | 72139.2 | 5.3 | 0.09 | 36 | 119.5 | L | 58 |
| LNU638 | 72142.1 | 5.3 | 0.24 | 38 | 117.3 | 0.06 | 55 |
| LNU638 | 72142.3 | 7.2 | L | 85 | 138.3 | L | 83 |
| LNU638 | 72143.3 | — | — | — | 91.1 | 0.10 | 20 |
| LNU638 | 72144.1 | 4.5 | 0.22 | 16 | 98.3 | 0.02 | 30 |
| LNU637 | 71664.2 | 5.3 | 0.03 | 36 | 103.7 | 0.04 | 37 |
| LNU637 | 71667.1 | 5.0 | 0.12 | 30 | 118.7 | 0.11 | 57 |
| LNU637 | 71669.5 | 6.6 | 0.06 | 70 | 125.8 | 0.07 | 66 |
| LNU618 | 72133.2 | 5.4 | 0.08 | 40 | 102.0 | 0.11 | 35 |
| LNU559 | 70832.4 | 7.2 | L | 84 | 149.1 | 0.02 | 97 |
| LNU559 | 70834.1 | 5.9 | L | 52 | 115.5 | L | 53 |
| LNU559 | 70835.1 | 6.3 | 0.24 | 63 | 126.5 | 0.20 | 67 |
| LNU559 | 70835.4 | 5.6 | 0.07 | 45 | 131.1 | 0.10 | 73 |
| LNU559 | 70837.2 | 5.6 | 0.03 | 45 | 116.7 | 0.06 | 54 |
| CONT. | — | 3.9 | — | — | 75.7 | — | — |
| LNU688 | 72694.4 | 6.2 | 0.08 | 42 | 125.9 | 0.08 | 44 |
| LNU661 | 72705.3 | 7.1 | 0.01 | 64 | 129.4 | 0.03 | 48 |
| LNU661 | 72707.2 | 8.6 | L | 99 | 163.1 | L | 87 |
| LNU611 | 72698.2 | 6.3 | 0.22 | 46 | 123.4 | 0.13 | 41 |
| LNU611 | 72699.1 | — | — | — | 106.9 | 0.23 | 23 |
| LNU573 | 72592.1 | 6.9 | 0.03 | 59 | 131.2 | 0.08 | 50 |
| LNU558 | 70468.2 | — | — | — | 111.4 | 0.28 | 28 |
| LNU558 | 70470.5 | 5.8 | 0.23 | 34 | 114.5 | 0.21 | 31 |
| LNU531 | 70212.1 | 6.7 | 0.08 | 55 | 135.1 | 0.07 | 55 |
| LNU522 | 70802.1 | 7.3 | L | 70 | 140.0 | 0.01 | 61 |
| LNU522 | 70805.2 | 5.9 | 0.21 | 35 | 121.6 | 0.15 | 39 |
| CONT. | — | 4.3 | — | — | 87.2 | — | — |

Table 72:
"CONT."—Control;
"Ave."—Average;
"% Incr." = % increment;
"p-val."—p-value;
L means that p-value is less than 0.01, p < 0.1 was considered as significant.

TABLE 73

Genes showing improved plant performance at standard nitrogen growth conditions (T2 generation)

| Gene Name | Event # | Leaf Area [cm²] Ave. | P-Val. | % Incr. | Roots Coverage [cm²] Ave. | P-Val. | % Incr. | Roots Length [cm] Ave. | P-Val. | % Incr. |
|---|---|---|---|---|---|---|---|---|---|---|
| LNU741 | 71248.4 | — | — | — | 6.6 | 0.30 | 35 | — | — | — |
| LNU741 | 71249.3 | — | — | — | — | — | — | 6.5 | 0.04 | 19 |
| LNU740 | 71242.6 | — | — | — | — | — | — | 6.3 | 0.04 | 16 |
| LNU732 | 71226.3 | — | — | — | — | — | — | 5.9 | 0.19 | 8 |
| LNU732 | 71226.6 | — | — | — | 6.1 | 0.07 | 27 | 6.4 | 0.01 | 18 |
| LNU728 | 71209.5 | 0.5 | 0.11 | 26 | 6.9 | 0.14 | 42 | 6.6 | 0.11 | 20 |

TABLE 73-continued

Genes showing improved plant performance at standard nitrogen growth conditions (T2 generation)

| Gene Name | Event # | Leaf Area [cm²] Ave. | P-Val. | % Incr. | Roots Coverage [cm²] Ave. | P-Val. | % Incr. | Roots Length [cm] Ave. | P-Val. | % Incr. |
|---|---|---|---|---|---|---|---|---|---|---|
| LNU728 | 71210.2 | — | — | — | 6.2 | 0.15 | 28 | 6.7 | 0.04 | 22 |
| LNU725 | 71198.4 | — | — | — | — | — | — | 6.3 | 0.13 | 15 |
| LNU725 | 71199.3 | — | — | — | — | — | — | 6.2 | 0.21 | 14 |
| LNU725 | 71199.4 | — | — | — | 6.1 | 0.25 | 26 | — | — | — |
| LNU725 | 71201.1 | — | — | — | 6.5 | 0.11 | 35 | 6.6 | 0.20 | 21 |
| LNU714 | 71181.2 | — | — | — | — | — | — | 6.0 | 0.19 | 10 |
| LNU714 | 71183.3 | 0.5 | 0.03 | 32 | 7.2 | 0.01 | 50 | 6.5 | L | 20 |
| LNU712 | 71143.3 | — | — | — | 7.7 | 0.19 | 60 | 6.8 | 0.05 | 24 |
| LNU712 | 71144.2 | 0.5 | 0.27 | 18 | 7.5 | L | 55 | 6.6 | L | 21 |
| LNU712 | 71144.3 | — | — | — | — | — | — | 6.4 | 0.06 | 17 |
| LNU712 | 71147.1 | — | — | — | 6.5 | 0.16 | 34 | — | — | — |
| LNU712 | 71147.4 | 0.5 | 0.25 | 19 | 7.3 | 0.10 | 51 | 6.2 | 0.23 | 13 |
| LNU711 | 71137.2 | — | — | — | — | — | — | 6.4 | 0.05 | 18 |
| LNU711 | 71137.5 | — | — | — | 6.1 | 0.08 | 27 | 6.7 | L | 23 |
| LNU711 | 71139.4 | — | — | — | 6.4 | 0.17 | 32 | — | — | — |
| CONT. | — | 0.4 | — | — | 4.8 | — | — | 5.4 | — | — |
| LNU646 | 72145.1 | — | — | — | 6.8 | 0.15 | 41 | 7.6 | 0.07 | 13 |
| LNU646 | 72150.2 | — | — | — | 7.7 | 0.14 | 60 | — | — | — |
| LNU638 | 72139.2 | — | — | — | 7.4 | 0.04 | 53 | — | — | — |
| LNU638 | 72142.3 | — | — | — | 7.3 | 0.12 | 51 | — | — | — |
| LNU638 | 72143.3 | 0.8 | L | 111 | 12.3 | L | 154 | — | — | — |
| LNU637 | 71669.8 | 0.6 | 0.05 | 59 | 7.9 | 0.02 | 63 | — | — | — |
| LNU615 | 72283.2 | — | — | — | 6.7 | 0.26 | 39 | — | — | — |
| LNU615 | 72285.1 | 0.6 | 0.02 | 65 | 8.8 | 0.03 | 82 | — | — | — |
| LNU615 | 72287.1 | — | — | — | 6.5 | 0.29 | 34 | — | — | — |
| LNU601 | 72131.3 | — | — | — | 6.1 | 0.24 | 26 | — | — | — |
| LNU601 | 72131.4 | 0.5 | 0.14 | 37 | 7.3 | 0.09 | 50 | — | — | — |
| LNU546 | 72586.1 | — | — | — | 7.9 | 0.02 | 63 | — | — | — |
| LNU546 | 72587.3 | — | — | — | 7.3 | 0.04 | 52 | — | — | — |
| LNU546 | 72588.1 | 0.5 | 0.29 | 40 | 7.7 | 0.24 | 60 | — | — | — |
| LNU533 | 71826.1 | 0.5 | 0.27 | 27 | 11.1 | L | 129 | 7.5 | 0.07 | 13 |
| CONT. | — | 0.4 | — | — | 4.8 | — | — | 6.7 | — | — |
| LNU735 | 71872.2 | — | — | — | 9.2 | 0.28 | 16 | 7.5 | 0.14 | 11 |
| LNU713 | 71862.1 | 0.6 | 0.13 | 16 | 9.2 | 0.16 | 16 | — | — | — |
| LNU713 | 71863.2 | — | — | — | 9.3 | 0.27 | 17 | 7.6 | 0.08 | 12 |
| LNU689 | 71779.6 | 0.6 | 0.06 | 20 | — | — | — | — | — | — |
| LNU601 | 72131.3 | 0.5 | 0.26 | 10 | — | — | — | — | — | — |
| CONT. | — | 0.5 | — | — | 7.9 | — | — | 6.8 | — | — |
| LNU706 | 71342.1 | 0.6 | 0.11 | 36 | 9.1 | 0.18 | 43 | 6.9 | 0.23 | 16 |
| LNU703 | 71492.1 | — | — | — | — | — | — | 6.7 | 0.19 | 13 |
| LNU695 | 71302.1 | — | — | — | — | — | — | 7.3 | 0.06 | 22 |
| LNU695 | 71303.2 | 0.6 | 0.14 | 27 | — | — | — | — | — | — |
| LNU687 | 71474.1 | 0.6 | 0.09 | 43 | 9.1 | 0.15 | 43 | 6.8 | 0.10 | 15 |
| LNU687 | 71474.3 | — | — | — | — | — | — | 6.9 | 0.18 | 16 |
| LNU687 | 71476.3 | 0.7 | L | 59 | 8.2 | 0.19 | 29 | — | — | — |
| LNU674 | 71427.5 | 0.6 | 0.02 | 34 | 9.1 | 0.11 | 43 | — | — | — |
| LNU674 | 71428.2 | 0.6 | 0.21 | 30 | — | — | — | — | — | — |
| LNU672 | 71420.3 | 0.6 | 0.07 | 28 | 10.7 | 0.01 | 68 | 7.4 | 0.10 | 24 |
| LNU672 | 71421.3 | 0.5 | 0.30 | 16 | 10.0 | 0.03 | 57 | 7.4 | L | 24 |
| LNU672 | 71421.6 | 0.5 | 0.24 | 18 | — | — | — | 6.7 | 0.16 | 12 |
| LNU652 | 71376.6 | 0.8 | 0.01 | 78 | — | — | — | — | — | — |
| LNU652 | 71380.1 | 0.5 | 0.07 | 22 | 7.6 | 0.22 | 19 | — | — | — |
| LNU632 | 71372.3 | 0.5 | 0.17 | 22 | — | — | — | — | — | — |
| LNU632 | 71372.4 | 0.6 | 0.02 | 33 | 11.0 | 0.01 | 73 | 7.6 | L | 28 |
| LNU624 | 71364.2 | 0.6 | 0.04 | 31 | — | — | — | — | — | — |
| LNU624 | 71367.1 | 0.6 | 0.05 | 32 | — | — | — | — | — | — |
| LNU624 | 71369.2 | 0.5 | 0.21 | 17 | — | — | — | — | — | — |
| CONT. | — | 0.4 | — | — | 6.4 | — | — | 6.0 | — | — |
| LNU706 | 71342.1 | 0.5 | 0.16 | 17 | — | — | — | — | — | — |
| LNU706 | 71343.1 | 0.5 | 0.09 | 33 | — | — | — | 7.0 | 0.25 | 10 |
| LNU706 | 71343.2 | 0.5 | 0.19 | 21 | 7.7 | 0.09 | 40 | — | — | — |
| LNU706 | 71344.5 | — | — | — | 7.5 | 0.16 | 36 | 7.3 | 0.03 | 15 |
| LNU703 | 71490.5 | 0.5 | 0.02 | 27 | 9.0 | L | 65 | 6.9 | 0.16 | 10 |
| LNU703 | 71491.2 | 0.5 | 0.24 | 20 | — | — | — | — | — | — |
| LNU703 | 71491.3 | — | — | — | — | — | — | 6.8 | 0.26 | 8 |
| LNU703 | 71492.6 | — | — | — | 6.3 | 0.27 | 14 | 6.9 | 0.06 | 10 |
| LNU695 | 71299.2 | 0.5 | 0.10 | 20 | 7.1 | 0.27 | 29 | — | — | — |
| LNU695 | 71302.1 | 0.5 | 0.14 | 18 | 6.6 | 0.07 | 21 | — | — | — |
| LNU695 | 71302.3 | 0.5 | 0.18 | 19 | 8.9 | L | 62 | 7.4 | 0.03 | 17 |
| LNU695 | 71303.2 | 0.6 | L | 51 | 9.2 | L | 67 | 7.2 | L | 14 |
| LNU687 | 71472.4 | — | — | — | 6.8 | 0.05 | 23 | 7.1 | 0.05 | 12 |

TABLE 73-continued

Genes showing improved plant performance at standard nitrogen growth conditions (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU687 | 71474.1 | 0.5 | 0.18 | 19 | 8.4 | 0.15 | 53 | 7.6 | 0.02 | 20 |
| LNU687 | 71474.3 | 0.5 | 0.11 | 27 | 10.3 | 0.03 | 88 | 7.6 | L | 20 |
| LNU687 | 71474.6 | 0.6 | L | 46 | 9.1 | L | 67 | 7.1 | 0.12 | 12 |
| LNU674 | 71425.1 | 0.5 | L | 35 | 6.5 | 0.09 | 19 | — | — | — |
| LNU674 | 71427.1 | 0.5 | L | 33 | 7.8 | 0.01 | 43 | 7.0 | 0.02 | 11 |
| LNU674 | 71428.2 | 0.5 | 0.04 | 24 | 6.9 | 0.05 | 25 | 6.8 | 0.11 | 7 |
| LNU672 | 71420.1 | 0.6 | L | 41 | 9.5 | L | 73 | 7.5 | L | 19 |
| LNU672 | 71420.3 | 0.6 | 0.07 | 55 | 9.5 | 0.15 | 73 | 7.0 | 0.27 | 11 |
| LNU672 | 71421.4 | 0.6 | 0.03 | 40 | 8.1 | 0.19 | 49 | — | — | — |
| LNU672 | 71421.6 | 0.5 | 0.07 | 26 | 9.3 | L | 69 | 7.6 | L | 20 |
| LNU652 | 71378.3 | 0.5 | 0.12 | 22 | — | — | — | — | — | — |
| LNU652 | 71380.1 | 0.7 | L | 69 | 10.4 | L | 89 | 6.9 | 0.26 | 9 |
| LNU632 | 71370.1 | 0.5 | 0.18 | 16 | 8.1 | 0.02 | 47 | 7.2 | 0.10 | 13 |
| LNU632 | 71372.4 | 0.5 | 0.13 | 20 | 6.9 | 0.20 | 26 | 7.3 | 0.16 | 16 |
| LNU632 | 71372.6 | 0.6 | 0.17 | 46 | 7.3 | 0.23 | 33 | 7.6 | 0.03 | 20 |
| LNU624 | 71364.2 | 0.6 | 0.02 | 49 | 9.1 | 0.07 | 66 | 7.1 | 0.10 | 12 |
| LNU624 | 71365.1 | 0.5 | 0.19 | 26 | — | — | — | — | — | — |
| LNU624 | 71367.1 | 0.5 | 0.05 | 34 | — | — | — | — | — | — |
| CONT. | — | 0.4 | — | — | 5.5 | — | — | 6.3 | — | — |
| LNU741 | 71248.4 | 0.5 | 0.05 | 22 | 4.8 | 0.26 | 20 | 5.7 | 0.01 | 22 |
| LNU741 | 71249.3 | — | — | — | 4.9 | 0.16 | 23 | 5.6 | 0.02 | 20 |
| LNU741 | 71249.5 | 0.5 | 0.04 | 34 | 5.7 | 0.15 | 45 | 5.7 | 0.05 | 22 |
| LNU741 | 71250.3 | — | — | — | — | — | — | 5.4 | 0.13 | 14 |
| LNU740 | 71239.6 | — | — | — | — | — | — | 5.3 | 0.14 | 13 |
| LNU740 | 71242.4 | 0.5 | 0.01 | 35 | 7.3 | L | 85 | 6.3 | L | 34 |
| LNU732 | 71222.2 | 0.5 | 0.20 | 22 | 5.1 | 0.13 | 28 | 5.5 | 0.14 | 17 |
| LNU732 | 71222.4 | 0.5 | 0.11 | 38 | 5.8 | 0.15 | 46 | 5.4 | 0.11 | 16 |
| LNU732 | 71224.5 | 0.7 | L | 81 | 7.8 | L | 98 | 5.8 | 0.03 | 24 |
| LNU732 | 71226.3 | — | — | — | — | — | — | 5.2 | 0.16 | 10 |
| LNU732 | 71226.6 | — | — | — | — | — | — | 5.6 | 0.02 | 20 |
| LNU728 | 71209.3 | 0.5 | 0.11 | 20 | 5.0 | 0.18 | 25 | — | — | — |
| LNU728 | 71209.5 | — | — | — | — | — | — | 5.7 | 0.10 | 21 |
| LNU728 | 71210.2 | 0.5 | L | 37 | 6.3 | 0.04 | 60 | 5.5 | 0.05 | 18 |
| LNU728 | 71214.3 | 0.6 | 0.16 | 50 | 6.7 | 0.15 | 69 | 5.8 | 0.02 | 23 |
| LNU726 | 71203.5 | 0.5 | 0.04 | 31 | 5.4 | 0.07 | 37 | 5.3 | 0.23 | 13 |
| LNU726 | 71204.4 | 0.5 | 0.23 | 16 | 5.2 | 0.11 | 31 | 5.4 | 0.10 | 16 |
| LNU726 | 71205.2 | — | — | — | 5.3 | 0.12 | 33 | 6.0 | L | 29 |
| LNU725 | 71199.1 | 0.5 | 0.06 | 21 | — | — | — | — | — | — |
| LNU725 | 71201.1 | — | — | — | 5.1 | 0.19 | 28 | 5.9 | 0.01 | 26 |
| LNU725 | 71201.5 | 0.6 | L | 50 | 7.1 | L | 80 | 6.4 | L | 35 |
| LNU714 | 71181.2 | 0.5 | 0.22 | 30 | 5.5 | 0.05 | 40 | 5.8 | 0.02 | 24 |
| LNU714 | 71181.6 | 0.5 | 0.05 | 29 | — | — | — | — | — | — |
| LNU714 | 71182.1 | 0.6 | L | 41 | 6.2 | 0.02 | 57 | 6.1 | L | 29 |
| LNU714 | 71183.2 | 0.5 | 0.08 | 19 | 6.1 | L | 53 | 6.1 | L | 31 |
| LNU712 | 71144.2 | 0.5 | 0.20 | 20 | 5.9 | 0.10 | 49 | 6.1 | L | 30 |
| LNU712 | 71144.3 | 0.8 | 0.01 | 100 | 9.2 | L | 131 | 6.6 | L | 42 |
| LNU712 | 71147.1 | — | — | — | 4.8 | 0.18 | 20 | 5.5 | 0.06 | 17 |
| LNU712 | 71147.4 | 0.7 | L | 68 | 8.8 | L | 121 | 6.4 | L | 37 |
| LNU712 | 71148.2 | 0.5 | 0.20 | 34 | — | — | — | — | — | — |
| LNU711 | 71137.2 | 0.5 | 0.09 | 20 | 5.5 | 0.07 | 39 | 5.6 | 0.07 | 19 |
| LNU711 | 71137.5 | — | — | — | 5.0 | 0.09 | 27 | 5.5 | 0.04 | 18 |
| LNU711 | 71139.2 | — | — | — | — | — | — | 5.4 | 0.26 | 14 |
| LNU711 | 71139.3 | 0.5 | 0.11 | 20 | 5.6 | 0.03 | 42 | 6.4 | L | 36 |
| CONT. | — | 0.4 | — | — | 4.0 | — | — | 4.7 | — | — |
| LNU709 | 71498.3 | 0.5 | 0.02 | 31 | 6.4 | 0.11 | 61 | — | — | — |
| LNU709 | 71498.4 | 0.5 | 0.08 | 32 | 6.7 | 0.01 | 67 | 5.7 | 0.03 | 13 |
| LNU709 | 71501.3 | 0.6 | 0.02 | 49 | 6.3 | 0.01 | 57 | 5.6 | 0.27 | 10 |
| LNU693 | 71547.3 | 0.5 | 0.09 | 26 | 5.5 | 0.14 | 38 | — | — | — |
| LNU693 | 71548.6 | 0.5 | 0.06 | 35 | 7.1 | 0.04 | 77 | 6.6 | 0.03 | 29 |
| LNU676 | 71095.2 | 0.5 | 0.16 | 23 | 5.7 | 0.07 | 43 | 5.9 | 0.04 | 15 |
| LNU676 | 71095.3 | — | — | — | — | — | — | 7.3 | L | 43 |
| LNU676 | 71095.4 | 0.6 | 0.17 | 48 | 7.1 | 0.04 | 78 | 6.3 | 0.10 | 23 |
| LNU676 | 71096.4 | — | — | — | — | — | — | 6.6 | 0.14 | 29 |
| LNU676 | 71097.2 | — | — | — | — | — | — | 5.6 | 0.23 | 10 |
| LNU671 | 71091.2 | 0.5 | 0.19 | 24 | 5.6 | 0.08 | 40 | — | — | — |
| LNU671 | 71091.5 | — | — | — | — | — | — | 5.9 | 0.13 | 17 |
| LNU671 | 71094.1 | — | — | — | 5.2 | 0.16 | 30 | 6.6 | L | 30 |
| LNU671 | 71094.5 | 0.5 | 0.04 | 44 | — | — | — | — | — | — |
| LNU659 | 71850.1 | — | — | — | 5.0 | 0.28 | 24 | — | — | — |
| LNU659 | 71853.2 | 0.5 | 0.28 | 22 | 6.0 | L | 50 | — | — | — |
| LNU659 | 71855.5 | 0.5 | L | 33 | 8.0 | L | 100 | 6.5 | L | 28 |

TABLE 73-continued

Genes showing improved plant performance at standard nitrogen growth conditions (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU654 | 71556.1 | 0.5 | 0.16 | 33 | 5.2 | 0.21 | 31 | — | — | — |
| LNU654 | 71557.3 | 0.5 | 0.03 | 33 | 7.0 | L | 76 | 5.9 | 0.02 | 17 |
| LNU654 | 71561.4 | — | — | — | 5.3 | 0.14 | 32 | 7.0 | L | 37 |
| LNU607 | 71592.5 | — | — | — | 5.2 | 0.08 | 31 | 5.9 | 0.17 | 16 |
| LNU607 | 71595.1 | — | — | — | 5.4 | 0.28 | 35 | 6.4 | 0.04 | 25 |
| LNU607 | 71595.3 | 0.4 | 0.26 | 16 | 6.0 | 0.01 | 49 | 5.9 | 0.04 | 16 |
| LNU607 | 71596.1 | — | — | — | 5.4 | 0.26 | 36 | 5.7 | 0.04 | 12 |
| LNU603 | 71612.1 | 0.4 | 0.10 | 17 | 5.0 | 0.03 | 26 | 5.9 | 0.05 | 16 |
| LNU603 | 71612.3 | — | — | — | — | — | — | 6.5 | 0.01 | 28 |
| LNU603 | 71613.2 | — | — | — | 4.9 | 0.25 | 23 | 5.7 | 0.08 | 11 |
| LNU521 | 71598.3 | — | — | — | 6.4 | 0.03 | 59 | 6.6 | 0.05 | 31 |
| LNU521 | 71598.4 | — | — | — | — | — | — | 6.5 | L | 27 |
| LNU521 | 71599.3 | — | — | — | 6.2 | 0.09 | 56 | 6.0 | 0.23 | 17 |
| LNU521 | 71601.3 | 0.4 | 0.28 | 17 | — | — | — | — | — | — |
| LNU521 | 71601.5 | — | — | — | 4.7 | 0.25 | 18 | 6.1 | 0.08 | 20 |
| CONT. | — | 0.4 | — | — | 4.0 | — | — | 5.1 | — | — |
| LNU742 | 71552.2 | 0.4 | 0.25 | 14 | 8.4 | 0.03 | 48 | 7.5 | 0.10 | 11 |
| LNU742 | 71552.4 | — | — | — | 7.9 | 0.07 | 38 | — | — | — |
| LNU742 | 71554.2 | 0.6 | 0.09 | 53 | 9.2 | 0.16 | 62 | — | — | — |
| LNU734 | 71646.5 | 0.7 | 0.03 | 83 | 11.4 | 0.01 | 100 | 7.7 | 0.13 | 13 |
| LNU734 | 71648.2 | 0.5 | 0.05 | 24 | 8.2 | L | 43 | 7.7 | 0.06 | 14 |
| LNU734 | 71648.3 | 0.5 | 0.05 | 29 | 8.0 | L | 40 | — | — | — |
| LNU734 | 71648.5 | 0.5 | 0.04 | 31 | 8.2 | 0.02 | 43 | 7.4 | 0.26 | 9 |
| LNU734 | 71649.1 | — | — | — | — | — | — | 7.4 | 0.16 | 9 |
| LNU715 | 71642.2 | 0.5 | 0.17 | 18 | 7.4 | 0.06 | 30 | — | — | — |
| LNU715 | 71643.1 | 0.7 | 0.07 | 85 | 9.9 | 0.10 | 73 | — | — | — |
| LNU715 | 71643.2 | 0.7 | 0.04 | 71 | 9.1 | 0.04 | 60 | 7.4 | 0.26 | 9 |
| LNU715 | 71643.3 | 0.5 | 0.02 | 32 | 8.8 | 0.05 | 54 | 7.7 | 0.05 | 14 |
| LNU715 | 71645.3 | 0.7 | 0.09 | 73 | 11.2 | L | 96 | 7.5 | 0.18 | 10 |
| LNU567 | 70995.2 | 0.5 | 0.13 | 22 | — | — | — | — | — | — |
| LNU567 | 70995.4 | 0.5 | 0.01 | 36 | 8.4 | L | 46 | — | — | — |
| LNU567 | 70998.3 | 0.5 | 0.06 | 28 | 9.7 | L | 69 | 7.7 | 0.05 | 13 |
| LNU567 | 70998.4 | — | — | — | 8.0 | 0.01 | 40 | 7.4 | 0.17 | 9 |
| CONT. | — | 0.4 | — | — | 5.7 | — | — | 6.8 | — | — |
| LNU722 | 71189.5 | 0.4 | L | 23 | 5.6 | 0.01 | 41 | 7.0 | 0.12 | 13 |
| LNU706 | 71343.2 | 0.4 | 0.20 | 26 | — | — | — | — | — | — |
| LNU706 | 71344.5 | 0.4 | 0.04 | 23 | 5.0 | 0.06 | 26 | — | — | — |
| LNU702 | 71857.3 | 0.4 | 0.24 | 11 | 5.3 | 0.03 | 34 | — | — | — |
| LNU702 | 71858.3 | — | — | — | 5.3 | 0.05 | 34 | — | — | — |
| LNU702 | 71859.3 | 0.5 | 0.06 | 58 | — | — | — | — | — | — |
| LNU702 | 71860.2 | — | — | — | 5.6 | 0.13 | 41 | — | — | — |
| LNU693 | 71546.3 | 0.4 | 0.23 | 17 | — | — | — | — | — | — |
| LNU693 | 71547.3 | 0.5 | L | 66 | 7.0 | L | 76 | — | — | — |
| LNU693 | 71548.6 | 0.6 | 0.02 | 92 | 6.6 | 0.06 | 66 | — | — | — |
| LNU668 | 71415.5 | 0.7 | 0.01 | 111 | 7.5 | 0.04 | 91 | — | — | — |
| LNU668 | 71415.6 | 0.5 | 0.03 | 49 | — | — | — | — | — | — |
| LNU668 | 71416.3 | 0.4 | 0.24 | 28 | — | — | — | — | — | — |
| LNU545 | 72596.1 | 0.5 | 0.02 | 43 | — | — | — | — | — | — |
| LNU545 | 72597.1 | 0.7 | 0.03 | 102 | 7.9 | 0.12 | 99 | — | — | — |
| LNU545 | 72598.1 | 0.4 | L | 28 | 5.5 | 0.04 | 41 | — | — | — |
| CONT. | — | 0.3 | — | — | 3.9 | — | — | 6.2 | — | — |
| LNU627 | 70491.2 | 0.9 | 0.07 | 42 | — | — | — | — | — | — |
| LNU627 | 70491.3 | 0.9 | L | 47 | 9.3 | 0.01 | 36 | — | — | — |
| LNU627 | 70491.5 | 0.7 | 0.06 | 26 | 7.8 | 0.29 | 14 | — | — | — |
| LNU616 | 70504.4 | 0.7 | 0.08 | 16 | — | — | — | — | — | — |
| LNU616 | 70505.2 | — | — | — | — | — | — | 6.9 | 0.16 | 8 |
| LNU595 | 70274.1 | 0.7 | 0.21 | 11 | — | — | — | — | — | — |
| LNU595 | 70274.3 | 0.9 | L | 55 | 9.9 | L | 46 | — | — | — |
| LNU565 | 70623.5 | 0.7 | 0.16 | 15 | — | — | — | — | — | — |
| LNU565 | 70624.3 | — | — | — | — | — | — | 6.6 | 0.30 | 4 |
| LNU565 | 70624.5 | — | — | — | 8.8 | 0.07 | 29 | — | — | — |
| LNU565 | 70626.1 | 0.7 | 0.23 | 19 | 7.9 | 0.14 | 16 | — | — | — |
| LNU542 | 70226.2 | 1.0 | 0.02 | 65 | 9.5 | 0.11 | 38 | — | — | — |
| LNU542 | 70229.3 | 0.7 | 0.25 | 25 | — | — | — | — | — | — |
| LNU537 | 70215.4 | 0.7 | 0.28 | 22 | 8.5 | 0.28 | 25 | — | — | — |
| CONT. | — | 0.6 | — | — | 6.8 | — | — | 6.4 | — | — |
| LNU688 | 72691.3 | 0.5 | 0.15 | 25 | — | — | — | — | — | — |
| LNU688 | 72692.4 | 0.5 | 0.08 | 34 | 9.3 | 0.22 | 25 | — | — | — |
| LNU688 | 72694.3 | 0.5 | 0.11 | 27 | 9.4 | 0.19 | 26 | — | — | — |
| LNU688 | 72694.4 | 0.5 | 0.09 | 28 | 10.4 | 0.08 | 39 | 7.6 | 0.04 | 7 |
| LNU657 | 70334.8 | 0.5 | 0.28 | 20 | — | — | — | — | — | — |

TABLE 73-continued

Genes showing improved plant performance at standard nitrogen growth conditions (T2 generation)

| Gene Name | Event # | Leaf Area [cm²] Ave. | P-Val. | % Incr. | Roots Coverage [cm²] Ave. | P-Val. | % Incr. | Roots Length [cm] Ave. | P-Val. | % Incr. |
|---|---|---|---|---|---|---|---|---|---|---|
| LNU657 | 70336.1 | 0.6 | 0.04 | 52 | 9.4 | 0.24 | 26 | — | — | — |
| LNU645 | 73004.1 | 0.5 | 0.09 | 39 | 10.1 | 0.08 | 36 | — | — | — |
| LNU645 | 73005.4 | 0.5 | 0.16 | 29 | — | — | — | — | — | — |
| LNU645 | 73006.2 | 0.6 | L | 56 | 12.3 | 0.02 | 65 | — | — | — |
| LNU645 | 73008.2 | 0.7 | 0.01 | 75 | 11.6 | 0.01 | 56 | 7.8 | 0.04 | 10 |
| LNU608 | 72997.4 | 0.6 | 0.01 | 45 | 11.1 | 0.04 | 49 | 7.6 | 0.27 | 7 |
| LNU608 | 73000.1 | 0.5 | 0.02 | 36 | 9.9 | 0.09 | 33 | — | — | — |
| LNU588 | 72994.3 | 0.5 | 0.17 | 34 | 10.0 | 0.09 | 34 | — | — | — |
| LNU554 | 70478.2 | 0.6 | L | 64 | 11.6 | L | 56 | 8.0 | 0.02 | 12 |
| LNU554 | 70479.1 | 0.5 | 0.13 | 33 | — | — | — | 7.6 | 0.10 | 6 |
| LNU554 | 70479.3 | — | — | — | — | — | — | 7.5 | 0.12 | 5 |
| LNU554 | 70482.4 | — | — | — | — | — | — | 7.7 | 0.01 | 8 |
| LNU554 | 70483.2 | 0.5 | 0.27 | 20 | — | — | — | — | — | — |
| LNU545 | 72598.1 | 0.6 | 0.01 | 63 | 9.4 | 0.23 | 27 | — | — | — |
| LNU545 | 72599.4 | 0.5 | 0.15 | 25 | — | — | — | — | — | — |
| CONT. | — | 0.4 | — | — | 7.4 | — | — | 7.1 | — | — |
| LNU748 | 72947.3 | 0.4 | 0.16 | 22 | 8.9 | 0.06 | 41 | — | — | — |
| LNU748 | 72948.5 | 0.4 | 0.29 | 17 | — | — | — | — | — | — |
| LNU747 | 70619.4 | 0.4 | 0.13 | 25 | — | — | — | — | — | — |
| LNU746 | 72964.3 | 0.5 | 0.08 | 30 | 7.9 | 0.25 | 24 | 7.4 | 0.07 | 12 |
| LNU746 | 72966.2 | 0.5 | 0.06 | 32 | — | — | — | — | — | — |
| LNU688 | 72691.3 | 0.6 | 0.18 | 64 | — | — | — | — | — | — |
| LNU688 | 72692.3 | 0.6 | 0.02 | 68 | 10.1 | 0.04 | 60 | 7.4 | 0.08 | 12 |
| LNU645 | 73005.4 | 0.5 | 0.06 | 32 | — | — | — | — | — | — |
| LNU636_H1 | 72937.3 | 0.5 | 0.24 | 28 | — | — | — | — | — | — |
| LNU636_H1 | 72939.3 | — | — | — | — | — | — | 7.3 | 0.22 | 11 |
| LNU636_H1 | 72942.2 | 0.5 | 0.10 | 51 | 9.0 | 0.16 | 42 | 7.1 | 0.18 | 8 |
| LNU608 | 72997.2 | — | — | — | 8.2 | 0.20 | 29 | — | — | — |
| LNU608 | 72997.4 | — | — | — | 8.2 | 0.17 | 30 | 7.9 | 0.06 | 21 |
| LNU585 | 72913.3 | 0.5 | 0.11 | 32 | 8.7 | 0.26 | 37 | — | — | — |
| LNU585 | 72914.2 | 0.5 | 0.01 | 46 | 7.9 | 0.27 | 24 | — | — | — |
| LNU585 | 72915.1 | 0.5 | 0.10 | 41 | 9.6 | 0.09 | 51 | — | — | — |
| LNU585 | 72917.3 | 0.6 | L | 74 | 10.6 | 0.02 | 68 | 7.8 | 0.01 | 18 |
| CONT. | — | 0.4 | — | — | 6.3 | — | — | 6.6 | — | — |
| LNU710 | 70712.3 | 0.6 | 0.13 | 41 | 6.6 | 0.19 | 36 | 6.0 | 0.10 | 10 |
| LNU710 | 70712.5 | 0.5 | 0.09 | 10 | 5.3 | 0.27 | 9 | 6.2 | L | 13 |
| LNU710 | 70715.1 | 0.6 | 0.16 | 43 | 6.3 | 0.28 | 31 | — | — | — |
| LNU710 | 70715.2 | 0.5 | 0.01 | 21 | — | — | — | 6.1 | 0.08 | 12 |
| LNU710 | 70716.1 | — | — | — | — | — | — | 5.9 | 0.22 | 8 |
| LNU705 | 70604.2 | 0.6 | 0.09 | 23 | — | — | — | — | — | — |
| LNU705 | 70607.3 | 0.6 | 0.11 | 44 | 7.6 | 0.18 | 57 | 6.6 | 0.02 | 21 |
| LNU705 | 70607.4 | — | — | — | 5.6 | 0.22 | 16 | 5.9 | 0.03 | 8 |
| LNU639 | 70869.2 | 0.7 | L | 62 | 7.9 | 0.02 | 63 | 6.4 | L | 16 |
| LNU639 | 70871.4 | 0.5 | 0.22 | 6 | — | — | — | — | — | — |
| LNU635 | 70784.2 | 0.6 | 0.04 | 25 | — | — | — | — | — | — |
| LNU635 | 70784.3 | 1.0 | L | 113 | 9.1 | L | 89 | 6.0 | 0.10 | 10 |
| LNU635 | 70784.4 | 0.6 | 0.26 | 30 | — | — | — | — | — | — |
| LNU635 | 70786.4 | 0.7 | 0.12 | 46 | 7.0 | 0.19 | 46 | — | — | — |
| LNU589 | 70707.2 | 0.6 | 0.04 | 28 | — | — | — | — | — | — |
| LNU580 | 70851.4 | 0.7 | 0.05 | 53 | 6.9 | 0.05 | 42 | 6.8 | L | 25 |
| LNU580 | 70855.4 | 0.5 | 0.24 | 10 | — | — | — | — | — | — |
| LNU549 | 70719.1 | 0.5 | 0.01 | 16 | 5.9 | 0.21 | 22 | 6.2 | 0.10 | 14 |
| LNU549 | 70719.2 | — | — | — | — | — | — | 5.8 | 0.26 | 7 |
| LNU549 | 70720.2 | 0.5 | 0.26 | 11 | — | — | — | 6.4 | L | 17 |
| LNU549 | 70723.2 | 0.7 | 0.02 | 58 | 8.0 | 0.04 | 66 | 6.5 | 0.04 | 18 |
| LNU543 | 70828.4 | — | — | — | — | — | — | 6.2 | 0.08 | 14 |
| LNU524 | 70808.4 | 0.5 | 0.12 | 13 | 5.4 | 0.26 | 12 | 5.9 | 0.17 | 8 |
| LNU524 | 70809.1 | 0.6 | 0.12 | 38 | 6.8 | 0.12 | 42 | 6.1 | 0.03 | 11 |
| LNU524 | 70809.2 | 0.5 | 0.24 | 13 | 6.0 | 0.22 | 23 | 6.3 | L | 16 |
| CONT. | — | 0.5 | — | — | 4.8 | — | — | 5.5 | — | — |
| LNU729 | 71517.4 | 0.5 | L | 44 | 7.8 | L | 58 | 7.1 | 0.03 | 16 |
| LNU729 | 71518.2 | 0.6 | L | 66 | 9.4 | L | 90 | 7.5 | L | 22 |
| LNU729 | 71519.4 | 0.5 | 0.11 | 47 | 6.7 | 0.20 | 36 | 6.9 | 0.09 | 12 |
| LNU719 | 71540.3 | 0.5 | L | 43 | 7.2 | 0.04 | 45 | 6.8 | 0.08 | 10 |
| LNU719 | 71542.3 | 0.6 | 0.11 | 63 | — | — | — | — | — | — |
| LNU719 | 71543.1 | 0.4 | 0.13 | 13 | — | — | — | — | — | — |
| LNU719 | 71543.8 | 0.5 | L | 42 | 6.9 | 0.08 | 39 | 6.7 | 0.07 | 10 |
| LNU718 | 71504.1 | 0.6 | L | 75 | 9.1 | L | 84 | 7.3 | L | 18 |
| LNU718 | 71504.6 | 0.5 | 0.03 | 45 | 7.3 | 0.01 | 47 | 7.0 | 0.06 | 15 |
| LNU718 | 71506.2 | 0.5 | 0.23 | 28 | — | — | — | — | — | — |
| LNU718 | 71507.2 | 0.5 | 0.08 | 42 | — | — | — | — | — | — |

TABLE 73-continued

Genes showing improved plant performance at standard nitrogen growth conditions (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU709 | 71498.4 | 0.7 | 0.02 | 86 | 9.2 | 0.03 | 86 | 7.1 | 0.09 | 16 |
| LNU709 | 71499.2 | 0.5 | 0.19 | 30 | — | — | — | — | — | — |
| LNU709 | 71501.3 | 0.6 | 0.01 | 55 | 8.1 | 0.01 | 63 | 7.2 | L | 18 |
| LNU709 | 71501.4 | 0.5 | 0.06 | 30 | — | — | — | — | — | — |
| LNU693 | 71546.2 | 0.5 | 0.10 | 42 | 7.1 | 0.04 | 43 | 6.7 | 0.23 | 8 |
| LNU693 | 71547.3 | 0.6 | L | 55 | 7.1 | 0.07 | 43 | — | — | — |
| LNU693 | 71547.5 | 0.5 | 0.06 | 39 | 8.7 | 0.01 | 75 | 7.4 | 0.01 | 21 |
| LNU693 | 71548.6 | 0.8 | L | 106 | 9.1 | 0.03 | 85 | — | — | — |
| LNU654 | 71557.1 | 0.5 | 0.04 | 27 | 7.5 | L | 52 | 6.8 | 0.23 | 11 |
| LNU654 | 71557.3 | 0.6 | L | 52 | 7.0 | 0.12 | 41 | — | — | — |
| LNU654 | 71559.2 | 0.4 | 0.13 | 17 | — | — | — | — | — | — |
| LNU654 | 71561.4 | 0.6 | 0.04 | 66 | 7.9 | 0.17 | 61 | 6.7 | 0.23 | 9 |
| LNU607 | 71592.5 | 0.7 | L | 91 | 9.6 | L | 94 | 7.3 | L | 19 |
| LNU607 | 71595.1 | — | — | — | — | — | — | 6.7 | 0.12 | 9 |
| LNU607 | 71595.3 | 0.6 | 0.09 | 58 | 8.6 | 0.05 | 75 | 7.3 | L | 19 |
| LNU603 | 71610.5 | 0.7 | L | 100 | 10.1 | L | 105 | 7.3 | L | 19 |
| LNU603 | 71612.3 | 0.5 | L | 32 | 8.4 | L | 71 | 7.0 | 0.01 | 14 |
| LNU603 | 71613.2 | 0.4 | 0.24 | 16 | — | — | — | 6.8 | 0.06 | 11 |
| LNU603 | 71613.6 | 0.6 | L | 70 | 7.9 | 0.01 | 59 | 7.1 | 0.03 | 16 |
| LNU521 | 71598.3 | 0.5 | L | 48 | 8.4 | L | 71 | 7.3 | 0.02 | 18 |
| LNU521 | 71598.4 | — | — | — | — | — | — | 6.8 | 0.29 | 12 |
| LNU521 | 71599.3 | — | — | — | — | — | — | 7.0 | 0.02 | 14 |
| LNU521 | 71601.3 | 0.4 | 0.28 | 18 | — | — | — | — | — | — |
| LNU521 | 71601.5 | 0.5 | 0.08 | 24 | 6.6 | 0.23 | 34 | 6.9 | 0.20 | 12 |
| CONT. | — | 0.4 | — | — | 4.9 | — | — | 6.1 | — | — |
| LNU708 | 71797.2 | 0.4 | 0.22 | 12 | — | — | — | — | — | — |
| LNU708 | 71797.3 | 0.6 | L | 49 | — | — | — | — | — | — |
| LNU708 | 71798.4 | 0.5 | 0.19 | 24 | — | — | — | — | — | — |
| LNU708 | 71800.1 | 0.5 | 0.08 | 41 | — | — | — | — | — | — |
| LNU649 | 71059.1 | 0.5 | 0.11 | 45 | 8.0 | 0.23 | 44 | 6.4 | 0.24 | 9 |
| LNU649 | 71063.1 | 0.6 | 0.02 | 52 | — | — | — | — | — | — |
| LNU649 | 71064.2 | 0.5 | 0.03 | 26 | — | — | — | — | — | — |
| LNU648 | 71023.3 | — | — | — | — | — | — | 6.7 | 0.08 | 13 |
| LNU648 | 71024.4 | 0.5 | 0.14 | 24 | — | — | — | — | — | — |
| LNU648 | 71026.1 | 0.6 | 0.01 | 58 | — | — | — | — | — | — |
| LNU634 | 71013.4 | 0.4 | 0.25 | 19 | 8.3 | 0.19 | 48 | — | — | — |
| LNU634 | 71016.3 | 0.5 | 0.03 | 25 | 7.8 | 0.05 | 39 | 6.9 | 0.04 | 16 |
| LNU622 | 70999.3 | — | — | — | 6.9 | 0.18 | 24 | 6.9 | 0.05 | 17 |
| LNU622 | 71003.3 | 0.6 | 0.02 | 56 | 9.2 | L | 64 | 7.0 | 0.05 | 18 |
| LNU622 | 71004.2 | 0.5 | 0.03 | 35 | 8.2 | 0.12 | 46 | 7.4 | 0.04 | 25 |
| LNU591 | 71283.1 | 0.6 | 0.07 | 65 | — | — | — | — | — | — |
| LNU591 | 71283.3 | 0.5 | L | 38 | — | — | — | — | — | — |
| LNU591 | 71286.1 | 0.4 | 0.24 | 14 | — | — | — | — | — | — |
| LNU581 | 71305.7 | 0.6 | 0.09 | 52 | — | — | — | — | — | — |
| LNU581 | 71306.1 | 0.5 | L | 39 | — | — | — | — | — | — |
| LNU574 | 71790.4 | 0.6 | L | 67 | 10.4 | L | 86 | 7.3 | L | 23 |
| LNU574 | 71791.2 | 0.5 | 0.02 | 26 | — | — | — | — | — | — |
| LNU574 | 71792.3 | 0.5 | 0.06 | 25 | — | — | — | — | — | — |
| CONT. | — | 0.4 | — | — | 5.6 | — | — | 5.9 | — | — |
| LNU676 | 71096.4 | — | — | — | — | — | — | 7.6 | 0.29 | 8 |
| LNU671 | 71094.5 | 0.7 | 0.24 | 17 | 10.7 | L | 42 | 8.0 | 0.05 | 14 |
| LNU671 | 71094.6 | — | — | — | — | — | — | 7.6 | 0.19 | 9 |
| LNU649 | 71062.1 | — | — | — | 10.9 | 0.20 | 44 | — | — | — |
| LNU649 | 71064.2 | 0.7 | 0.14 | 25 | — | — | — | — | — | — |
| LNU622 | 71003.4 | 0.7 | 0.11 | 26 | 11.1 | 0.06 | 48 | 7.9 | 0.06 | 13 |
| LNU581 | 71305.7 | — | — | — | 9.2 | 0.21 | 22 | 7.6 | 0.26 | 9 |
| LNU581 | 71306.1 | 0.7 | 0.16 | 24 | 11.3 | 0.04 | 50 | 7.8 | 0.15 | 11 |
| CONT. | — | 0.6 | — | — | 7.5 | — | — | 7.0 | — | — |
| LNU735 | 71872.2 | — | — | — | 8.7 | 0.28 | 12 | — | — | — |
| LNU735 | 71873.2 | 0.6 | 0.21 | 39 | — | — | — | — | — | — |
| LNU735 | 71873.5 | 0.6 | 0.19 | 34 | 10.1 | 0.07 | 30 | — | — | — |
| LNU713 | 71862.1 | 0.5 | 0.13 | 21 | — | — | — | — | — | — |
| LNU689 | 71778.3 | 0.6 | L | 48 | 13.4 | 0.03 | 72 | — | — | — |
| LNU689 | 71779.6 | 0.6 | 0.11 | 42 | — | — | — | — | — | — |
| LNU688 | 72692.4 | 0.6 | 0.16 | 35 | 9.8 | 0.26 | 26 | — | — | — |
| LNU669 | 70391.1 | 0.5 | 0.12 | 23 | — | — | — | — | — | — |
| LNU669 | 70393.1 | 0.6 | 0.17 | 30 | 10.6 | 0.15 | 36 | — | — | — |
| LNU611 | 72698.2 | — | — | — | 8.9 | 0.23 | 14 | — | — | — |
| LNU546 | 72584.3 | 0.6 | 0.01 | 39 | 11.5 | L | 48 | — | — | — |
| LNU546 | 72586.1 | 0.5 | 0.19 | 16 | 9.6 | 0.05 | 23 | — | — | — |
| LNU533 | 71826.1 | 0.5 | 0.09 | 15 | — | — | — | — | — | — |

TABLE 73-continued

Genes showing improved plant performance at standard nitrogen growth conditions (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | 0.4 | — | — | 7.8 | — | — | — | — | — |
| LNU710 | 70712.5 | 0.5 | 0.10 | 22 | — | — | — | — | — | — |
| LNU710 | 70712.6 | 0.6 | L | 33 | 8.3 | L | 42 | — | — | — |
| LNU710 | 70715.2 | 0.7 | L | 65 | 8.1 | 0.07 | 39 | 6.7 | 0.22 | 8 |
| LNU710 | 70716.1 | — | — | — | — | — | — | 7.1 | L | 13 |
| LNU705 | 70604.2 | 0.5 | 0.06 | 22 | 8.9 | L | 53 | 7.3 | L | 17 |
| LNU705 | 70604.4 | 0.5 | 0.04 | 19 | 7.6 | 0.02 | 30 | 7.3 | L | 17 |
| LNU705 | 70607.3 | 0.6 | 0.15 | 32 | 7.3 | 0.14 | 26 | — | — | — |
| LNU639 | 70871.3 | 0.6 | 0.03 | 31 | 8.2 | 0.07 | 40 | 6.7 | 0.28 | 7 |
| LNU639 | 70872.4 | 0.5 | 0.18 | 16 | — | — | — | — | — | — |
| LNU639 | 70873.2 | 0.6 | 0.24 | 33 | — | — | — | — | — | — |
| LNU635 | 70784.2 | 0.5 | 0.17 | 10 | — | — | — | — | — | — |
| LNU635 | 70784.4 | 0.5 | L | 23 | — | — | — | — | — | — |
| LNU635 | 70786.4 | — | — | — | — | — | — | 6.8 | 0.11 | 9 |
| LNU635 | 70787.3 | 0.5 | 0.20 | 17 | 7.6 | 0.08 | 31 | — | — | — |
| LNU580 | 70851.2 | 0.5 | L | 21 | — | — | — | 6.6 | 0.25 | 6 |
| LNU580 | 70851.4 | — | — | — | — | — | — | 6.8 | 0.09 | 9 |
| LNU580 | 70853.2 | 0.5 | 0.13 | 19 | — | — | — | — | — | — |
| LNU580 | 70855.3 | 0.5 | 0.06 | 30 | 7.9 | 0.08 | 35 | 7.1 | L | 14 |
| LNU580 | 70855.4 | 0.5 | 0.17 | 16 | — | — | — | — | — | — |
| LNU549 | 70723.2 | 0.5 | 0.03 | 18 | — | — | — | — | — | — |
| LNU543 | 70826.1 | — | — | — | 7.0 | 0.06 | 21 | 7.2 | L | 15 |
| LNU543 | 70827.1 | 0.6 | 0.04 | 48 | 7.7 | 0.16 | 32 | — | — | — |
| LNU543 | 70828.1 | 0.5 | 0.22 | 11 | — | — | — | — | — | — |
| LNU543 | 70828.4 | 0.6 | L | 47 | 9.7 | L | 67 | 7.3 | L | 18 |
| LNU524 | 70808.1 | 0.5 | 0.01 | 22 | 9.1 | L | 55 | 7.2 | L | 16 |
| LNU524 | 70809.2 | 0.5 | 0.27 | 18 | — | — | — | 6.9 | 0.19 | 11 |
| CONT. | — | 0.4 | — | — | 5.8 | — | — | 6.2 | — | — |
| LNU748 | 72945.1 | 0.6 | 0.06 | 48 | 8.3 | 0.14 | 31 | 7.5 | 0.06 | 13 |
| LNU748 | 72945.2 | 0.6 | L | 49 | 10.4 | 0.01 | 65 | 8.0 | L | 20 |
| LNU748 | 72947.3 | — | — | — | 9.8 | 0.03 | 55 | 7.6 | 0.02 | 15 |
| LNU746 | 72962.2 | 0.6 | 0.01 | 52 | 9.8 | 0.03 | 55 | 7.4 | 0.10 | 11 |
| LNU746 | 72966.3 | 0.5 | 0.03 | 36 | 9.7 | 0.03 | 54 | 7.7 | 0.03 | 15 |
| LNU745 | 70911.1 | 0.5 | 0.02 | 40 | 8.7 | 0.12 | 37 | — | — | — |
| LNU745 | 70911.4 | — | — | — | 9.2 | 0.08 | 46 | — | — | — |
| LNU745 | 70914.2 | 0.5 | 0.26 | 34 | — | — | — | — | — | — |
| LNU745 | 70914.4 | 0.6 | 0.17 | 66 | 10.9 | 0.26 | 72 | 7.6 | 0.04 | 14 |
| LNU739 | 71630.1 | 0.5 | 0.09 | 28 | 10.0 | 0.02 | 59 | 8.0 | L | 20 |
| LNU739 | 71630.3 | 0.5 | 0.03 | 30 | 8.2 | 0.10 | 30 | 8.0 | L | 20 |
| LNU739 | 71631.3 | 0.7 | 0.12 | 75 | 11.9 | 0.07 | 89 | 8.2 | 0.01 | 23 |
| LNU636_H1 | 72937.3 | — | — | — | — | — | — | 7.2 | 0.28 | 9 |
| LNU636_H1 | 72940.1 | 0.7 | 0.06 | 95 | 13.0 | 0.04 | 106 | 7.6 | 0.13 | 13 |
| LNU636_H1 | 72942.1 | — | — | — | 9.2 | 0.02 | 45 | 7.4 | 0.05 | 11 |
| LNU636_H1 | 72942.2 | 0.5 | 0.12 | 44 | 9.9 | 0.05 | 57 | — | — | — |
| LNU590 | 70264.2 | — | — | — | 7.9 | 0.18 | 25 | — | — | — |
| LNU590 | 70267.4 | 0.6 | 0.15 | 52 | 9.0 | 0.07 | 42 | 7.7 | 0.04 | 15 |
| LNU585 | 72913.3 | 0.6 | L | 50 | 10.2 | L | 62 | 7.8 | 0.02 | 17 |
| LNU585 | 72915.1 | 0.6 | L | 55 | 12.1 | L | 92 | 7.9 | L | 19 |
| LNU585 | 72917.1 | — | — | — | — | — | — | 7.4 | 0.06 | 11 |
| LNU585 | 72917.3 | — | — | — | — | — | — | 7.4 | 0.09 | 11 |
| LNU556 | 72363.2 | 0.6 | 0.05 | 71 | 10.7 | 0.11 | 70 | 7.4 | 0.11 | 11 |
| LNU556 | 72364.2 | — | — | — | — | — | — | 7.1 | 0.29 | 6 |
| LNU545 | 72595.2 | 0.6 | 0.04 | 47 | 10.6 | L | 68 | — | — | — |
| LNU545 | 72596.1 | 0.5 | 0.30 | 26 | — | — | — | — | — | — |
| LNU545 | 72597.1 | — | — | — | — | — | — | 7.7 | 0.04 | 15 |
| LNU545 | 72598.1 | 0.5 | 0.06 | 42 | 8.8 | 0.19 | 39 | — | — | — |
| CONT. | — | 0.4 | — | — | 6.3 | — | — | 6.7 | — | — |
| LNU696 | 70599.4 | 0.6 | L | 43 | 6.0 | 0.20 | 23 | — | — | — |
| LNU696 | 70600.3 | 0.5 | L | 39 | — | — | — | — | — | — |
| LNU696 | 70600.4 | 0.6 | 0.02 | 46 | 5.8 | 0.12 | 18 | — | — | — |
| LNU686 | 70689.2 | 0.5 | 0.05 | 23 | — | — | — | — | — | — |
| LNU686 | 70689.4 | 0.6 | 0.02 | 53 | — | — | — | — | — | — |
| LNU686 | 70689.5 | 0.5 | L | 25 | — | — | — | — | — | — |
| LNU686 | 70690.1 | 0.5 | 0.26 | 20 | — | — | — | — | — | — |
| LNU686 | 70690.5 | 0.5 | 0.22 | 19 | — | — | — | — | — | — |
| LNU627 | 70490.2 | 0.5 | 0.14 | 28 | — | — | — | — | — | — |
| LNU627 | 70491.3 | 0.5 | 0.20 | 35 | — | — | — | — | — | — |
| LNU627 | 70491.5 | 0.6 | 0.03 | 59 | 6.1 | 0.29 | 25 | — | — | — |
| LNU627 | 70493.5 | 0.5 | 0.03 | 22 | — | — | — | — | — | — |
| LNU616 | 70505.3 | 0.5 | L | 29 | — | — | — | — | — | — |
| LNU595 | 70274.3 | 0.5 | 0.21 | 18 | — | — | — | — | — | — |

TABLE 73-continued

Genes showing improved plant performance at standard nitrogen growth conditions (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU595 | 70276.1 | 0.5 | 0.27 | 28 | — | — | — | — | — | — |
| LNU595 | 70277.1 | 0.4 | 0.20 | 13 | — | — | — | — | — | — |
| LNU595 | 70278.1 | 0.5 | 0.07 | 29 | — | — | — | — | — | — |
| LNU565 | 70623.5 | 0.5 | 0.03 | 21 | — | — | — | — | — | — |
| LNU565 | 70624.3 | 0.4 | 0.19 | 11 | — | — | — | — | — | — |
| LNU565 | 70624.5 | — | — | — | 8.7 | 0.01 | 78 | — | — | — |
| LNU565 | 70626.4 | 0.5 | 0.06 | 28 | — | — | — | — | — | — |
| LNU542 | 70226.1 | 0.5 | L | 28 | — | — | — | — | — | — |
| LNU542 | 70229.7 | 0.5 | L | 30 | — | — | — | — | — | — |
| LNU542 | 70230.2 | 0.5 | 0.14 | 25 | — | — | — | — | — | — |
| LNU539 | 70220.1 | 0.5 | L | 26 | — | — | — | — | — | — |
| LNU539 | 70221.2 | 0.5 | 0.03 | 20 | — | — | — | — | — | — |
| LNU539 | 70225.3 | 0.6 | 0.01 | 44 | 5.8 | 0.11 | 18 | — | — | — |
| LNU537 | 70215.4 | 0.7 | L | 81 | 9.0 | L | 84 | 6.4 | L | 14 |
| LNU537 | 70217.2 | 0.7 | L | 75 | 8.0 | L | 62 | 6.4 | 0.06 | 13 |
| LNU537 | 70217.4 | 0.5 | 0.15 | 29 | — | — | — | — | — | — |
| LNU537 | 70218.2 | 0.6 | L | 41 | 6.0 | 0.05 | 22 | — | — | — |
| CONT. | — | 0.4 | — | — | 4.9 | — | — | 5.6 | — | — |
| LNU742 | 71555.2 | 0.5 | 0.25 | 20 | — | — | — | — | — | — |
| LNU734 | 71646.5 | — | — | — | 9.0 | 0.20 | 36 | 7.8 | L | 15 |
| LNU734 | 71648.2 | 0.7 | 0.24 | 61 | 10.6 | 0.21 | 60 | 7.7 | 0.03 | 13 |
| LNU734 | 71649.1 | 0.5 | 0.06 | 21 | 9.2 | 0.08 | 39 | 7.8 | L | 15 |
| LNU729 | 71517.4 | 0.6 | 0.16 | 43 | — | — | — | — | — | — |
| LNU729 | 71517.6 | 0.5 | 0.17 | 17 | — | — | — | — | — | — |
| LNU729 | 71518.2 | — | — | — | — | — | — | 7.6 | 0.03 | 11 |
| LNU729 | 71519.4 | 0.5 | 0.11 | 22 | 8.5 | 0.15 | 28 | — | — | — |
| LNU729 | 71519.6 | 0.6 | 0.23 | 39 | 10.4 | 0.16 | 57 | 7.7 | 0.03 | 13 |
| LNU719 | 71542.3 | 0.6 | 0.20 | 33 | 9.7 | 0.15 | 46 | 8.0 | L | 17 |
| LNU719 | 71543.8 | — | — | — | — | — | — | 7.2 | 0.07 | 7 |
| LNU708 | 71797.2 | 0.5 | 0.09 | 13 | 8.4 | 0.13 | 26 | 7.9 | L | 17 |
| LNU708 | 71798.3 | 0.5 | 0.23 | 15 | — | — | — | — | — | — |
| LNU708 | 71798.4 | — | — | — | 9.1 | 0.14 | 37 | 7.9 | L | 16 |
| LNU708 | 71801.5 | 0.7 | 0.06 | 55 | 12.0 | 0.02 | 81 | 8.0 | L | 18 |
| LNU659 | 71850.2 | 0.5 | 0.11 | 17 | 8.2 | 0.08 | 23 | 7.5 | 0.03 | 11 |
| LNU659 | 71853.3 | 0.5 | 0.08 | 27 | — | — | — | — | — | — |
| LNU574 | 71790.2 | — | — | — | 10.5 | 0.25 | 58 | 7.9 | 0.03 | 16 |
| LNU574 | 71790.4 | — | — | — | — | — | — | 7.5 | 0.06 | 11 |
| LNU574 | 71791.2 | 0.5 | 0.07 | 16 | 8.1 | 0.12 | 22 | 7.6 | 0.11 | 12 |
| LNU574 | 71791.4 | — | — | — | 7.6 | 0.22 | 14 | 7.7 | 0.01 | 13 |
| LNU574 | 71792.3 | 0.6 | 0.12 | 33 | 8.6 | 0.06 | 30 | — | — | — |
| CONT. | — | 0.4 | — | — | 6.6 | — | — | 6.8 | — | — |
| LNU739 | 71630.1 | 0.6 | L | 44 | — | — | — | — | — | — |
| LNU739 | 71630.4 | 0.5 | 0.09 | 28 | 7.6 | 0.02 | 58 | 6.4 | 0.05 | 24 |
| LNU715 | 71642.2 | 0.5 | 0.06 | 33 | — | — | — | — | — | — |
| LNU715 | 71643.2 | 0.5 | 0.05 | 24 | — | — | — | — | — | — |
| LNU715 | 71643.3 | 0.5 | 0.13 | 14 | 5.5 | 0.19 | 15 | 5.8 | 0.05 | 13 |
| LNU715 | 71645.3 | 0.6 | L | 43 | 7.0 | 0.22 | 46 | — | — | — |
| LNU653 | 70658.3 | 0.5 | 0.03 | 28 | 6.4 | 0.20 | 34 | — | — | — |
| LNU653 | 70659.4 | 0.5 | 0.05 | 23 | — | — | — | — | — | — |
| LNU638 | 72139.2 | 0.5 | 0.24 | 12 | — | — | — | — | — | — |
| LNU638 | 72142.1 | 0.5 | 0.02 | 34 | 8.0 | 0.10 | 67 | 6.2 | 0.15 | 21 |
| LNU638 | 72142.3 | 0.6 | L | 50 | — | — | — | — | — | — |
| LNU638 | 72144.1 | 0.5 | L | 34 | — | — | — | — | — | — |
| LNU637 | 71664.2 | 0.5 | 0.10 | 16 | — | — | — | — | — | — |
| LNU637 | 71667.1 | 0.5 | 0.06 | 34 | — | — | — | — | — | — |
| LNU637 | 71669.5 | 0.6 | 0.05 | 40 | 8.7 | 0.23 | 82 | — | — | — |
| LNU637 | 71669.6 | 0.4 | 0.29 | 9 | — | — | — | — | — | — |
| LNU618 | 72133.2 | 0.5 | 0.12 | 32 | 6.6 | 0.13 | 38 | 5.8 | 0.19 | 14 |
| LNU559 | 70832.4 | 0.6 | L | 41 | 5.6 | 0.27 | 16 | — | — | — |
| LNU559 | 70834.1 | 0.6 | L | 37 | 6.0 | 0.11 | 26 | — | — | — |
| LNU559 | 70835.1 | 0.6 | 0.19 | 41 | — | — | — | — | — | — |
| LNU559 | 70835.4 | 0.5 | 0.05 | 30 | 7.5 | 0.16 | 56 | — | — | — |
| LNU559 | 70837.2 | 0.5 | 0.05 | 17 | 5.8 | 0.26 | 21 | — | — | — |
| CONT. | — | 0.4 | — | — | 4.8 | — | — | 5.1 | — | — |
| LNU688 | 72694.4 | 0.6 | 0.06 | 27 | 11.8 | 0.16 | 38 | 8.3 | 0.14 | 5 |
| LNU661 | 72705.3 | 0.7 | L | 43 | 10.9 | 0.11 | 28 | — | — | — |
| LNU661 | 72707.2 | 0.7 | 0.02 | 56 | 12.7 | 0.03 | 49 | — | — | — |
| LNU611 | 72698.2 | — | — | — | 12.7 | 0.01 | 49 | 8.3 | 0.14 | 5 |
| LNU573 | 72590.1 | — | — | — | — | — | — | 8.3 | 0.26 | 4 |
| LNU573 | 72592.1 | 0.6 | 0.10 | 37 | 10.8 | 0.09 | 27 | 8.3 | 0.10 | 4 |
| LNU531 | 70212.1 | 0.6 | 0.12 | 28 | — | — | — | — | — | — |

TABLE 73-continued

Genes showing improved plant performance at standard nitrogen growth conditions (T2 generation)

| Gene Name | Event # | Leaf Area [cm$^2$] | | | Roots Coverage [cm$^2$] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU522 | 70802.1 | 0.6 | 0.04 | 29 | — | — | — | — | — | — |
| CONT. | — | 0.5 | — | — | 8.5 | — | — | 7.9 | — | — |

Table 73:
"CONT."—Control;
"Ave."—Average;
"% Incr." = % increment;
"p-val."—p-value;
L means that p-value is less than 0.01, p < 0.1 was considered as significant.

TABLE 74

Genes showing improved plant performance at standard nitrogen growth conditions (T1 generation)

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| LNU585 | 8.0 | 0.13 | 15 | — | — | — |
| CONT. | 7.0 | — | — | — | — | — |
| LNU667 | 7.0 | 0.24 | 17 | — | — | — |
| CONT. | 6.0 | — | — | — | — | — |
| LNU611 | 6.9 | 0.14 | 22 | 175.2 | L | 37 |
| LNU585 | 8.1 | 0.07 | 43 | 173.1 | 0.07 | 35 |
| LNU545 | — | — | — | 163.2 | 0.12 | 28 |
| CONT. | 5.7 | — | — | 127.9 | — | — |

Table 74:
"CONT."—Control;
"Ave."—Average;
"% Incr." = % increment;
"p-val."—p-value;
L means that p- value is less than 0.01, p < 0.1 was considered as significant.

TABLE 75

Genes showing improved plant performance at standard nitrogen growth conditions (T1 generation)

| Gene Name | Leaf Area [cm$^2$] | | | Roots Coverage [cm$^2$] | | | Roots Length [cm] | | |
|---|---|---|---|---|---|---|---|---|---|
| | Ave. | P-Val. | % Incr. | Ave. | P-Val. | % Incr. | Ave. | P-Val. | % Incr. |
| LNU583 | — | — | — | 6.3 | 0.12 | 33 | 6.2 | 0.04 | 27 |
| CONT. | — | — | — | 4.7 | — | — | 4.9 | — | — |
| LNU667 | 0.6 | 0.25 | 14 | — | — | — | — | — | — |
| CONT. | 0.5 | — | — | — | — | — | — | — | — |
| LNU611 | 0.7 | 0.19 | 15 | — | — | — | — | — | — |
| LNU585 | 0.7 | 0.13 | 28 | 8.0 | L | 47 | 6.7 | 0.09 | 22 |
| LNU545 | 0.7 | 0.27 | 26 | — | — | — | — | — | — |
| CONT. | 0.6 | — | — | 5.4 | — | — | 5.5 | — | — |

Table 75:
"CONT."—Control;
"Ave."—Average;
"% Incr." = % increment;
"p-val."—p-value;
L means that p-value is less than 0.01, p < 0.1 was considered as significant.

The genes listed in Tables 76-77 improved plant relative growth rate (RGR of leaf area, root length and root coverage) when grown at standard nitrogen concentration levels. These genes produced plants that grew faster than control plants when grown under standard nitrogen growth conditions. Faster growth was observed when growth rate of leaf area, root length and root coverage was measured.

TABLE 76

Genes showing improved growth rate at standard nitrogen growth conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU741 | 71248.4 | — | — | — | 0.8 | 0.13 | 35 | — | — | — |
| LNU741 | 71249.3 | — | — | — | — | — | — | 0.7 | 0.02 | 22 |
| LNU740 | 71242.6 | — | — | — | — | — | — | 0.6 | 0.04 | 17 |
| LNU732 | 71226.3 | — | — | — | — | — | — | 0.6 | 0.18 | 12 |
| LNU732 | 71226.6 | — | — | — | 0.7 | 0.13 | 26 | 0.6 | 0.05 | 16 |
| LNU728 | 71209.5 | 0.1 | 0.22 | 26 | 0.8 | 0.05 | 43 | 0.6 | 0.06 | 20 |
| LNU728 | 71210.2 | — | — | — | 0.8 | 0.12 | 29 | 0.7 | 0.02 | 23 |
| LNU728 | 71214.6 | — | — | — | — | — | — | 0.6 | 0.29 | 12 |
| LNU725 | 71198.4 | — | — | — | — | — | — | 0.6 | 0.13 | 14 |
| LNU725 | 71199.3 | — | — | — | — | — | — | 0.6 | 0.20 | 13 |
| LNU725 | 71199.4 | — | — | — | 0.7 | 0.18 | 26 | — | — | — |
| LNU725 | 71201.1 | — | — | — | 0.8 | 0.08 | 35 | 0.6 | 0.18 | 16 |

TABLE 76-continued

Genes showing improved growth rate at standard nitrogen growth conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU714 | 71181.2 | — | — | — | — | — | — | 0.6 | 0.18 | 12 |
| LNU714 | 71183.3 | 0.1 | 0.12 | 31 | 0.9 | L | 50 | 0.6 | 0.03 | 18 |
| LNU712 | 71143.3 | — | — | — | 0.9 | 0.03 | 60 | 0.7 | 0.04 | 21 |
| LNU712 | 71144.2 | — | — | — | 0.9 | L | 57 | 0.7 | L | 27 |
| LNU712 | 71144.3 | — | — | — | — | — | — | 0.6 | 0.07 | 17 |
| LNU712 | 71147.1 | — | — | — | 0.8 | 0.10 | 34 | — | — | — |
| LNU712 | 71147.4 | — | — | — | 0.9 | 0.03 | 50 | — | — | — |
| LNU711 | 71137.2 | — | — | — | — | — | — | 0.6 | 0.04 | 19 |
| LNU711 | 71137.5 | — | — | — | 0.7 | 0.16 | 25 | 0.6 | 0.04 | 18 |
| LNU711 | 71139.4 | — | — | — | 0.8 | 0.11 | 32 | — | — | — |
| CONT. | — | 0.0 | — | — | 0.6 | — | — | 0.5 | — | — |
| LNU646 | 72145.1 | — | — | — | 0.8 | 0.13 | 45 | 0.7 | 0.03 | 23 |
| LNU646 | 72150.2 | — | — | — | 0.9 | 0.06 | 65 | — | — | — |
| LNU638 | 72139.2 | — | — | — | 0.9 | 0.06 | 56 | — | — | — |
| LNU638 | 72142.3 | — | — | — | 0.9 | 0.09 | 53 | — | — | — |
| LNU638 | 72143.3 | 0.1 | L | 109 | 1.5 | L | 158 | — | — | — |
| LNU637 | 71669.8 | 0.1 | 0.09 | 60 | 1.0 | 0.02 | 68 | 0.7 | 0.10 | 18 |
| LNU615 | 72283.2 | — | — | — | 0.8 | 0.20 | 41 | — | — | — |
| LNU615 | 72285.1 | 0.1 | 0.04 | 72 | 1.1 | L | 88 | — | — | — |
| LNU615 | 72287.1 | — | — | — | 0.8 | 0.24 | 37 | — | — | — |
| LNU601 | 72131.4 | 0.1 | 0.26 | 38 | 0.9 | 0.09 | 51 | — | — | — |
| LNU546 | 72586.1 | — | — | — | 0.9 | 0.03 | 66 | — | — | — |
| LNU546 | 72587.3 | — | — | — | 0.9 | 0.05 | 55 | — | — | — |
| LNU546 | 72588.1 | 0.1 | 0.29 | 42 | 0.9 | 0.09 | 64 | — | — | — |
| LNU533 | 71826.1 | — | — | — | 1.3 | L | 137 | 0.7 | 0.08 | 19 |
| CONT. | — | 0.0 | — | — | 0.6 | — | — | 0.6 | — | — |
| LNU689 | 71779.6 | 0.1 | 0.11 | 22 | — | — | — | — | — | — |
| CONT. | — | 0.1 | — | — | — | — | — | — | — | — |
| LNU706 | 71342.1 | 0.1 | 0.04 | 41 | 1.1 | 0.06 | 45 | 0.6 | 0.27 | 17 |
| LNU703 | 71491.3 | — | — | — | — | — | — | 0.6 | 0.24 | 14 |
| LNU703 | 71492.1 | — | — | — | — | — | — | 0.7 | 0.09 | 21 |
| LNU695 | 71302.1 | — | — | — | — | — | — | 0.8 | L | 39 |
| LNU695 | 71302.3 | — | — | — | — | — | — | 0.6 | 0.22 | 14 |
| LNU695 | 71303.2 | 0.1 | 0.13 | 29 | — | — | — | 0.6 | 0.15 | 16 |
| LNU687 | 71474.1 | 0.1 | 0.02 | 53 | 1.1 | 0.05 | 48 | 0.7 | 0.02 | 30 |
| LNU687 | 71474.3 | — | — | — | — | — | — | 0.7 | 0.11 | 21 |
| LNU687 | 71474.6 | — | — | — | — | — | — | 0.7 | 0.13 | 20 |
| LNU687 | 71476.3 | 0.1 | L | 68 | 1.0 | 0.12 | 31 | — | — | — |
| LNU674 | 71427.5 | 0.1 | 0.01 | 44 | 1.1 | 0.04 | 47 | 0.7 | 0.09 | 22 |
| LNU674 | 71428.2 | 0.1 | 0.08 | 37 | 1.0 | 0.21 | 27 | 0.7 | 0.05 | 24 |
| LNU672 | 71420.2 | — | — | — | — | — | — | 0.6 | 0.28 | 12 |
| LNU672 | 71420.3 | 0.1 | 0.04 | 36 | 1.3 | L | 72 | 0.7 | 0.08 | 26 |
| LNU672 | 71421.3 | 0.1 | 0.18 | 23 | 1.2 | L | 60 | 0.7 | 0.02 | 27 |
| LNU672 | 71421.4 | — | — | — | — | — | — | 0.7 | 0.07 | 27 |
| LNU672 | 71421.6 | 0.1 | 0.13 | 26 | — | — | — | 0.6 | 0.27 | 13 |
| LNU652 | 71376.6 | 0.1 | L | 78 | — | — | — | — | — | — |
| LNU652 | 71378.1 | — | — | — | — | — | — | 0.7 | 0.10 | 21 |
| LNU652 | 71378.3 | 0.1 | 0.28 | 17 | — | — | — | 0.6 | 0.11 | 19 |
| LNU652 | 71380.1 | 0.1 | 0.10 | 27 | 0.9 | 0.22 | 22 | 0.7 | 0.05 | 23 |
| LNU632 | 71372.3 | 0.1 | 0.12 | 28 | — | — | — | — | — | — |
| LNU632 | 71372.4 | 0.1 | 0.01 | 43 | 1.3 | L | 79 | 0.8 | L | 40 |
| LNU624 | 71364.2 | 0.1 | 0.03 | 36 | 0.9 | 0.27 | 26 | 0.7 | 0.07 | 27 |
| LNU624 | 71367.1 | 0.1 | 0.02 | 40 | — | — | — | — | — | — |
| LNU624 | 71369.2 | 0.1 | 0.09 | 28 | — | — | — | — | — | — |
| CONT. | — | 0.0 | — | — | 0.8 | — | — | 0.5 | — | — |
| LNU706 | 71340.4 | 0.0 | 0.26 | 26 | — | — | — | — | — | — |
| LNU706 | 71343.1 | 0.1 | 0.04 | 45 | — | — | — | 0.7 | 0.24 | 10 |
| LNU706 | 71343.2 | 0.0 | 0.23 | 26 | 0.9 | 0.07 | 33 | — | — | — |
| LNU706 | 71344.5 | 0.0 | 0.28 | 22 | 0.9 | 0.05 | 37 | 0.7 | 0.05 | 15 |
| LNU703 | 71490.5 | 0.1 | 0.04 | 38 | 1.1 | L | 67 | 0.7 | 0.07 | 14 |
| LNU703 | 71491.2 | 0.0 | 0.10 | 35 | — | — | — | — | — | — |
| LNU703 | 71491.3 | — | — | — | — | — | — | 0.7 | 0.10 | 13 |
| LNU703 | 71492.6 | — | — | — | — | — | — | 0.7 | 0.04 | 14 |
| LNU695 | 71299.2 | 0.0 | 0.27 | 21 | 0.9 | 0.12 | 31 | 0.7 | 0.30 | 9 |
| LNU695 | 71302.1 | 0.0 | 0.14 | 29 | 0.8 | 0.15 | 23 | — | — | — |
| LNU695 | 71302.3 | 0.0 | 0.11 | 32 | 1.1 | 0.65 | 65 | 0.8 | L | 27 |
| LNU695 | 71303.2 | 0.1 | L | 68 | 1.1 | L | 68 | 0.7 | 0.26 | 7 |
| LNU687 | 71472.4 | 0.0 | 0.29 | 22 | 0.8 | 0.12 | 25 | 0.7 | L | 19 |
| LNU687 | 71474.1 | 0.0 | 0.12 | 31 | 1.0 | 0.02 | 55 | 0.7 | L | 21 |
| LNU687 | 71474.3 | 0.1 | 0.06 | 39 | 1.2 | L | 88 | 0.7 | 0.15 | 11 |
| LNU687 | 71474.6 | 0.1 | L | 58 | 1.1 | L | 68 | 0.7 | 0.25 | 9 |

TABLE 76-continued

Genes showing improved growth rate at standard nitrogen growth conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU674 | 71425.1 | 0.1 | 0.01 | 48 | 0.8 | 0.19 | 21 | — | — | — |
| LNU674 | 71427.1 | 0.1 | 0.02 | 45 | 0.9 | 0.01 | 43 | 0.7 | 0.12 | 10 |
| LNU674 | 71428.2 | 0.1 | 0.03 | 42 | 0.8 | 0.13 | 25 | 0.7 | 0.12 | 11 |
| LNU672 | 71420.1 | 0.1 | L | 52 | 1.2 | L | 74 | 0.7 | L | 20 |
| LNU672 | 71420.3 | 0.1 | L | 82 | 1.2 | L | 74 | — | — | — |
| LNU672 | 71421.4 | 0.1 | 0.02 | 49 | 1.0 | 0.03 | 50 | — | — | — |
| LNU672 | 71421.6 | 0.0 | 0.08 | 35 | 1.1 | L | 69 | 0.7 | 0.04 | 14 |
| LNU652 | 71378.3 | 0.0 | 0.22 | 24 | — | — | — | — | — | — |
| LNU652 | 71380.1 | 0.1 | L | 92 | 1.2 | L | 88 | — | — | — |
| LNU632 | 71370.1 | 0.0 | 0.19 | 25 | 1.0 | L | 48 | 0.7 | 0.16 | 12 |
| LNU632 | 71372.4 | 0.0 | 0.12 | 30 | 0.8 | 0.13 | 26 | 0.7 | 0.07 | 17 |
| LNU632 | 71372.6 | 0.1 | 0.02 | 69 | 0.9 | 0.09 | 34 | 0.7 | 0.02 | 22 |
| LNU624 | 71364.2 | 0.1 | L | 63 | 1.1 | L | 69 | 0.7 | 0.04 | 17 |
| LNU624 | 71365.1 | 0.1 | 0.05 | 42 | — | — | — | — | — | — |
| LNU624 | 71366.1 | 0.0 | 0.22 | 25 | — | — | — | — | — | — |
| LNU624 | 71367.1 | 0.1 | 0.02 | 51 | — | — | — | — | — | — |
| CONT. | — | 0.0 | — | — | 0.7 | — | — | 0.6 | — | — |
| LNU741 | 71248.4 | 0.1 | 0.08 | 29 | — | — | — | 0.5 | 0.22 | 17 |
| LNU741 | 71249.3 | — | — | — | 0.6 | 0.19 | 26 | 0.5 | 0.13 | 20 |
| LNU741 | 71249.5 | 0.1 | 0.06 | 33 | 0.7 | 0.04 | 49 | 0.5 | 0.09 | 25 |
| LNU741 | 71250.3 | — | — | — | — | — | — | 0.5 | 0.24 | 17 |
| LNU740 | 71239.6 | — | — | — | — | — | — | 0.5 | 0.26 | 16 |
| LNU740 | 71242.4 | 0.1 | L | 46 | 0.9 | L | 90 | 0.5 | 0.02 | 35 |
| LNU732 | 71222.2 | 0.1 | 0.15 | 27 | 0.6 | 0.15 | 30 | 0.5 | 0.15 | 22 |
| LNU732 | 71222.4 | 0.1 | 0.03 | 46 | 0.7 | 0.04 | 50 | 0.5 | 0.29 | 15 |
| LNU732 | 71224.5 | 0.1 | L | 89 | 0.9 | L | 103 | — | — | — |
| LNU732 | 71226.6 | — | — | — | — | — | — | 0.5 | 0.25 | 16 |
| LNU728 | 71209.3 | 0.0 | 0.17 | 23 | 0.6 | 0.19 | 27 | — | — | — |
| LNU728 | 71209.5 | — | — | — | — | — | — | 0.5 | 0.17 | 21 |
| LNU728 | 71210.2 | 0.1 | 0.01 | 42 | 0.8 | L | 65 | 0.5 | 0.30 | 15 |
| LNU728 | 71214.3 | 0.1 | 0.03 | 57 | 0.8 | 0.02 | 75 | 0.5 | 0.15 | 21 |
| LNU726 | 71203.5 | 0.1 | 0.04 | 37 | 0.7 | 0.05 | 42 | — | — | — |
| LNU726 | 71204.4 | 0.0 | 0.22 | 21 | 0.6 | 0.10 | 34 | 0.5 | 0.15 | 21 |
| LNU726 | 71205.2 | — | — | — | 0.6 | 0.09 | 36 | 0.5 | 0.04 | 29 |
| LNU725 | 71199.1 | 0.0 | 0.20 | 21 | — | — | — | — | — | — |
| LNU725 | 71201.1 | — | — | — | 0.6 | 0.16 | 30 | 0.5 | 0.03 | 31 |
| LNU725 | 71201.5 | 0.1 | L | 60 | 0.8 | L | 82 | 0.5 | 0.01 | 36 |
| LNU714 | 71181.2 | 0.1 | 0.12 | 34 | 0.6 | 0.06 | 39 | 0.5 | 0.21 | 18 |
| LNU714 | 71181.6 | 0.0 | 0.13 | 26 | — | — | — | — | — | — |
| LNU714 | 71182.1 | 0.1 | L | 49 | 0.7 | L | 59 | — | — | — |
| LNU714 | 71183.2 | 0.0 | 0.18 | 21 | 0.7 | L | 55 | 0.5 | 0.04 | 30 |
| LNU712 | 71144.2 | 0.0 | 0.16 | 25 | 0.7 | 0.03 | 53 | 0.5 | 0.02 | 35 |
| LNU712 | 71144.3 | 0.1 | L | 105 | 1.1 | L | 137 | 0.5 | 0.04 | 31 |
| LNU712 | 71147.1 | — | — | — | 0.6 | 0.25 | 23 | 0.5 | 0.12 | 22 |
| LNU712 | 71147.4 | 0.1 | L | 75 | 1.0 | L | 121 | 0.5 | 0.02 | 33 |
| LNU712 | 71148.2 | 0.1 | 0.16 | 30 | — | — | — | — | — | — |
| LNU711 | 71137.1 | — | — | — | 0.6 | 0.23 | 30 | 0.5 | 0.25 | 17 |
| LNU711 | 71137.2 | 0.0 | 0.24 | 19 | 0.6 | 0.06 | 40 | — | — | — |
| LNU711 | 71137.5 | — | — | — | 0.6 | 0.15 | 29 | — | — | — |
| LNU711 | 71139.2 | — | — | — | — | — | — | 0.5 | 0.21 | 20 |
| LNU711 | 71139.3 | 0.0 | 0.19 | 23 | 0.7 | 0.03 | 46 | 0.6 | L | 41 |
| CONT. | — | 0.0 | — | — | 0.5 | — | — | 0.4 | — | — |
| LNU709 | 71498.3 | 0.1 | 0.03 | 36 | 0.8 | L | 60 | — | — | — |
| LNU709 | 71498.4 | 0.1 | 0.03 | 39 | 0.8 | L | 66 | — | — | — |
| LNU709 | 71501.3 | 0.1 | L | 52 | 0.8 | L | 58 | 0.6 | 0.21 | 14 |
| LNU693 | 71546.2 | 0.0 | 0.22 | 22 | — | — | — | — | — | — |
| LNU693 | 71547.3 | 0.1 | 0.09 | 28 | 0.7 | 0.05 | 39 | — | — | — |
| LNU693 | 71547.5 | — | — | — | 0.6 | 0.29 | 21 | 0.6 | 0.28 | 12 |
| LNU693 | 71548.6 | 0.1 | 0.06 | 37 | 0.9 | L | 77 | 0.7 | 0.04 | 25 |
| LNU676 | 71095.2 | 0.1 | 0.14 | 26 | 0.7 | 0.02 | 43 | 0.6 | 0.12 | 16 |
| LNU676 | 71095.3 | — | — | — | 0.7 | 0.08 | 53 | 0.8 | L | 44 |
| LNU676 | 71095.4 | 0.1 | 0.04 | 51 | 0.9 | L | 80 | 0.7 | 0.02 | 30 |
| LNU676 | 71096.4 | — | — | — | — | — | — | 0.7 | 0.05 | 29 |
| LNU671 | 71091.2 | 0.1 | 0.08 | 32 | 0.7 | 0.03 | 39 | — | — | — |
| LNU671 | 71091.5 | — | — | — | 0.6 | 0.28 | 22 | 0.6 | 0.07 | 20 |
| LNU671 | 71094.1 | — | — | — | 0.6 | 0.09 | 30 | 0.7 | L | 33 |
| LNU671 | 71094.5 | 0.1 | 0.03 | 41 | 0.7 | 0.13 | 38 | — | — | — |
| LNU659 | 71850.1 | — | — | — | 0.6 | 0.17 | 24 | — | — | — |
| LNU659 | 71853.2 | 0.1 | 0.17 | 26 | 0.7 | L | 51 | — | — | — |
| LNU659 | 71855.5 | 0.1 | 0.02 | 39 | 1.0 | L | 100 | 0.7 | 0.01 | 26 |
| LNU654 | 71556.1 | 0.1 | 0.07 | 36 | 0.6 | 0.09 | 32 | — | — | — |

TABLE 76-continued

Genes showing improved growth rate at standard nitrogen growth conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU654 | 71557.3 | 0.1 | 0.03 | 36 | 0.9 | L | 77 | 0.6 | 0.07 | 18 |
| LNU654 | 71561.4 | — | — | — | 0.6 | 0.07 | 33 | 0.7 | L | 41 |
| LNU607 | 71592.5 | — | — | — | 0.6 | 0.07 | 31 | 0.6 | 0.18 | 15 |
| LNU607 | 71595.1 | — | — | — | 0.7 | 0.11 | 35 | 0.7 | 0.01 | 29 |
| LNU607 | 71595.3 | — | — | — | 0.7 | L | 48 | 0.6 | 0.18 | 14 |
| LNU607 | 71596.1 | — | — | — | 0.7 | 0.11 | 35 | — | — | — |
| LNU603 | 71612.1 | — | — | — | 0.6 | 0.10 | 26 | 0.6 | 0.13 | 15 |
| LNU603 | 71612.3 | — | — | — | — | — | — | 0.7 | L | 31 |
| LNU603 | 71613.2 | — | — | — | 0.6 | 0.19 | 22 | — | — | — |
| LNU521 | 71598.3 | — | — | — | 0.8 | L | 59 | 0.7 | 0.03 | 26 |
| LNU521 | 71598.4 | — | — | — | — | — | — | 0.7 | 0.01 | 27 |
| LNU521 | 71599.3 | — | — | — | 0.8 | L | 55 | — | — | — |
| LNU521 | 71601.3 | 0.0 | 0.22 | 21 | 0.6 | 0.22 | 22 | 0.6 | 0.28 | 11 |
| LNU521 | 71601.5 | — | — | — | 0.6 | 0.25 | 18 | 0.6 | 0.10 | 18 |
| CONT. | — | 0.0 | — | — | 0.5 | — | — | 0.5 | — | — |
| LNU742 | 71552.2 | — | — | — | 1.0 | L | 51 | 0.8 | 0.05 | 23 |
| LNU742 | 71552.4 | — | — | — | 1.0 | 0.03 | 41 | — | — | — |
| LNU742 | 71554.2 | 0.1 | 0.04 | 49 | 1.1 | 0.02 | 65 | — | — | — |
| LNU734 | 71646.5 | 0.1 | L | 90 | 1.4 | L | 107 | 0.8 | 0.05 | 25 |
| LNU734 | 71648.2 | 0.0 | 0.13 | 24 | 1.0 | L | 45 | 0.7 | 0.16 | 17 |
| LNU734 | 71648.3 | 0.1 | 0.07 | 32 | 1.0 | 0.01 | 43 | — | — | — |
| LNU734 | 71648.5 | 0.1 | 0.07 | 31 | 1.0 | 0.01 | 45 | 0.7 | 0.13 | 18 |
| LNU734 | 71649.1 | — | — | — | — | — | — | 0.7 | 0.20 | 15 |
| LNU715 | 71642.2 | — | — | — | 0.9 | 0.05 | 33 | — | — | — |
| LNU715 | 71643.1 | 0.1 | L | 84 | 1.2 | L | 76 | — | — | — |
| LNU715 | 71643.2 | 0.1 | 0.02 | 60 | 1.1 | L | 63 | — | — | — |
| LNU715 | 71643.3 | 0.1 | 0.07 | 31 | 1.1 | L | 56 | — | — | — |
| LNU715 | 71645.3 | 0.1 | L | 79 | 1.4 | L | 103 | 0.7 | 0.10 | 20 |
| LNU567 | 70995.2 | 0.0 | 0.26 | 19 | 0.8 | 0.23 | 21 | — | — | — |
| LNU567 | 70995.4 | 0.1 | 0.04 | 36 | 1.0 | L | 48 | — | — | — |
| LNU567 | 70998.3 | 0.1 | 0.14 | 26 | 1.2 | L | 72 | 0.7 | 0.20 | 16 |
| LNU567 | 70998.4 | — | — | — | 1.0 | 0.01 | 44 | 0.7 | 0.26 | 14 |
| CONT. | — | 0.0 | — | — | 0.7 | — | — | 0.6 | — | — |
| LNU722 | 71189.5 | 0.0 | 0.01 | 26 | 0.7 | L | 43 | 0.7 | 0.04 | 20 |
| LNU706 | 71340.4 | 0.0 | 0.18 | 31 | 0.7 | 0.13 | 55 | — | — | — |
| LNU706 | 71343.2 | 0.0 | 0.04 | 31 | 0.6 | 0.17 | 32 | — | — | — |
| LNU706 | 71344.5 | 0.0 | 0.02 | 28 | 0.6 | 0.05 | 29 | — | — | — |
| LNU702 | 71857.3 | — | — | — | 0.6 | 0.02 | 38 | — | — | — |
| LNU702 | 71858.3 | — | — | — | 0.6 | 0.03 | 37 | — | — | — |
| LNU702 | 71859.3 | 0.1 | L | 62 | — | — | — | — | — | — |
| LNU702 | 71860.2 | — | — | — | 0.7 | 0.02 | 45 | — | — | — |
| LNU693 | 71546.3 | 0.0 | 0.26 | 15 | — | — | — | — | — | — |
| LNU693 | 71547.3 | 0.1 | L | 70 | 0.8 | L | 80 | — | — | — |
| LNU693 | 71548.6 | 0.1 | L | 95 | 0.8 | L | 68 | — | — | — |
| LNU668 | 71412.1 | 0.0 | 0.21 | 20 | — | — | — | — | — | — |
| LNU668 | 71415.5 | 0.1 | L | 123 | 0.9 | L | 96 | 0.6 | 0.23 | 12 |
| LNU668 | 71415.6 | 0.1 | L | 52 | — | — | — | — | — | — |
| LNU668 | 71416.3 | 0.0 | 0.13 | 26 | — | — | — | — | — | — |
| LNU545 | 72596.1 | 0.0 | L | 42 | — | — | — | — | — | — |
| LNU545 | 72597.1 | 0.1 | L | 106 | 0.9 | L | 102 | — | — | — |
| LNU545 | 72598.1 | 0.0 | L | 32 | 0.7 | 0.02 | 43 | — | — | — |
| CONT. | — | 0.0 | — | — | 0.5 | — | — | 0.6 | — | — |
| LNU696 | 70601.2 | — | — | — | 1.0 | 0.22 | 24 | — | — | — |
| LNU627 | 70491.2 | 0.1 | 0.04 | 40 | — | — | — | — | — | — |
| LNU627 | 70491.3 | 0.1 | L | 49 | 1.1 | L | 39 | — | — | — |
| LNU627 | 70491.5 | 0.1 | 0.09 | 26 | — | — | — | — | — | — |
| LNU616 | 70504.4 | 0.1 | 0.11 | 22 | — | — | — | — | — | — |
| LNU616 | 70505.2 | 0.1 | 0.22 | 21 | 1.0 | 0.25 | 21 | — | — | — |
| LNU595 | 70274.3 | 0.1 | L | 59 | 1.2 | L | 47 | — | — | — |
| LNU565 | 70623.5 | 0.1 | 0.13 | 21 | — | — | — | — | — | — |
| LNU565 | 70624.3 | — | — | — | 1.0 | 0.23 | 22 | — | — | — |
| LNU565 | 70624.5 | — | — | — | 1.0 | 0.06 | 30 | — | — | — |
| LNU565 | 70626.1 | 0.1 | 0.28 | 17 | 0.9 | 0.22 | 16 | — | — | — |
| LNU542 | 70226.2 | 0.1 | L | 66 | 1.1 | 0.03 | 37 | — | — | — |
| LNU542 | 70229.3 | 0.1 | 0.18 | 25 | — | — | — | — | — | — |
| LNU537 | 70215.4 | 0.1 | 0.22 | 22 | 1.0 | 0.15 | 25 | — | — | — |
| CONT. | — | 0.1 | — | — | 0.8 | — | — | — | — | — |
| LNU688 | 72691.3 | 0.0 | 0.16 | 33 | — | — | — | — | — | — |
| LNU688 | 72692.4 | 0.1 | 0.08 | 42 | 1.1 | 0.21 | 28 | — | — | — |
| LNU688 | 72694.3 | 0.0 | 0.12 | 36 | 1.1 | 0.19 | 28 | — | — | — |
| LNU688 | 72694.4 | 0.0 | 0.12 | 36 | 1.2 | 0.06 | 42 | 0.7 | 0.23 | 11 |

TABLE 76-continued

Genes showing improved growth rate at standard nitrogen growth conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU657 | 70334.8 | 0.0 | 0.22 | 29 | — | — | — | — | — | — |
| LNU657 | 70336.1 | 0.1 | L | 72 | 1.1 | 0.19 | 29 | — | — | — |
| LNU657 | 70338.2 | 0.0 | 0.23 | 28 | — | — | — | — | — | — |
| LNU645 | 73004.1 | 0.1 | 0.03 | 55 | 1.2 | 0.08 | 40 | — | — | — |
| LNU645 | 73005.4 | 0.1 | 0.12 | 39 | — | — | — | 0.7 | 0.10 | 18 |
| LNU645 | 73006.2 | 0.1 | L | 69 | 1.5 | L | 70 | — | — | — |
| LNU645 | 73008.2 | 0.1 | L | 93 | 1.4 | L | 60 | 0.7 | 0.07 | 17 |
| LNU608 | 72997.2 | — | — | — | — | — | — | 0.7 | 0.16 | 13 |
| LNU608 | 72997.3 | 0.0 | 0.26 | 35 | — | — | — | — | — | — |
| LNU608 | 72997.4 | 0.1 | 0.01 | 60 | 1.3 | 0.02 | 52 | — | — | — |
| LNU608 | 73000.1 | 0.1 | 0.03 | 49 | 1.2 | 0.10 | 36 | — | — | — |
| LNU608 | 73000.4 | — | — | — | — | — | — | 0.7 | 0.22 | 12 |
| LNU588 | 72994.3 | 0.1 | 0.08 | 47 | 1.2 | 0.09 | 38 | — | — | — |
| LNU554 | 70478.2 | 0.1 | L | 76 | 1.4 | L | 61 | 0.8 | L | 26 |
| LNU554 | 70479.1 | 0.1 | 0.06 | 47 | 1.1 | 0.30 | 24 | — | — | — |
| LNU554 | 70479.3 | — | — | — | — | — | — | 0.7 | 0.11 | 14 |
| LNU554 | 70482.4 | — | — | — | — | — | — | 0.7 | 0.04 | 18 |
| LNU554 | 70483.2 | 0.0 | 0.21 | 29 | — | — | — | — | — | — |
| LNU545 | 72595.2 | — | — | — | — | — | — | 0.7 | 0.20 | 12 |
| LNU545 | 72598.1 | 0.1 | L | 81 | 1.1 | 0.20 | 29 | — | — | — |
| LNU545 | 72599.4 | 0.0 | 0.14 | 34 | — | — | — | — | — | — |
| CONT. | — | 0.0 | — | — | 0.9 | — | — | 0.6 | — | — |
| LNU748 | 72947.2 | 0.0 | 0.29 | 27 | — | — | — | — | — | — |
| LNU748 | 72947.3 | 0.0 | 0.27 | 24 | 1.1 | 0.09 | 43 | — | — | — |
| LNU746 | 72964.3 | — | — | — | — | — | — | 0.7 | 0.09 | 17 |
| LNU746 | 72966.2 | 0.0 | 0.10 | 36 | — | — | — | — | — | — |
| LNU688 | 72691.3 | 0.1 | 0.04 | 71 | 1.1 | 0.22 | 38 | — | — | — |
| LNU688 | 72692.3 | 0.1 | L | 78 | 1.2 | 0.03 | 60 | — | — | — |
| LNU645 | 73005.4 | 0.1 | 0.12 | 35 | — | — | — | — | — | — |
| LNU636_H1 | 72937.3 | 0.0 | 0.22 | 30 | — | — | — | — | — | — |
| LNU636_H1 | 72942.1 | — | — | — | — | — | — | 0.7 | 0.19 | 17 |
| LNU636_H1 | 72942.2 | 0.1 | 0.04 | 58 | 1.1 | 0.11 | 45 | 0.7 | 0.24 | 12 |
| LNU608 | 72997.2 | — | — | — | 1.0 | 0.26 | 29 | — | — | — |
| LNU608 | 72997.4 | — | — | — | 1.0 | 0.21 | 32 | 0.8 | 0.02 | 28 |
| LNU608 | 73000.1 | — | — | — | — | — | — | 0.7 | 0.28 | 11 |
| LNU588 | 72995.4 | 0.0 | 0.18 | 35 | 1.1 | 0.20 | 41 | — | — | — |
| LNU585 | 72913.3 | 0.0 | 0.11 | 37 | 1.1 | 0.19 | 38 | — | — | — |
| LNU585 | 72914.2 | 0.1 | 0.05 | 43 | — | — | — | — | — | — |
| LNU585 | 72915.1 | 0.1 | 0.07 | 44 | 1.2 | 0.06 | 52 | — | — | — |
| LNU585 | 72917.3 | 0.1 | L | 75 | 1.3 | 0.01 | 69 | 0.7 | 0.24 | 12 |
| CONT. | — | 0.0 | — | — | 0.8 | — | — | 0.6 | — | — |
| LNU710 | 70712.3 | 0.1 | L | 48 | 0.8 | 0.03 | 39 | — | — | — |
| LNU710 | 70712.5 | 0.1 | 0.22 | 11 | 0.6 | 0.21 | 12 | 0.5 | 0.02 | 20 |
| LNU710 | 70715.1 | 0.1 | 0.01 | 48 | 0.7 | 0.07 | 33 | — | — | — |
| LNU710 | 70715.2 | 0.1 | 0.02 | 24 | — | — | — | 0.5 | 0.02 | 21 |
| LNU705 | 70604.2 | 0.1 | 0.12 | 17 | — | — | — | — | — | — |
| LNU705 | 70607.3 | 0.1 | 0.02 | 40 | 0.9 | 0.01 | 63 | 0.6 | L | 29 |
| LNU705 | 70607.4 | — | — | — | 0.6 | 0.10 | 18 | 0.5 | 0.07 | 15 |
| LNU639 | 70869.2 | 0.1 | L | 69 | 0.9 | L | 69 | 0.5 | 0.03 | 19 |
| LNU639 | 70871.3 | — | — | — | 0.6 | 0.22 | 13 | — | — | — |
| LNU639 | 70872.4 | 0.1 | 0.16 | 20 | — | — | — | — | — | — |
| LNU635 | 70784.2 | 0.1 | 0.01 | 28 | — | — | — | — | — | — |
| LNU635 | 70784.3 | 0.1 | L | 113 | 1.1 | L | 99 | 0.5 | 0.02 | 20 |
| LNU635 | 70784.4 | 0.1 | 0.10 | 29 | — | — | — | — | — | — |
| LNU635 | 70786.4 | 0.1 | 0.01 | 46 | 0.8 | 0.02 | 48 | — | — | — |
| LNU589 | 70707.2 | 0.1 | 0.01 | 27 | — | — | — | — | — | — |
| LNU580 | 70851.4 | 0.1 | L | 45 | 0.8 | L | 43 | 0.5 | L | 26 |
| LNU549 | 70719.1 | 0.1 | 0.05 | 17 | 0.7 | 0.07 | 24 | 0.5 | 0.19 | 14 |
| LNU549 | 70719.2 | — | — | — | — | — | — | 0.5 | 0.04 | 19 |
| LNU549 | 70720.2 | 0.1 | 0.14 | 14 | 0.6 | 0.26 | 11 | 0.5 | L | 25 |
| LNU549 | 70723.2 | 0.1 | L | 66 | 0.9 | L | 72 | 0.5 | 0.02 | 26 |
| LNU543 | 70828.4 | — | — | — | — | — | — | 0.5 | 0.10 | 16 |
| LNU524 | 70808.4 | — | — | — | 0.6 | 0.18 | 14 | 0.5 | 0.08 | 16 |
| LNU524 | 70809.1 | 0.1 | 0.01 | 38 | 0.8 | 0.01 | 44 | 0.5 | 0.22 | 10 |
| LNU524 | 70809.2 | 0.1 | 0.18 | 14 | 0.7 | 0.07 | 25 | 0.5 | 0.03 | 18 |
| CONT. | — | 0.0 | — | — | 0.5 | — | — | 0.4 | — | — |
| LNU729 | 71517.4 | 0.1 | L | 62 | 0.9 | L | 61 | 0.6 | 0.12 | 20 |
| LNU729 | 71518.2 | 0.1 | L | 79 | 1.1 | L | 95 | 0.7 | 0.03 | 28 |
| LNU729 | 71519.4 | 0.1 | L | 56 | 0.8 | 0.15 | 34 | — | — | — |
| LNU719 | 71540.3 | 0.1 | L | 44 | 0.8 | 0.03 | 47 | 0.6 | 0.14 | 18 |
| LNU719 | 71542.3 | 0.1 | L | 76 | — | — | — | — | — | — |

TABLE 76-continued

Genes showing improved growth rate at standard nitrogen growth conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU719 | 71543.8 | 0.1 | L | 51 | 0.8 | 0.07 | 40 | 0.6 | 0.24 | 15 |
| LNU718 | 71504.1 | 0.1 | L | 90 | 1.1 | L | 91 | 0.7 | 0.03 | 29 |
| LNU718 | 71504.6 | 0.1 | L | 55 | 0.9 | 0.02 | 50 | 0.6 | 0.11 | 21 |
| LNU718 | 71506.2 | 0.0 | 0.05 | 38 | — | — | — | — | — | — |
| LNU718 | 71507.2 | 0.1 | 0.02 | 43 | 0.8 | 0.18 | 34 | — | — | — |
| LNU709 | 71498.4 | 0.1 | L | 105 | 1.1 | L | 87 | — | — | — |
| LNU709 | 71499.2 | 0.0 | 0.08 | 34 | — | — | — | — | — | — |
| LNU709 | 71501.3 | 0.1 | L | 67 | 0.9 | L | 66 | 0.6 | 0.07 | 21 |
| LNU709 | 71501.4 | 0.0 | 0.02 | 39 | — | — | — | 0.6 | 0.07 | 23 |
| LNU693 | 71546.2 | 0.1 | 0.01 | 50 | 0.8 | 0.03 | 47 | 0.6 | 0.12 | 21 |
| LNU693 | 71547.3 | 0.1 | L | 57 | 0.8 | 0.06 | 42 | — | — | — |
| LNU693 | 71547.5 | 0.1 | L | 52 | 1.0 | L | 83 | 0.7 | L | 39 |
| LNU693 | 71548.6 | 0.1 | L | 110 | 1.1 | L | 89 | — | — | — |
| LNU654 | 71557.1 | 0.0 | 0.03 | 33 | 0.9 | L | 57 | 0.6 | 0.10 | 23 |
| LNU654 | 71557.3 | 0.1 | L | 60 | 0.8 | 0.06 | 45 | — | — | — |
| LNU654 | 71559.2 | 0.0 | 0.10 | 25 | — | — | — | — | — | — |
| LNU654 | 71561.4 | 0.1 | L | 76 | 0.9 | 0.03 | 63 | — | — | — |
| LNU607 | 71592.5 | 0.1 | L | 114 | 1.1 | L | 98 | 0.6 | 0.13 | 18 |
| LNU607 | 71595.1 | 0.0 | 0.22 | 19 | — | — | — | — | — | — |
| LNU607 | 71595.3 | 0.1 | L | 72 | 1.0 | L | 80 | 0.7 | 0.01 | 33 |
| LNU603 | 71610.5 | 0.1 | L | 120 | 1.2 | L | 110 | 0.6 | 0.04 | 27 |
| LNU603 | 71612.3 | 0.0 | L | 40 | 1.0 | L | 76 | 0.6 | 0.06 | 23 |
| LNU603 | 71613.2 | 0.0 | 0.21 | 19 | — | — | — | 0.6 | 0.14 | 18 |
| LNU603 | 71613.6 | 0.1 | L | 77 | 0.9 | L | 61 | 0.6 | 0.08 | 23 |
| LNU521 | 71598.3 | 0.1 | L | 58 | 1.0 | L | 75 | 0.6 | 0.10 | 21 |
| LNU521 | 71598.4 | 0.1 | 0.10 | 54 | — | — | — | — | — | — |
| LNU521 | 71599.3 | — | — | — | — | — | — | 0.6 | 0.05 | 24 |
| LNU521 | 71601.3 | 0.0 | 0.11 | 26 | — | — | — | — | — | — |
| LNU521 | 71601.5 | 0.0 | 0.04 | 32 | 0.8 | 0.11 | 38 | 0.6 | 0.14 | 20 |
| CONT. | — | 0.0 | — | — | 0.6 | — | — | 0.5 | — | — |
| LNU708 | 71797.3 | 0.1 | L | 50 | — | — | — | — | — | — |
| LNU708 | 71798.4 | 0.0 | 0.17 | 23 | — | — | — | — | — | — |
| LNU708 | 71800.1 | 0.1 | 0.02 | 44 | — | — | — | — | — | — |
| LNU649 | 71059.1 | 0.1 | 0.03 | 45 | 1.0 | 0.09 | 45 | — | — | — |
| LNU649 | 71063.1 | 0.1 | 0.01 | 44 | — | — | — | — | — | — |
| LNU649 | 71064.1 | — | — | — | — | — | — | 0.7 | 0.19 | 19 |
| LNU649 | 71064.2 | 0.0 | 0.10 | 24 | — | — | — | — | — | — |
| LNU648 | 71023.3 | — | — | — | — | — | — | 0.7 | 0.20 | 15 |
| LNU648 | 71024.4 | 0.0 | 0.15 | 23 | — | — | — | 0.7 | 0.28 | 13 |
| LNU648 | 71026.1 | 0.1 | L | 54 | — | — | — | — | — | — |
| LNU634 | 71013.4 | 0.0 | 0.19 | 22 | 1.0 | 0.07 | 49 | — | — | — |
| LNU634 | 71016.3 | 0.0 | 0.07 | 26 | 0.9 | 0.08 | 38 | — | — | — |
| LNU622 | 70999.3 | — | — | — | 0.8 | 0.25 | 24 | 0.7 | 0.21 | 15 |
| LNU622 | 71003.3 | 0.1 | L | 55 | 1.1 | L | 66 | 0.7 | 0.03 | 28 |
| LNU622 | 71004.2 | 0.1 | 0.03 | 36 | 1.0 | 0.05 | 46 | 0.7 | 0.14 | 19 |
| LNU591 | 71283.1 | 0.1 | L | 64 | 0.9 | 0.20 | 34 | 0.7 | 0.20 | 19 |
| LNU591 | 71283.3 | 0.1 | 0.01 | 37 | — | — | — | — | — | — |
| LNU581 | 71305.7 | 0.1 | 0.02 | 52 | — | — | — | — | — | — |
| LNU581 | 71306.1 | 0.1 | L | 40 | — | — | — | — | — | — |
| LNU574 | 71790.4 | 0.1 | L | 71 | 1.3 | L | 87 | 0.7 | 0.11 | 19 |
| LNU574 | 71791.2 | 0.0 | 0.06 | 27 | — | — | — | — | — | — |
| LNU574 | 71792.3 | 0.0 | 0.13 | 23 | — | — | — | — | — | — |
| CONT. | — | 0.0 | — | — | 0.7 | — | — | 0.6 | — | — |
| LNU671 | 71094.5 | 0.1 | 0.20 | 17 | 1.3 | L | 43 | 0.7 | 0.18 | 17 |
| LNU649 | 71062.1 | — | — | — | 1.3 | 0.04 | 48 | 0.8 | 0.17 | 19 |
| LNU649 | 71064.2 | 0.1 | 0.10 | 23 | — | — | — | — | — | — |
| LNU622 | 70999.1 | 0.1 | 0.29 | 15 | — | — | — | — | — | — |
| LNU622 | 71003.4 | 0.1 | 0.03 | 29 | 1.3 | 0.01 | 50 | 0.8 | 0.07 | 22 |
| LNU591 | 71283.3 | — | — | — | 1.0 | 0.30 | 17 | — | — | — |
| LNU581 | 71305.7 | — | — | — | 1.1 | 0.19 | 22 | — | — | — |
| LNU581 | 71306.1 | 0.1 | 0.04 | 30 | 1.4 | L | 53 | 0.8 | 0.16 | 19 |
| CONT. | — | 0.1 | — | — | 0.9 | — | — | 0.6 | — | — |
| LNU735 | 71873.2 | 0.1 | 0.04 | 46 | 1.2 | 0.23 | 22 | — | — | — |
| LNU735 | 71873.5 | 0.1 | 0.04 | 40 | 1.2 | 0.04 | 30 | — | — | — |
| LNU713 | 71862.1 | 0.1 | 0.08 | 24 | 1.1 | 0.23 | 18 | — | — | — |
| LNU689 | 71778.3 | 0.1 | L | 55 | 1.6 | L | 73 | — | — | — |
| LNU689 | 71779.6 | 0.1 | L | 52 | 1.1 | 0.28 | 15 | — | — | — |
| LNU688 | 72692.3 | 0.1 | 0.12 | 37 | 1.3 | 0.07 | 41 | — | — | — |
| LNU688 | 72692.4 | 0.1 | 0.04 | 38 | 1.2 | 0.12 | 27 | — | — | — |
| LNU669 | 70391.1 | 0.1 | 0.05 | 28 | 1.2 | 0.17 | 23 | — | — | — |
| LNU669 | 70393.1 | 0.1 | 0.06 | 30 | 1.3 | 0.03 | 38 | — | — | — |

TABLE 76-continued

Genes showing improved growth rate at standard nitrogen growth conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU611 | 72698.2 | — | — | — | 1.1 | 0.28 | 15 | — | — | — |
| LNU546 | 72584.3 | 0.1 | L | 45 | 1.4 | L | 50 | — | — | — |
| LNU546 | 72586.1 | 0.1 | 0.11 | 22 | 1.2 | 0.06 | 23 | — | — | — |
| LNU533 | 71826.1 | 0.1 | 0.22 | 15 | 1.1 | 0.23 | 20 | — | — | — |
| CONT. | — | 0.0 | — | — | 0.9 | — | — | — | — | — |
| LNU710 | 70712.5 | 0.1 | 0.10 | 23 | — | — | — | — | — | — |
| LNU710 | 70712.6 | 0.1 | 0.01 | 31 | 1.0 | L | 42 | — | — | — |
| LNU710 | 70715.2 | 0.1 | L | 67 | 1.0 | 0.03 | 40 | — | — | — |
| LNU710 | 70716.1 | — | — | — | — | — | — | 0.7 | 0.10 | 12 |
| LNU705 | 70604.2 | 0.1 | 0.07 | 24 | 1.1 | L | 54 | 0.7 | 0.03 | 16 |
| LNU705 | 70604.4 | 0.1 | 0.11 | 19 | 0.9 | 0.04 | 30 | 0.7 | 0.01 | 18 |
| LNU705 | 70606.2 | 0.1 | 0.20 | 23 | — | — | — | — | — | — |
| LNU705 | 70607.3 | 0.1 | 0.10 | 27 | 0.9 | 0.09 | 27 | 0.7 | 0.14 | 11 |
| LNU639 | 70871.3 | 0.1 | 0.02 | 30 | 1.0 | 0.02 | 40 | — | — | — |
| LNU639 | 70873.2 | 0.1 | 0.10 | 32 | — | — | — | — | — | — |
| LNU635 | 70784.4 | 0.1 | 0.10 | 20 | — | — | — | — | — | — |
| LNU635 | 70786.4 | — | — | — | — | — | — | 0.7 | 0.07 | 13 |
| LNU635 | 70787.3 | 0.1 | 0.20 | 17 | 0.9 | 0.04 | 32 | — | — | — |
| LNU580 | 70851.2 | 0.1 | 0.11 | 20 | — | — | — | 0.7 | 0.29 | 7 |
| LNU580 | 70853.2 | 0.1 | 0.20 | 17 | — | — | — | — | — | — |
| LNU580 | 70855.3 | 0.1 | 0.04 | 29 | 1.0 | 0.03 | 36 | 0.7 | 0.04 | 14 |
| LNU549 | 70720.2 | — | — | — | — | — | — | 0.7 | 0.27 | 8 |
| LNU549 | 70723.2 | 0.1 | 0.13 | 17 | — | — | — | — | — | — |
| LNU543 | 70826.1 | — | — | — | 0.9 | 0.12 | 22 | 0.7 | 0.05 | 15 |
| LNU543 | 70827.1 | 0.1 | L | 45 | 0.9 | 0.08 | 31 | — | — | — |
| LNU543 | 70828.4 | 0.1 | L | 51 | 1.2 | L | 67 | 0.7 | 0.03 | 15 |
| LNU524 | 70808.1 | 0.1 | 0.08 | 22 | 1.1 | L | 57 | 0.7 | 0.05 | 13 |
| LNU524 | 70809.2 | — | — | — | — | — | — | 0.7 | 0.09 | 14 |
| CONT. | — | 0.0 | — | — | 0.7 | — | — | 0.6 | — | — |
| LNU748 | 72945.1 | 0.1 | 0.03 | 51 | 1.0 | 0.20 | 28 | — | — | — |
| LNU748 | 72945.2 | 0.1 | L | 60 | 1.3 | L | 67 | 0.8 | 0.03 | 24 |
| LNU748 | 72947.3 | — | — | — | 1.2 | 0.01 | 56 | 0.7 | 0.24 | 13 |
| LNU748 | 72948.5 | — | — | — | — | — | — | 0.7 | 0.19 | 16 |
| LNU746 | 72962.2 | 0.1 | L | 59 | 1.2 | 0.01 | 57 | 0.7 | 0.22 | 13 |
| LNU746 | 72966.3 | 0.1 | 0.02 | 48 | 1.2 | 0.01 | 54 | 0.7 | 0.28 | 13 |
| LNU745 | 70911.1 | 0.1 | 0.01 | 50 | 1.1 | 0.07 | 41 | 0.7 | 0.17 | 16 |
| LNU745 | 70911.4 | — | — | — | 1.1 | 0.03 | 50 | 0.7 | 0.12 | 15 |
| LNU745 | 70914.4 | 0.1 | 0.05 | 72 | 1.3 | 0.06 | 75 | 0.8 | 0.04 | 25 |
| LNU739 | 71630.1 | 0.1 | 0.06 | 38 | 1.2 | L | 61 | 0.8 | 0.03 | 24 |
| LNU739 | 71630.3 | 0.0 | 0.07 | 35 | 1.0 | 0.14 | 30 | 0.8 | 0.03 | 24 |
| LNU739 | 71631.3 | 0.1 | 0.02 | 77 | 1.4 | L | 88 | 0.8 | 0.04 | 24 |
| LNU636_H1 | 72937.3 | — | — | — | — | — | — | 0.7 | 0.12 | 17 |
| LNU636_H1 | 72940.1 | 0.1 | L | 106 | 1.6 | L | 107 | 0.7 | 0.25 | 16 |
| LNU636_H1 | 72942.1 | — | — | — | 1.1 | 0.02 | 48 | 0.7 | 0.20 | 13 |
| LNU636_H1 | 72942.2 | 0.1 | 0.03 | 53 | 1.2 | 0.01 | 60 | 0.7 | 0.24 | 12 |
| LNU590 | 70264.2 | — | — | — | 0.9 | 0.23 | 25 | 0.7 | 0.26 | 12 |
| LNU590 | 70267.4 | 0.1 | 0.03 | 64 | 1.1 | 0.05 | 42 | 0.7 | 0.27 | 12 |
| LNU585 | 72913.3 | 0.1 | 0.01 | 52 | 1.2 | L | 64 | 0.8 | 0.02 | 25 |
| LNU585 | 72915.1 | 0.1 | L | 62 | 1.5 | L | 95 | 0.7 | 0.09 | 20 |
| LNU585 | 72917.1 | — | — | — | — | — | — | 0.7 | 0.15 | 14 |
| LNU585 | 72917.3 | — | — | — | — | — | — | 0.7 | 0.26 | 12 |
| LNU556 | 72363.2 | 0.1 | L | 86 | 1.3 | 0.01 | 74 | 0.8 | 0.03 | 24 |
| LNU556 | 72364.2 | — | — | — | — | — | — | 0.7 | 0.26 | 11 |
| LNU545 | 72595.2 | 0.1 | 0.02 | 52 | 1.3 | L | 71 | 0.7 | 0.29 | 12 |
| LNU545 | 72596.1 | 0.0 | 0.29 | 25 | — | — | — | — | — | — |
| LNU545 | 72597.1 | 0.1 | 0.13 | 57 | 1.1 | 0.12 | 51 | 0.7 | 0.07 | 22 |
| LNU545 | 72598.1 | 0.1 | 0.02 | 53 | 1.1 | 0.09 | 41 | — | — | — |
| CONT. | — | 0.0 | — | — | 0.8 | — | — | 0.6 | — | — |
| LNU696 | 70599.4 | 0.1 | L | 48 | — | — | — | — | — | — |
| LNU696 | 70600.3 | 0.1 | L | 35 | — | — | — | — | — | — |
| LNU696 | 70600.4 | 0.1 | L | 53 | 0.7 | 0.27 | 16 | — | — | — |
| LNU686 | 70689.2 | 0.0 | 0.18 | 18 | — | — | — | — | — | — |
| LNU686 | 70689.4 | 0.1 | L | 52 | 0.7 | 0.19 | 26 | 0.5 | 0.29 | 11 |
| LNU686 | 70689.5 | 0.1 | 0.06 | 25 | — | — | — | — | — | — |
| LNU627 | 70490.2 | 0.1 | 0.13 | 25 | — | — | — | — | — | — |
| LNU627 | 70491.3 | 0.1 | 0.11 | 31 | — | — | — | — | — | — |
| LNU627 | 70491.5 | 0.1 | L | 62 | 0.7 | 0.23 | 22 | — | — | — |
| LNU627 | 70493.5 | 0.1 | 0.05 | 26 | — | — | — | — | — | — |
| LNU616 | 70505.3 | 0.1 | 0.06 | 24 | — | — | — | — | — | — |
| LNU595 | 70276.1 | 0.1 | 0.11 | 31 | — | — | — | — | — | — |
| LNU595 | 70278.1 | 0.0 | 0.18 | 19 | — | — | — | — | — | — |

TABLE 76-continued

Genes showing improved growth rate at standard nitrogen growth conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU565 | 70623.5 | 0.0 | 0.15 | 19 | — | — | — | — | — | — |
| LNU565 | 70624.5 | — | — | — | 1.1 | L | 82 | — | — | — |
| LNU565 | 70626.4 | 0.0 | 0.22 | 17 | — | — | — | — | — | — |
| LNU542 | 70226.1 | 0.1 | 0.09 | 23 | — | — | — | — | — | — |
| LNU542 | 70229.7 | 0.1 | 0.04 | 27 | — | — | — | — | — | — |
| LNU542 | 70230.2 | 0.1 | 0.12 | 25 | — | — | — | — | — | — |
| LNU539 | 70220.1 | 0.1 | 0.07 | 24 | — | — | — | — | — | — |
| LNU539 | 70221.2 | 0.0 | 0.28 | 14 | — | — | — | — | — | — |
| LNU539 | 70225.3 | 0.1 | 0.02 | 34 | 0.7 | 0.26 | 16 | — | — | — |
| LNU537 | 70215.4 | 0.1 | L | 82 | 1.1 | L | 83 | 0.5 | 0.12 | 12 |
| LNU537 | 70217.2 | 0.1 | L | 85 | 0.9 | L | 62 | 0.5 | 0.06 | 16 |
| LNU537 | 70217.4 | 0.1 | 0.07 | 31 | — | — | — | — | — | — |
| LNU537 | 70218.2 | 0.1 | L | 38 | 0.7 | 0.15 | 20 | — | — | — |
| CONT. | — | 0.0 | — | — | 0.6 | — | — | 0.5 | — | — |
| LNU742 | 71555.2 | 0.1 | 0.17 | 21 | 1.0 | 0.21 | 27 | — | — | — |
| LNU734 | 71646.5 | — | — | — | 1.1 | 0.05 | 38 | 0.7 | 0.02 | 13 |
| LNU734 | 71648.2 | 0.1 | 0.05 | 65 | 1.3 | 0.03 | 62 | 0.7 | 0.28 | 8 |
| LNU734 | 71649.1 | 0.1 | 0.05 | 26 | 1.1 | 0.03 | 41 | 0.8 | L | 17 |
| LNU729 | 71517.4 | 0.1 | 0.04 | 43 | — | — | — | — | — | — |
| LNU729 | 71517.6 | 0.1 | 0.13 | 20 | 0.9 | 0.28 | 19 | 0.7 | 0.09 | 10 |
| LNU729 | 71518.2 | — | — | — | 1.0 | 0.24 | 22 | 0.7 | L | 15 |
| LNU729 | 71519.4 | 0.1 | 0.11 | 22 | 1.0 | 0.08 | 29 | — | — | — |
| LNU729 | 71519.6 | 0.1 | 0.04 | 45 | 1.3 | 0.02 | 59 | — | — | — |
| LNU719 | 71542.3 | 0.1 | 0.07 | 35 | 1.2 | 0.03 | 47 | 0.7 | 0.08 | 11 |
| LNU719 | 71543.1 | 0.1 | 0.10 | 43 | — | — | — | — | — | — |
| LNU708 | 71797.2 | 0.1 | 0.28 | 12 | 1.0 | 0.10 | 27 | 0.8 | L | 18 |
| LNU708 | 71798.3 | 0.1 | 0.22 | 16 | 1.0 | 0.21 | 22 | — | — | — |
| LNU708 | 71798.4 | 0.1 | 0.25 | 18 | 1.1 | 0.04 | 40 | 0.7 | 0.03 | 13 |
| LNU708 | 71801.5 | 0.1 | L | 60 | 1.5 | L | 85 | 0.8 | L | 18 |
| LNU659 | 71850.2 | 0.1 | 0.11 | 21 | 1.0 | 0.10 | 24 | 0.7 | 0.12 | 10 |
| LNU659 | 71853.3 | 0.1 | 0.08 | 24 | 0.9 | 0.29 | 19 | — | — | — |
| LNU659 | 71855.4 | — | — | — | — | — | — | 0.7 | 0.29 | 8 |
| LNU574 | 71790.2 | 0.1 | 0.19 | 29 | 1.3 | 0.05 | 60 | 0.7 | 0.20 | 11 |
| LNU574 | 71790.4 | — | — | — | 1.0 | 0.20 | 21 | 0.7 | 0.02 | 15 |
| LNU574 | 71791.2 | 0.1 | 0.15 | 17 | 1.0 | 0.13 | 23 | 0.7 | 0.02 | 15 |
| LNU574 | 71791.4 | — | — | — | 0.9 | 0.26 | 16 | 0.7 | L | 16 |
| LNU574 | 71792.3 | 0.1 | 0.04 | 35 | 1.1 | 0.04 | 34 | 0.7 | 0.05 | 10 |
| CONT. | — | 0.0 | — | — | 0.8 | — | — | 0.6 | — | — |
| LNU739 | 71630.1 | 0.1 | L | 53 | — | — | — | — | — | — |
| LNU739 | 71630.4 | 0.0 | 0.05 | 28 | 0.8 | L | 55 | 0.5 | 0.23 | 14 |
| LNU715 | 71642.2 | 0.1 | 0.02 | 35 | — | — | — | — | — | — |
| LNU715 | 71643.2 | 0.0 | 0.13 | 19 | — | — | — | — | — | — |
| LNU715 | 71643.3 | — | — | — | 0.6 | 0.29 | 10 | 0.5 | 0.29 | 11 |
| LNU715 | 71645.3 | 0.1 | L | 41 | 0.8 | 0.03 | 44 | — | — | — |
| LNU653 | 70658.3 | 0.0 | 0.03 | 30 | 0.7 | 0.03 | 34 | 0.5 | 0.07 | 28 |
| LNU653 | 70659.1 | 0.0 | 0.18 | 19 | — | — | — | — | — | — |
| LNU653 | 70659.4 | 0.0 | 0.09 | 22 | — | — | — | — | — | — |
| LNU638 | 72139.2 | 0.0 | 0.22 | 16 | — | — | — | — | — | — |
| LNU638 | 72142.1 | 0.1 | 0.01 | 35 | 0.9 | L | 67 | 0.5 | 0.13 | 20 |
| LNU638 | 72142.3 | 0.1 | L | 55 | — | — | — | — | — | — |
| LNU638 | 72144.1 | 0.1 | 0.01 | 33 | — | — | — | — | — | — |
| LNU637 | 71664.2 | 0.0 | 0.19 | 17 | — | — | — | — | — | — |
| LNU637 | 71667.1 | 0.1 | 0.01 | 40 | — | — | — | — | — | — |
| LNU637 | 71669.5 | 0.1 | L | 44 | 1.0 | 0.02 | 83 | 0.5 | 0.13 | 23 |
| LNU637 | 71669.6 | — | — | — | 0.6 | 0.19 | 17 | — | — | — |
| LNU618 | 72133.2 | 0.0 | 0.10 | 26 | 0.7 | 0.02 | 36 | — | — | — |
| LNU559 | 70832.4 | 0.1 | L | 47 | 0.6 | 0.26 | 13 | — | — | — |
| LNU559 | 70834.1 | 0.1 | L | 42 | 0.7 | 0.03 | 27 | — | — | — |
| LNU559 | 70835.1 | 0.1 | 0.03 | 44 | — | — | — | — | — | — |
| LNU559 | 70835.4 | 0.1 | 0.02 | 34 | 0.8 | L | 57 | 0.5 | 0.18 | 24 |
| LNU559 | 70837.2 | 0.0 | 0.11 | 20 | 0.6 | 0.13 | 20 | — | — | — |
| CONT. | — | 0.0 | — | — | 0.5 | — | — | 0.4 | — | — |
| LNU688 | 72694.4 | 0.1 | 0.09 | 32 | 1.4 | 0.08 | 39 | — | — | — |
| LNU661 | 72705.3 | 0.1 | 0.02 | 45 | 1.3 | 0.13 | 28 | — | — | — |
| LNU661 | 72707.2 | 0.1 | L | 60 | 1.5 | 0.02 | 50 | — | — | — |
| LNU611 | 72698.2 | — | — | — | 1.5 | 0.01 | 51 | — | — | — |
| LNU573 | 72590.1 | — | — | — | — | — | — | 0.8 | 0.22 | 8 |
| LNU573 | 72592.1 | 0.1 | 0.07 | 40 | 1.3 | 0.15 | 26 | — | — | — |
| LNU531 | 70212.1 | 0.1 | 0.16 | 29 | — | — | — | — | — | — |

TABLE 76-continued

Genes showing improved growth rate at standard nitrogen growth conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LNU522 | 70802.1 | 0.1 | 0.10 | 31 | — | — | — | — | — | — |
| CONT. | — | 0.0 | — | — | 1.0 | — | — | 0.7 | — | — |

Table 76:
"CONT."—Control;
"Ave."—Average;
"% Incr." = % increment;
"p-val."—p-value;
L means that p-value is less than 0.01, p < 0.1 was considered as significant.

TABLE 77

Genes showing improved growth rate at standard nitrogen growth conditions (T1 generation)

| Gene Name | RGR Of Leaf Area | | | RGR Of Roots Coverage | | | RGR Of Root Length | | |
|---|---|---|---|---|---|---|---|---|---|
| | Ave. | P-Val. | % Incr. | Ave. | P-Val. | % Incr. | Ave. | P-Val. | % Incr. |
| LNU583 | — | — | — | 0.8 | 0.13 | 33 | 0.7 | 0.05 | 28 |
| CONT. | — | — | — | 0.6 | — | — | 0.5 | — | — |
| LNU667 | 0.1 | 0.29 | 16 | — | — | — | — | — | — |
| CONT. | 0.0 | — | — | — | — | — | — | — | — |
| LNU585 | 0.1 | 0.10 | 34 | 1.0 | 0.01 | 47 | 0.8 | 0.03 | 22 |
| LNU545 | 0.1 | 0.16 | 32 | 1.0 | 0.12 | 45 | — | — | — |
| CONT. | 0.1 | — | — | 0.7 | — | — | 0.6 | — | — |

Table 77. "CONT."—Control; "Ave."—Average; "% Incr." = % increment; "p-val."—p-value; L means that p-value is less than 0.01, p < 0.1 was considered as significant.

Example 19

Evaluation of Transgenic *Arabidopsis* Nue, Yield and Plant Growth Rate Under Low or Normal Nitrogen Fertilization in Greenhouse Assay Assay 1: Nitrogen Use Efficiency: Seed Yield, Plant Biomass and Plant Growth Rate at Limited and Optimal Nitrogen Concentration Under Greenhouse Conditions (Greenhouse-Seed Maturation)—

This assay follows seed yield production, the biomass formation and the rosette area growth of plants grown in the greenhouse at limiting and non-limiting (optimal) nitrogen growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing nitrogen limiting conditions, which were achieved by irrigating the plants with a solution containing 1.5 mM inorganic nitrogen in the form of $KNO_3$, supplemented with 1 mM $KH_2PO_4$, 1 mM $MgSO_4$, 3.6 mM KCl, 2 mM $CaCl_2$ and microelements, while normal nitrogen levels were achieved by applying a solution of 6 mM inorganic nitrogen also in the form of $KNO_3$ with 1 mM $KH_2PO_4$, 1 mM $MgSO_4$, 2 mM $CaCl_2$ and microelements. All plants were grown in the greenhouse until mature seeds. Seeds were harvested, extracted and weighted. The remaining plant biomass (the above ground tissue) was also harvested, and weighted immediately or following drying in oven at 50° C. for 24 hours.

Each construct was validated at its $T_2$ generation. Transgenic plants transformed with a construct conformed by an empty vector carrying the At6669 promoter and the selectable marker was used as control.

The plants were analyzed for their overall size, growth rate, flowering, seed yield, 1,000-seed weight, dry matter and harvest index (HI-seed yield/dry matter). Transgenic plants performance was compared to control plants grown in parallel under identical growth conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital Imaging—

A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which is developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf Analysis—

Using the digital analysis leaves data was calculated, including leaf number, rosette area, rosette diameter, leaf blade area.

Vegetative Growth Rate:

the relative growth rate (RGR) of leaf number [formula VI (described above)], rosette area [formula VII (described above)], plot coverage [formula IX (described above)] and harvest index [formula IV (described above)] was calculated with the indicated formulas.

Seeds Average Weight—

At the end of the experiment all seeds were collected. The seeds were scattered on a glass tray and a picture was taken. Using the digital analysis, the number of seeds in each sample was calculated.

Dry Weight and Seed Yield—

On about day 80 from sowing, the plants were harvested and left to dry at 30° C. in a drying chamber. The biomass and seed weight of each plot were measured and divided by the number of plants in each plot. Dry weight=total weight of the vegetative portion above ground (excluding roots) after drying at 30° C. in a drying chamber; Seed yield per plant=total seed weight per plant (gr). 1000 seed weight (the weight of 1000 seeds) (gr.).

The harvest index (HI) was calculated using Formula IV as described above.

Oil Percentage in Seeds—

At the end of the experiment all seeds from each plot were collected. Seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingler's) 1879, 232, 461) was used to create a calibration curve for the Low Resonance NMR. The content of oil of all seed samples was determined using the Low Resonance NMR (MARAN Ultra—Oxford Instrument) and its Multi-Quant software package Silique Length Analysis—

On day 50 from sowing, 30 siliques from different plants in each plot were sampled in block A. The chosen siliques were green-yellow in color and were collected from the bottom parts of a grown plant's stem. A digital photograph was taken to determine silique's length.

Statistical Analyses—

To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Tables 78-87 summarize the observed phenotypes of transgenic plants exogenously expressing the gene constructs using the greenhouse seed maturation (GH-SM) assays under low nitrogen (Tables 78-82) or normal nitrogen (Tables 83-87) conditions. The evaluation of each gene was performed by testing the performance of different number of events. Event with p-value<0.1 was considered statistically significant.

TABLE 78

Genes showing improved plant performance at low Nitrogen growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LNU721 | 70610.6 | 597.5 | 0.05 | 33 | — | — | — | — | — | — |
| LNU721 | 70613.4 | 616.2 | 0.25 | 37 | 16.5 | 0.05 | −7 | — | — | — |
| LNU700 | 70406.3 | — | — | — | 16.7 | L | −6 | — | — | — |
| LNU700 | 70407.1 | 497.5 | 0.03 | 11 | 17.1 | 0.28 | −4 | — | — | — |
| LNU700 | 70411.1 | 591.2 | L | 32 | 17.1 | 0.28 | −4 | — | — | — |
| LNU690 | 70694.2 | 532.5 | L | 19 | 16.8 | L | −5 | — | — | — |
| LNU690 | 70694.3 | 615.0 | 0.10 | 37 | — | — | — | — | — | — |
| LNU690 | 70695.3 | 477.5 | 0.16 | 6 | 16.6 | L | −7 | — | — | — |
| LNU680 | 70593.1 | 500.6 | 0.20 | 12 | — | — | — | — | — | — |
| LNU680 | 70593.2 | 520.6 | 0.28 | 16 | — | — | — | — | — | — |
| LNU679 | 70790.1 | — | — | — | 17.3 | 0.06 | −3 | — | — | — |
| LNU679 | 70794.3 | 693.8 | L | 55 | — | — | — | — | — | — |
| LNU662 | 70341.3 | 568.1 | 0.08 | 27 | — | — | — | — | — | — |
| LNU662 | 70342.2 | 537.5 | 0.19 | 20 | 17.0 | 0.15 | −5 | — | — | — |
| LNU662 | 70343.1 | 611.9 | 0.01 | 36 | 16.6 | L | −7 | — | — | — |
| LNU631 | 70316.4 | 678.1 | L | 51 | — | — | — | — | — | — |
| LNU631 | 70318.1 | 486.2 | 0.15 | 8 | — | — | — | — | — | — |
| LNU631 | 70318.2 | — | — | — | 16.6 | L | −7 | — | — | — |
| LNU631 | 70320.1 | — | — | — | 17.1 | 0.28 | −4 | — | — | — |
| LNU629 | 70313.1 | 537.5 | L | 20 | — | — | — | — | — | — |
| LNU628 | 70754.2 | 617.5 | 0.16 | 38 | — | — | — | — | — | — |

TABLE 78-continued

Genes showing improved plant performance at low Nitrogen growth conditions under regulation of At6669 promoter

| Gene Name | Event # | Dry Weight [mg] Ave. | P-Val. | % Incr. | Flowering Ave. | P-Val. | % Incr. | Inflorescence Emergence Ave. | P-Val. | % Incr. |
|---|---|---|---|---|---|---|---|---|---|---|
| LNU628 | 70756.2 | 552.2 | L | 23 | — | — | — | — | — | — |
| LNU628 | 70756.3 | 656.9 | L | 46 | — | — | — | — | — | — |
| LNU628 | 70759.1 | 482.0 | 0.08 | 7 | — | — | — | — | — | — |
| LNU621 | 70306.1 | — | — | — | 17.3 | 0.01 | −3 | — | — | — |
| LNU621 | 70306.3 | 688.1 | 0.07 | 53 | 16.6 | L | −7 | — | — | — |
| LNU609 | 70773.2 | 663.1 | 0.03 | 48 | 16.4 | L | −8 | — | — | — |
| LNU609 | 70774.4 | — | — | — | 17.4 | 0.11 | −2 | — | — | — |
| LNU609 | 70776.4 | 687.9 | L | 53 | 16.2 | 0.07 | −9 | — | — | — |
| LNU609 | 70777.1 | — | — | — | 17.4 | 0.05 | −2 | — | — | — |
| LNU602 | 70382.5 | — | — | — | 16.2 | 0.04 | −9 | — | — | — |
| LNU602 | 70383.4 | — | — | — | 16.7 | 0.07 | −6 | — | — | — |
| LNU602 | 70384.2 | 540.6 | 0.17 | 21 | 17.0 | 0.15 | −5 | — | — | — |
| LNU602 | 70385.3 | 536.2 | L | 20 | — | — | — | — | — | — |
| LNU564 | 70838.1 | 479.4 | 0.20 | 7 | — | — | — | — | — | — |
| LNU564 | 70839.2 | 540.6 | 0.30 | 21 | — | — | — | — | — | — |
| LNU564 | 70843.3 | 497.5 | 0.04 | 11 | — | — | — | — | — | — |
| LNU550 | 70766.2 | — | — | — | 17.3 | 0.05 | −3 | — | — | — |
| LNU550 | 70770.4 | — | — | — | 17.0 | 0.15 | −5 | — | — | — |
| LNU550 | 70771.4 | — | — | — | 16.9 | 0.22 | −5 | — | — | — |
| LNU544 | 70232.1 | 484.4 | 0.22 | 8 | 16.4 | L | −8 | — | — | — |
| LNU544 | 70234.1 | — | — | — | 16.5 | L | −7 | — | — | — |
| LNU544 | 70234.3 | — | — | — | 17.6 | 0.26 | −1 | — | — | — |
| LNU544 | 70237.3 | — | — | — | 16.5 | L | −7 | — | — | — |
| LNU536 | 70820.3 | — | — | — | 17.5 | 0.29 | −2 | — | — | — |
| LNU536 | 70821.1 | 501.2 | 0.06 | 12 | 17.4 | 0.05 | −2 | — | — | — |
| LNU536 | 70821.2 | 496.9 | 0.07 | 11 | — | — | — | — | — | — |
| LNU529 | 70474.1 | 675.4 | L | 51 | — | — | — | — | — | — |
| LNU529 | 70475.2 | 486.2 | 0.06 | 8 | 17.6 | 0.26 | −1 | — | — | — |
| LNU529 | 70475.4 | 621.2 | 0.04 | 39 | — | — | — | — | — | — |
| LNU529 | 70476.3 | — | — | — | 17.1 | 0.28 | −4 | — | — | — |
| CONT. | — | 448.5 | — | — | 17.8 | — | — | — | — | — |
| LNU733 | 71227.3 | 397.5 | 0.07 | 12 | 22.8 | 0.12 | −1 | 16.0 | 0.26 | −1 |
| LNU730 | 71217.6 | — | — | — | 22.6 | 0.01 | −3 | — | — | — |
| LNU704 | 70797.1 | 410.0 | 0.03 | 16 | — | — | — | — | — | — |
| LNU704 | 70798.3 | 396.2 | 0.09 | 12 | 22.5 | 0.10 | −3 | — | — | — |
| LNU704 | 70800.4 | — | — | — | 22.9 | 0.13 | −1 | — | — | — |
| LNU692 | 71482.2 | 386.2 | 0.18 | 9 | — | — | — | — | — | — |
| LNU692 | 71483.3 | — | — | — | — | — | — | 16.0 | 0.26 | −1 |
| LNU691 | 71436.2 | — | — | — | 22.8 | 0.12 | −1 | — | — | — |
| LNU691 | 71436.4 | — | — | — | 22.6 | 0.03 | −2 | — | — | — |
| LNU691 | 71439.2 | 392.5 | 0.09 | 11 | — | — | — | — | — | — |
| LNU691 | 71441.1 | — | — | — | 22.2 | 0.02 | −4 | 16.0 | 0.26 | −1 |
| LNU680 | 70593.5 | 421.2 | 0.02 | 19 | — | — | — | — | — | — |
| LNU680 | 70595.5 | — | — | — | 22.9 | 0.19 | −1 | 16.0 | 0.26 | −1 |
| LNU679 | 70790.2 | — | — | — | 22.6 | 0.03 | −2 | — | — | — |
| LNU679 | 70794.2 | — | — | — | 22.6 | 0.01 | −3 | — | — | — |
| LNU679 | 70794.3 | — | — | — | 22.9 | 0.13 | −1 | — | — | — |
| LNU664 | 71291.3 | 386.2 | 0.21 | 9 | — | — | — | — | — | — |
| LNU640 | 71017.4 | — | — | — | — | — | — | 16.0 | 0.26 | −1 |
| LNU640 | 71022.8 | — | — | — | 22.7 | 0.19 | −2 | — | — | — |
| LNU628 | 70756.2 | 382.5 | 0.21 | 8 | — | — | — | — | — | — |
| LNU628 | 70756.3 | — | — | — | — | — | — | 16.0 | 0.26 | −1 |
| LNU628 | 70759.1 | — | — | — | 22.8 | 0.05 | −2 | — | — | — |
| LNU613 | 71616.6 | 409.4 | 0.08 | 16 | — | — | — | — | — | — |
| LNU613 | 71621.1 | 445.0 | 0.18 | 26 | — | — | — | — | — | — |
| LNU609 | 70773.2 | 408.1 | 0.17 | 15 | 22.2 | L | −4 | 16.0 | 0.26 | −1 |
| LNU609 | 70774.4 | 389.4 | 0.12 | 10 | 22.9 | 0.19 | −1 | 16.0 | 0.26 | −1 |
| LNU609 | 70776.4 | — | — | — | 22.9 | 0.17 | −1 | — | — | — |
| LNU564 | 70838.1 | — | — | — | 22.4 | L | −3 | — | — | — |
| LNU564 | 70838.2 | — | — | — | 22.8 | 0.12 | −1 | — | — | — |
| LNU561 | 71346.8 | 469.4 | L | 33 | 22.3 | 0.26 | −4 | 16.0 | 0.26 | −1 |
| LNU561 | 71349.1 | — | — | — | 22.4 | L | −3 | 16.0 | 0.26 | −1 |
| LNU550 | 70770.1 | 377.5 | 0.28 | 7 | 22.7 | 0.19 | −2 | 16.0 | 0.26 | −1 |
| LNU550 | 70770.4 | 408.1 | 0.23 | 15 | — | — | — | 16.0 | 0.26 | −1 |
| LNU550 | 70771.4 | — | — | — | 22.1 | 0.04 | −5 | 16.0 | 0.26 | −1 |
| LNU536 | 70820.3 | 400.0 | 0.05 | 13 | 22.3 | 0.26 | −4 | 16.0 | 0.26 | −1 |
| CONT. | — | 354.1 | — | — | 23.2 | — | — | 16.1 | — | — |
| LNU744 | 71485.1 | — | — | — | 24.3 | 0.11 | −7 | — | — | — |
| LNU736 | 71233.1 | — | — | — | 25.0 | 0.02 | −5 | — | — | — |
| LNU736 | 71235.1 | 267.1 | 0.18 | 6 | — | — | — | — | — | — |
| LNU736 | 71237.2 | — | — | — | 24.5 | L | −7 | — | — | — |

TABLE 78-continued

Genes showing improved plant performance at low Nitrogen
growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LNU733 | 71227.3 | 300.0 | 0.01 | 18 | — | — | — | — | — | — |
| LNU733 | 71228.1 | — | — | — | 25.4 | 0.12 | −3 | — | — | — |
| LNU730 | 71215.5 | 301.2 | 0.19 | 19 | 25.5 | 0.30 | −3 | — | — | — |
| LNU730 | 71217.2 | — | — | — | 25.4 | 0.14 | −3 | — | — | — |
| LNU704 | 70797.1 | 276.2 | 0.04 | 9 | 24.8 | L | −6 | — | — | — |
| LNU704 | 70798.2 | — | — | — | 24.1 | 0.02 | −8 | — | — | — |
| LNU698 | 70883.1 | — | — | — | 24.5 | 0.23 | −7 | — | — | — |
| LNU698 | 70883.3 | 273.8 | 0.06 | 8 | 24.8 | 0.15 | −6 | — | — | — |
| LNU698 | 70883.4 | — | — | — | 24.9 | 0.10 | −5 | — | — | — |
| LNU698 | 70885.4 | — | — | — | 25.3 | 0.17 | −4 | — | — | — |
| LNU694 | 71128.6 | 315.0 | 0.08 | 24 | — | — | — | — | — | — |
| LNU694 | 71129.2 | 276.2 | 0.04 | 9 | — | — | — | — | — | — |
| LNU685 | 71122.1 | — | — | — | 25.1 | 0.05 | −4 | — | — | — |
| LNU685 | 71123.3 | — | — | — | 25.1 | 0.06 | −4 | — | — | — |
| LNU665 | 71077.1 | — | — | — | 24.1 | 0.09 | −8 | — | — | — |
| LNU665 | 71082.4 | 273.1 | 0.07 | 8 | — | — | — | — | — | — |
| LNU664 | 71292.1 | 293.9 | 0.08 | 16 | — | — | — | — | — | — |
| LNU663 | 71071.6 | 274.4 | 0.12 | 8 | 24.6 | 0.26 | −6 | — | — | — |
| LNU663 | 71072.5 | — | — | — | 25.4 | 0.12 | −3 | — | — | — |
| LNU663 | 71075.3 | — | — | — | 24.8 | 0.14 | −5 | — | — | — |
| LNU640 | 71017.2 | — | — | — | 25.3 | 0.17 | −4 | — | — | — |
| LNU640 | 71017.4 | — | — | — | 25.1 | 0.25 | −5 | — | — | — |
| LNU568 | 70846.3 | — | — | — | 25.4 | 0.16 | −3 | — | — | — |
| LNU557 | 71400.4 | — | — | — | 24.8 | 0.04 | −6 | — | — | — |
| LNU557 | 71402.2 | — | — | — | 25.3 | 0.20 | −4 | — | — | — |
| LNU557 | 71404.2 | — | — | — | 24.9 | 0.02 | −5 | — | — | — |
| LNU548 | 70570.4 | 295.6 | 0.06 | 17 | 25.5 | 0.12 | −3 | — | — | — |
| LNU548 | 70570.5 | — | — | — | 25.3 | 0.16 | −4 | — | — | — |
| LNU548 | 70573.5 | — | — | — | 24.9 | 0.01 | −5 | — | — | — |
| LNU526 | 70816.2 | 303.5 | 0.23 | 20 | 25.7 | 0.29 | −2 | — | — | — |
| CONT. | — | 253.2 | — | — | 26.3 | — | — | — | — | — |
| LNU700 | 70406.3 | — | — | — | 16.9 | L | −7 | — | — | — |
| LNU700 | 70407.1 | — | — | — | 17.0 | 0.01 | −6 | 14.9 | 0.25 | −3 |
| LNU675 | 70403.2 | 414.4 | 0.05 | 6 | — | — | — | — | — | — |
| LNU675 | 70405.3 | 407.5 | 0.15 | 4 | — | — | — | — | — | — |
| LNU662 | 70342.2 | — | — | — | 17.3 | 0.05 | −4 | — | — | — |
| LNU662 | 70343.1 | 539.3 | L | 38 | 17.2 | 0.29 | −5 | 14.7 | L | −5 |
| LNU662 | 70343.3 | 441.2 | 0.05 | 13 | — | — | — | — | — | — |
| LNU657 | 70334.10 | — | — | — | 17.2 | 0.04 | −5 | 14.7 | L | −5 |
| LNU641 | 70632.3 | 426.9 | 0.12 | 9 | — | — | — | — | — | — |
| LNU641 | 70633.5 | 428.8 | 0.18 | 10 | — | — | — | — | — | — |
| LNU631 | 70316.2 | 404.4 | 0.27 | 3 | — | — | — | — | — | — |
| LNU631 | 70316.4 | 415.6 | 0.04 | 6 | — | — | — | — | — | — |
| LNU631 | 70318.2 | 430.0 | 0.03 | 10 | — | — | — | — | — | — |
| LNU631 | 70320.1 | — | — | — | 16.1 | 0.01 | −10 | — | — | — |
| LNU629 | 70311.2 | — | — | — | 16.3 | 0.08 | −10 | 14.7 | L | −5 |
| LNU629 | 70312.1 | 404.4 | 0.21 | 3 | — | — | — | — | — | — |
| LNU621 | 70304.2 | 433.1 | 0.14 | 11 | — | — | — | — | — | — |
| LNU621 | 70305.1 | 500.8 | 0.14 | 28 | 17.1 | 0.02 | −5 | — | — | — |
| LNU621 | 70308.3 | 443.8 | L | 13 | — | — | — | — | — | — |
| LNU602 | 70382.2 | 408.1 | 0.24 | 4 | — | — | — | — | — | — |
| LNU602 | 70382.5 | — | — | — | 17.2 | 0.29 | −5 | — | — | — |
| LNU602 | 70383.4 | 418.8 | 0.04 | 7 | — | — | — | — | — | — |
| LNU602 | 70384.2 | 414.4 | 0.05 | 6 | 16.8 | 0.01 | −7 | — | — | — |
| LNU600 | 70484.3 | — | — | — | — | — | — | 15.1 | L | −2 |
| LNU600 | 70486.4 | 403.8 | 0.24 | 3 | — | — | — | — | — | — |
| LNU600 | 70488.2 | 436.2 | 0.28 | 11 | 17.3 | 0.05 | −4 | — | — | — |
| LNU587 | 70379.3 | — | — | — | 17.5 | 0.16 | −3 | — | — | — |
| LNU587 | 70380.3 | — | — | — | 16.9 | 0.17 | −6 | — | — | — |
| LNU587 | 70380.5 | 428.1 | L | 9 | 17.0 | 0.01 | −6 | — | — | — |
| LNU587 | 70381.1 | 433.8 | 0.08 | 11 | 17.5 | 0.16 | −3 | — | — | — |
| LNU582 | 70258.2 | 443.8 | 0.03 | 13 | — | — | — | — | — | — |
| LNU582 | 70259.3 | 457.5 | L | 17 | — | — | — | — | — | — |
| LNU582 | 70260.1 | 433.3 | 0.05 | 11 | 17.1 | 0.02 | −5 | — | — | — |
| LNU560 | 70240.5 | 410.6 | 0.15 | 5 | — | — | — | — | — | — |
| LNU560 | 70241.4 | — | — | — | — | — | — | 15.1 | L | −2 |
| LNU560 | 70243.4 | — | — | — | 17.5 | 0.16 | −3 | — | — | — |
| LNU553 | 70370.1 | — | — | — | 17.7 | 0.24 | −2 | — | — | — |
| LNU553 | 70372.2 | 430.6 | 0.29 | 10 | — | — | — | — | — | — |
| LNU553 | 70373.1 | 430.0 | L | 10 | — | — | — | — | — | — |
| LNU553 | 70374.1 | 507.5 | 0.03 | 30 | — | — | — | — | — | — |

TABLE 78-continued

Genes showing improved plant performance at low Nitrogen growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LNU553 | 70375.1 | 429.3 | 0.23 | 10 | — | — | — | — | — | — |
| LNU544 | 70232.1 | 463.1 | 0.26 | 18 | — | — | — | — | — | — |
| LNU544 | 70237.2 | — | — | — | 17.5 | 0.16 | −3 | 15.1 | L | −2 |
| LNU544 | 70237.3 | 438.1 | 0.18 | 12 | — | — | — | — | — | — |
| LNU532 | 70556.4 | 440.1 | L | 12 | — | — | — | — | — | — |
| LNU532 | 70556.5 | 512.5 | 0.29 | 31 | — | — | — | — | — | — |
| LNU530 | 70203.1 | 411.9 | 0.11 | 5 | — | — | — | — | — | — |
| LNU530 | 70204.1 | — | — | — | 17.2 | 0.29 | −5 | — | — | — |
| CONT. | — | 391.4 | — | — | 18.0 | — | — | 15.4 | — | — |

Table 78. "CONT."—Control; "Ave."—Average; "% Incr." = % increment; "p-val."—p-value; L means that p-value is less than 0.01, p < 0.1 was considered as significant. The transgenes were under the transcriptional regulation of the new At6669 promoter (SEQ ID NO: 6052).

TABLE 79

Genes showing improved plant performance at Low N growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LNU721 | 70613.1 | — | — | — | 10.3 | 0.25 | 3 | — | — | — |
| LNU721 | 70613.4 | — | — | — | 10.5 | 0.11 | 5 | 82.5 | 0.20 | 10 |
| LNU721 | 70614.1 | 1.5 | 0.03 | 10 | — | — | — | 83.5 | 0.11 | 12 |
| LNU700 | 70406.3 | — | — | — | 10.6 | 0.07 | 6 | — | — | — |
| LNU700 | 70410.2 | — | — | — | 11.1 | 0.04 | 11 | — | — | — |
| LNU700 | 70410.4 | — | — | — | 10.5 | 0.09 | 5 | — | — | — |
| LNU690 | 70694.2 | — | — | — | — | — | — | 84.5 | 0.28 | 13 |
| LNU690 | 70695.3 | — | — | — | 10.9 | 0.11 | 10 | 82.3 | L | 10 |
| LNU690 | 70696.4 | — | — | — | 10.6 | 0.16 | 6 | — | — | — |
| LNU680 | 70593.2 | 1.5 | 0.29 | 9 | 10.4 | 0.17 | 4 | 85.6 | 0.30 | 14 |
| LNU680 | 70593.5 | 1.5 | 0.28 | 13 | — | — | — | 86.3 | L | 15 |
| LNU680 | 70595.4 | — | — | — | 10.6 | 0.06 | 6 | — | — | — |
| LNU679 | 70790.2 | — | — | — | 10.5 | 0.11 | 5 | — | — | — |
| LNU679 | 70794.2 | — | — | — | 10.4 | 0.21 | 5 | — | — | — |
| LNU679 | 70794.3 | — | — | — | — | — | — | 82.8 | 0.19 | 11 |
| LNU662 | 70342.1 | — | — | — | — | — | — | 87.7 | 0.27 | 17 |
| LNU662 | 70342.2 | — | — | — | — | — | — | 86.9 | 0.07 | 16 |
| LNU662 | 70343.1 | 1.4 | 0.05 | 7 | 10.6 | 0.29 | 6 | 83.7 | 0.02 | 12 |
| LNU662 | 70343.3 | 1.7 | 0.05 | 22 | 10.8 | 0.02 | 8 | 99.4 | L | 33 |
| LNU631 | 70318.1 | 1.5 | 0.02 | 10 | — | — | — | 87.6 | 0.02 | 17 |
| LNU631 | 70318.2 | 1.5 | 0.14 | 8 | 10.4 | 0.13 | 5 | 85.8 | 0.02 | 15 |
| LNU631 | 70320.1 | 1.6 | L | 20 | 11.0 | L | 10 | 95.4 | L | 27 |
| LNU629 | 70311.2 | 1.5 | L | 11 | 11.0 | 0.15 | 10 | 94.6 | L | 26 |
| LNU629 | 70313.1 | 1.5 | 0.04 | 10 | 11.0 | 0.15 | 10 | 87.3 | L | 17 |
| LNU628 | 70754.2 | — | — | — | 11.2 | 0.24 | 12 | 88.5 | 0.14 | 18 |
| LNU628 | 70758.4 | — | — | — | 10.4 | 0.21 | 4 | — | — | — |
| LNU621 | 70306.1 | 1.6 | L | 21 | — | — | — | 99.4 | 0.07 | 33 |
| LNU609 | 70773.2 | 1.5 | 0.04 | 11 | 10.8 | 0.23 | 8 | 90.4 | 0.11 | 21 |
| LNU609 | 70776.4 | — | — | — | 10.6 | 0.05 | 6 | — | — | — |
| LNU609 | 70777.3 | — | — | — | 10.8 | 0.05 | 8 | — | — | — |
| LNU602 | 70382.2 | — | — | — | — | — | — | 78.7 | 0.11 | 5 |
| LNU602 | 70383.4 | 1.4 | 0.10 | 5 | 10.8 | 0.11 | 8 | 79.1 | 0.23 | 6 |
| LNU602 | 70384.2 | 1.6 | L | 17 | 11.3 | L | 13 | 94.7 | L | 27 |
| LNU602 | 70385.3 | 1.5 | 0.11 | 10 | — | — | — | 83.9 | 0.17 | 12 |
| LNU564 | 70838.1 | — | — | — | 10.8 | 0.02 | 8 | — | — | — |
| LNU564 | 70839.4 | 1.5 | 0.02 | 12 | 10.3 | 0.25 | 3 | 85.1 | L | 14 |
| LNU550 | 70767.3 | — | — | — | 10.3 | 0.25 | 3 | — | — | — |
| LNU550 | 70770.1 | 1.7 | 0.04 | 29 | 11.0 | 0.05 | 10 | 100.9 | L | 35 |
| LNU550 | 70770.4 | — | — | — | 10.5 | 0.11 | 5 | — | — | — |
| LNU550 | 70771.4 | 1.7 | 0.13 | 27 | 10.8 | 0.11 | 8 | 102.1 | L | 36 |
| LNU544 | 70232.1 | — | — | — | 10.5 | 0.23 | 5 | — | — | — |
| LNU544 | 70234.1 | — | — | — | — | — | — | 79.0 | 0.15 | 5 |
| LNU536 | 70820.3 | — | — | — | 10.6 | 0.26 | 6 | 80.8 | 0.10 | 8 |
| LNU536 | 70821.1 | 1.5 | L | 13 | — | — | — | 88.1 | L | 18 |
| LNU536 | 70822.3 | — | — | — | 10.6 | 0.26 | 6 | — | — | — |

TABLE 79-continued

Genes showing improved plant performance at Low N growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LNU529 | 70474.1 | 1.5 | L | 10 | 10.9 | 0.08 | 9 | 85.0 | 0.25 | 14 |
| LNU529 | 70475.2 | — | — | — | 10.6 | 0.07 | 6 | — | — | — |
| LNU529 | 70477.3 | — | — | — | 10.9 | 0.02 | 9 | — | — | — |
| CONT. | — | 1.4 | — | — | 10.0 | — | — | 74.9 | — | — |
| LNU733 | 71227.2 | 1.2 | L | 31 | — | — | — | 67.0 | L | 27 |
| LNU733 | 71227.3 | 1.2 | L | 23 | — | — | — | 61.1 | L | 16 |
| LNU730 | 71217.6 | — | — | — | — | — | — | 57.4 | 0.12 | 9 |
| LNU704 | 70798.3 | 1.0 | 0.17 | 7 | 10.4 | 0.26 | 3 | 59.7 | 0.14 | 13 |
| LNU692 | 71481.3 | 1.0 | 0.19 | 5 | — | — | — | — | — | — |
| LNU691 | 71436.2 | 1.0 | 0.23 | 4 | — | — | — | 56.9 | 0.11 | 8 |
| LNU691 | 71439.2 | 1.0 | 0.23 | 7 | — | — | — | 57.5 | 0.04 | 9 |
| LNU691 | 71441.2 | — | — | — | 10.9 | 0.02 | 8 | — | — | — |
| LNU680 | 70593.5 | 1.0 | 0.04 | 9 | — | — | — | 60.0 | L | 14 |
| LNU679 | 70790.2 | 1.0 | 0.09 | 6 | — | — | — | 60.9 | 0.01 | 15 |
| LNU666 | 71388.2 | — | — | — | 10.6 | 0.19 | 6 | 64.5 | 0.21 | 22 |
| LNU628 | 70758.4 | 1.1 | 0.22 | 17 | — | — | — | 64.7 | 0.16 | 23 |
| LNU613 | 71619.2 | 1.0 | 0.09 | 7 | — | — | — | — | — | — |
| LNU613 | 71621.3 | 1.1 | L | 19 | — | — | — | — | — | — |
| LNU613 | 71621.4 | — | — | — | 10.5 | 0.28 | 4 | 65.6 | 0.04 | 24 |
| LNU609 | 70776.4 | 1.1 | 0.25 | 18 | — | — | — | — | — | — |
| LNU564 | 70839.2 | 1.0 | 0.07 | 7 | — | — | — | 57.0 | 0.06 | 8 |
| LNU561 | 71346.8 | 1.2 | L | 24 | 11.1 | 0.24 | 11 | 71.1 | 0.09 | 35 |
| LNU561 | 71349.1 | 1.0 | 0.24 | 8 | — | — | — | — | — | — |
| LNU550 | 70770.4 | — | — | — | — | — | — | 56.1 | 0.20 | 7 |
| LNU550 | 70771.4 | 1.1 | 0.13 | 13 | — | — | — | 63.4 | 0.25 | 20 |
| LNU536 | 70821.1 | 1.1 | 0.01 | 12 | — | — | — | 58.3 | 0.04 | 11 |
| CONT. | — | 1.0 | — | — | 10.1 | — | — | 52.7 | — | — |
| LNU744 | 71485.1 | 1.4 | 0.12 | 8 | — | — | — | — | — | — |
| LNU730 | 71215.5 | — | — | — | — | — | — | 95.7 | 0.15 | 17 |
| LNU698 | 70883.1 | — | — | — | — | — | — | 90.1 | 0.26 | 11 |
| LNU640 | 71017.4 | — | — | — | 12.1 | 0.21 | 3 | — | — | — |
| LNU568 | 70848.2 | — | — | — | 12.1 | 0.25 | 3 | — | — | — |
| LNU526 | 70814.3 | 1.3 | 0.22 | 5 | — | — | — | 85.9 | 0.24 | 5 |
| LNU526 | 70816.2 | — | — | — | 12.6 | 0.02 | 7 | — | — | — |
| CONT. | — | 1.3 | — | — | 11.8 | — | — | 81.5 | — | — |
| LNU700 | 70410.2 | 1.4 | 0.25 | 13 | — | — | — | — | — | — |
| LNU700 | 70410.4 | 1.3 | 0.29 | 4 | — | — | — | — | — | — |
| LNU675 | 70401.2 | — | — | — | 10.1 | 0.23 | 3 | — | — | — |
| LNU662 | 70342.2 | 1.3 | 0.19 | 7 | 10.8 | 0.22 | 9 | 79.5 | 0.02 | 14 |
| LNU641 | 70628.2 | 1.3 | 0.11 | 6 | — | — | — | — | — | — |
| LNU641 | 70632.1 | 1.3 | 0.17 | 5 | — | — | — | — | — | — |
| LNU631 | 70316.2 | — | — | — | 10.3 | 0.03 | 5 | — | — | — |
| LNU631 | 70318.2 | 1.4 | 0.16 | 13 | — | — | — | 77.0 | 0.29 | 11 |
| LNU631 | 70320.1 | 1.3 | 0.16 | 9 | — | — | — | — | — | — |
| LNU629 | 70311.2 | — | — | — | 10.7 | 0.05 | 8 | 78.0 | 0.09 | 12 |
| LNU621 | 70306.1 | 1.4 | 0.28 | 14 | — | — | — | 77.7 | 0.15 | 12 |
| LNU621 | 70306.3 | 1.3 | 0.01 | 11 | — | — | — | 73.3 | 0.22 | 5 |
| LNU600 | 70484.3 | — | — | — | 10.1 | 0.25 | 2 | — | — | — |
| LNU600 | 70486.2 | — | — | — | 10.2 | 0.11 | 4 | — | — | — |
| LNU587 | 70378.1 | 1.4 | 0.12 | 15 | 10.4 | 0.01 | 6 | 78.1 | 0.03 | 12 |
| LNU587 | 70380.5 | 1.4 | L | 16 | — | — | — | 75.1 | 0.14 | 8 |
| LNU582 | 70259.2 | 1.4 | 0.04 | 15 | 10.3 | 0.17 | 5 | 80.0 | 0.19 | 15 |
| LNU582 | 70259.3 | — | — | — | 10.7 | 0.18 | 8 | — | — | — |
| LNU582 | 70260.1 | — | — | — | — | — | — | 79.7 | 0.24 | 15 |
| LNU560 | 70243.4 | 1.4 | 0.02 | 13 | — | — | — | 75.2 | 0.10 | 8 |
| LNU553 | 70372.2 | — | — | — | 10.1 | 0.23 | 3 | — | — | — |
| LNU553 | 70374.1 | — | — | — | 10.3 | 0.03 | 5 | 76.4 | 0.14 | 10 |
| LNU532 | 70556.4 | 1.4 | 0.24 | 11 | 10.4 | 0.11 | 6 | 76.8 | 0.06 | 11 |
| LNU532 | 70556.5 | — | — | — | 10.2 | 0.09 | 3 | — | — | — |
| LNU530 | 70205.6 | 1.5 | L | 21 | — | — | — | 82.2 | 0.07 | 18 |
| LNU529 | 70474.1 | 1.3 | 0.02 | 10 | — | — | — | 76.3 | 0.17 | 10 |
| LNU529 | 70477.3 | — | — | — | 10.6 | 0.22 | 7 | — | — | — |
| CONT. | — | 1.2 | — | — | 9.9 | — | — | 69.5 | — | — |

Table 79. "CONT."—Control; "Ave."—Average; "% Incr." = % increment; "p-val."—p-value; L means that p-value is less than 0.01, p < 0.1 was considered as significant. The transgenes were under the transcriptional regulation of the new At6669 promoter (SEQ ID NO: 6052).

TABLE 80

Genes showing improved plant performance at low Nitrogen growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU721 | 70613.4 | 0.8 | 0.19 | 19 | — | — | — | — | — | — |
| LNU700 | 70407.1 | — | — | — | 11.7 | 0.25 | 17 | — | — | — |
| LNU700 | 70410.2 | 0.9 | 0.14 | 20 | 12.2 | 0.13 | 23 | — | — | — |
| LNU700 | 70411.1 | — | — | — | — | — | — | 0.6 | 0.24 | 10 |
| LNU690 | 70696.4 | 0.8 | 0.20 | 18 | — | — | — | — | — | — |
| LNU680 | 70593.5 | — | — | — | 11.5 | 0.28 | 15 | — | — | — |
| LNU680 | 70595.5 | 0.8 | 0.26 | 17 | — | — | — | — | — | — |
| LNU679 | 70790.2 | 0.8 | 0.16 | 20 | — | — | — | — | — | — |
| LNU679 | 70794.3 | 0.9 | 0.15 | 21 | — | — | — | 0.6 | 0.18 | 11 |
| LNU662 | 70342.1 | — | — | — | 11.6 | 0.23 | 17 | — | — | — |
| LNU662 | 70342.2 | — | — | — | 11.5 | 0.26 | 15 | — | — | — |
| LNU662 | 70343.3 | — | — | — | 13.2 | 0.03 | 32 | — | — | — |
| LNU631 | 70316.4 | — | — | — | — | — | — | 0.6 | 0.25 | 10 |
| LNU631 | 70318.1 | — | — | — | 11.7 | 0.22 | 17 | — | — | — |
| LNU631 | 70320.1 | — | — | — | 12.7 | 0.06 | 27 | — | — | — |
| LNU629 | 70311.2 | — | — | — | 12.7 | 0.07 | 27 | — | — | — |
| LNU629 | 70313.1 | 0.9 | 0.12 | 22 | 11.7 | 0.22 | 17 | 0.6 | 0.24 | 9 |
| LNU628 | 70754.2 | 0.9 | 0.03 | 31 | 11.9 | 0.18 | 19 | — | — | — |
| LNU621 | 70306.1 | — | — | — | 13.2 | 0.03 | 32 | — | — | — |
| LNU609 | 70773.2 | — | — | — | 12.1 | 0.13 | 21 | 0.6 | 0.28 | 9 |
| LNU609 | 70777.3 | 0.9 | 0.10 | 23 | — | — | — | — | — | — |
| LNU602 | 70382.2 | 0.8 | 0.26 | 15 | — | — | — | — | — | — |
| LNU602 | 70384.2 | 0.8 | 0.23 | 17 | 12.6 | 0.07 | 26 | — | — | — |
| LNU564 | 70838.1 | 0.8 | 0.20 | 17 | — | — | — | — | — | — |
| LNU564 | 70839.4 | — | — | — | 11.4 | 0.29 | 14 | — | — | — |
| LNU550 | 70770.1 | — | — | — | 13.4 | 0.02 | 34 | 0.6 | 0.29 | 8 |
| LNU550 | 70771.4 | — | — | — | 13.5 | 0.02 | 36 | — | — | — |
| LNU536 | 70821.1 | — | — | — | 11.8 | 0.20 | 18 | — | — | — |
| LNU536 | 70822.3 | 0.9 | 0.13 | 21 | — | — | — | — | — | — |
| LNU536 | 70825.1 | 0.8 | 0.26 | 16 | — | — | — | — | — | — |
| LNU529 | 70474.1 | 0.8 | 0.28 | 15 | 11.4 | 0.29 | 15 | 0.6 | 0.22 | 10 |
| CONT. | — | 0.7 | — | — | 10.0 | — | — | 0.5 | — | — |
| LNU733 | 71227.2 | — | — | — | 8.2 | 0.02 | 28 | 0.4 | 0.01 | 21 |
| LNU733 | 71227.3 | — | — | — | 7.6 | 0.11 | 18 | 0.4 | 0.02 | 19 |
| LNU733 | 71228.1 | — | — | — | 7.5 | 0.26 | 17 | 0.4 | 0.17 | 17 |
| LNU730 | 71217.6 | 0.7 | 0.11 | 26 | — | — | — | 0.4 | 0.13 | 11 |
| LNU704 | 70798.3 | — | — | — | 7.3 | 0.22 | 13 | — | — | — |
| LNU704 | 70800.4 | — | — | — | 7.8 | 0.08 | 21 | — | — | — |
| LNU692 | 71481.3 | — | — | — | — | — | — | 0.4 | 0.09 | 13 |
| LNU692 | 71482.2 | — | — | — | — | — | — | 0.4 | 0.28 | 10 |
| LNU692 | 71483.3 | — | — | — | 7.8 | 0.07 | 22 | 0.4 | 0.02 | 21 |
| LNU691 | 71436.4 | — | — | — | 7.4 | 0.21 | 15 | — | — | — |
| LNU691 | 71439.2 | — | — | — | — | — | — | 0.4 | 0.23 | 9 |
| LNU691 | 71441.1 | — | — | — | 7.3 | 0.22 | 14 | — | — | — |
| LNU691 | 71441.2 | — | — | — | 8.1 | 0.03 | 27 | 0.4 | 0.04 | 17 |
| LNU685 | 71123.3 | — | — | — | — | — | — | 0.4 | 0.28 | 9 |
| LNU680 | 70593.1 | — | — | — | — | — | — | 0.4 | 0.14 | 12 |
| LNU680 | 70593.2 | — | — | — | — | — | — | 0.4 | 0.12 | 12 |
| LNU680 | 70593.5 | — | — | — | 7.2 | 0.24 | 12 | 0.4 | 0.10 | 12 |
| LNU679 | 70790.2 | — | — | — | 7.5 | 0.12 | 17 | 0.4 | 0.12 | 12 |
| LNU679 | 70793.2 | — | — | — | — | — | — | 0.4 | 0.29 | 8 |
| LNU666 | 71388.2 | — | — | — | 7.7 | 0.09 | 20 | — | — | — |
| LNU666 | 71389.2 | — | — | — | — | — | — | 0.4 | 0.14 | 11 |
| LNU666 | 71390.2 | — | — | — | 7.5 | 0.15 | 16 | 0.4 | 0.04 | 21 |
| LNU640 | 71017.3 | — | — | — | — | — | — | 0.4 | 0.16 | 13 |
| LNU640 | 71022.8 | — | — | — | — | — | — | 0.4 | 0.30 | 8 |
| LNU628 | 70758.4 | — | — | — | 7.8 | 0.06 | 22 | 0.4 | 0.26 | 8 |
| LNU613 | 71616.6 | — | — | — | 7.3 | 0.22 | 14 | — | — | — |
| LNU613 | 71619.2 | — | — | — | — | — | — | 0.4 | 0.23 | 9 |
| LNU613 | 71621.3 | — | — | — | 7.7 | 0.10 | 20 | 0.4 | 0.17 | 12 |
| LNU613 | 71621.4 | — | — | — | 7.9 | 0.04 | 24 | — | — | — |
| LNU609 | 70773.2 | — | — | — | 7.7 | 0.11 | 19 | 0.4 | 0.28 | 9 |
| LNU609 | 70776.4 | — | — | — | — | — | — | 0.4 | 0.03 | 19 |
| LNU564 | 70839.4 | — | — | — | — | — | — | 0.4 | 0.07 | 15 |
| LNU561 | 71346.8 | — | — | — | 8.6 | L | 34 | 0.5 | L | 23 |
| LNU561 | 71349.1 | — | — | — | — | — | — | 0.4 | 0.08 | 13 |
| LNU550 | 70767.3 | — | — | — | — | — | — | 0.4 | 0.05 | 15 |
| LNU550 | 70770.1 | — | — | — | 7.6 | 0.14 | 18 | 0.4 | 0.15 | 12 |
| LNU550 | 70771.4 | — | — | — | 7.7 | 0.09 | 20 | — | — | — |
| LNU536 | 70821.1 | — | — | — | — | — | — | 0.4 | 0.28 | 8 |
| CONT. | — | 0.6 | — | — | 6.4 | — | — | 0.4 | — | — |

TABLE 80-continued

Genes showing improved plant performance at low
Nitrogen growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU730 | 71215.5 | — | — | — | 9.7 | 0.20 | 17 | 0.4 | 0.24 | 10 |
| LNU701 | 71131.3 | 0.8 | 0.08 | 14 | — | — | — | — | — | — |
| LNU698 | 70883.1 | — | — | — | — | — | — | 0.4 | 0.20 | 12 |
| LNU698 | 70883.4 | 0.7 | 0.26 | 9 | — | — | — | — | — | — |
| LNU694 | 71129.2 | 0.8 | 0.16 | 12 | 10.0 | 0.17 | 21 | — | — | — |
| LNU557 | 71400.4 | 0.8 | 0.18 | 11 | — | — | — | — | — | — |
| LNU557 | 71402.2 | 0.7 | 0.17 | 11 | — | — | — | — | — | — |
| LNU557 | 71404.2 | 0.7 | 0.22 | 11 | — | — | — | — | — | — |
| LNU548 | 70570.2 | 0.7 | 0.22 | 11 | — | — | — | — | — | — |
| LNU548 | 70573.5 | 0.7 | 0.27 | 9 | — | — | — | — | — | — |
| LNU526 | 70816.2 | 0.8 | 0.11 | 14 | — | — | — | — | — | — |
| CONT. | | 0.7 | — | — | 8.3 | — | — | 0.4 | — | — |
| LNU700 | 70410.2 | — | — | — | — | — | — | 0.5 | 0.24 | 10 |
| LNU641 | 70628.2 | — | — | — | — | — | — | 0.5 | 0.28 | 8 |
| LNU641 | 70632.1 | — | — | — | — | — | — | 0.5 | 0.25 | 9 |
| LNU631 | 70318.2 | — | — | — | — | — | — | 0.5 | 0.29 | 8 |
| LNU621 | 70308.3 | — | — | — | — | — | — | 0.5 | 0.13 | 13 |
| LNU587 | 70378.1 | — | — | — | — | — | — | 0.5 | 0.10 | 12 |
| LNU587 | 70380.5 | — | — | — | — | — | — | 0.5 | 0.21 | 9 |
| LNU582 | 70259.2 | — | — | — | 10.6 | 0.30 | 15 | — | — | — |
| LNU582 | 70260.1 | — | — | — | 10.6 | 0.30 | 15 | — | — | — |
| LNU532 | 70556.4 | — | — | — | — | — | — | 0.5 | 0.30 | 8 |
| LNU530 | 70205.6 | — | — | — | 10.9 | 0.20 | 18 | 0.5 | 0.07 | 14 |
| LNU529 | 70477.3 | — | — | — | — | — | — | 0.5 | 0.26 | 9 |
| CONT. | | — | — | — | 9.2 | — | — | 0.5 | — | — |

Table 80. "CONT."—Control; "Ave."—Average; "% Incr." = % increment; "p-val."—p-value; L means that p-value is less than 0.01 p < 0.1 was considered as significant. The transgenes were under the transcriptional regulation of the new At6669 promoter (SEQ ID NO: 6052).

TABLE 81

Genes showing improved plant performance at low
Nitrogen growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU721 | 70610.6 | 0.4 | L | 16 | — | — | — | — | — | — |
| LNU721 | 70613.4 | 0.4 | L | 9 | 10.3 | 0.20 | 10 | 5.6 | 0.26 | 5 |
| LNU721 | 70614.1 | 0.4 | 0.19 | 5 | 10.4 | 0.11 | 12 | 5.5 | 0.03 | 3 |
| LNU700 | 70410.2 | 0.4 | 0.15 | 6 | — | — | — | — | — | — |
| LNU700 | 70410.4 | 0.4 | 0.04 | 9 | — | — | — | — | — | — |
| LNU700 | 70411.1 | 0.4 | L | 16 | — | — | — | — | — | — |
| LNU690 | 70694.2 | — | — | — | 10.6 | 0.28 | 13 | 5.8 | 0.29 | 7 |
| LNU690 | 70694.3 | 0.4 | 0.18 | 27 | — | — | — | — | — | — |
| LNU690 | 70695.3 | 0.4 | 0.13 | 9 | 10.3 | L | 10 | 5.5 | 0.26 | 2 |
| LNU680 | 70593.1 | — | — | — | — | — | — | 5.5 | 0.15 | 2 |
| LNU680 | 70593.2 | — | — | — | 10.7 | 0.30 | 14 | — | — | — |
| LNU680 | 70593.5 | — | — | — | 10.8 | L | 15 | — | — | — |
| LNU679 | 70794.2 | 0.4 | 0.22 | 10 | — | — | — | — | — | — |
| LNU679 | 70794.3 | — | — | — | 10.4 | 0.19 | 11 | 5.9 | 0.18 | 9 |
| LNU662 | 70341.3 | 0.4 | 0.03 | 21 | — | — | — | — | — | — |
| LNU662 | 70342.1 | — | — | — | 11.0 | 0.27 | 17 | 5.7 | 0.02 | 6 |
| LNU662 | 70342.2 | — | — | — | 10.9 | 0.07 | 16 | 5.6 | L | 5 |
| LNU662 | 70343.1 | — | — | — | 10.5 | 0.02 | 12 | 5.6 | 0.25 | 4 |
| LNU662 | 70343.3 | — | — | — | 12.4 | L | 33 | 6.0 | L | 13 |
| LNU631 | 70316.4 | 0.4 | L | 17 | — | — | — | — | — | — |
| LNU631 | 70318.1 | — | — | — | 11.0 | 0.02 | 17 | — | — | — |
| LNU631 | 70318.2 | — | — | — | 10.7 | 0.02 | 15 | 5.5 | 0.03 | 3 |
| LNU631 | 70320.1 | — | — | — | 11.9 | L | 27 | 5.7 | 0.09 | 7 |
| LNU629 | 70311.2 | — | — | — | 11.8 | L | 26 | 5.9 | 0.22 | 9 |
| LNU629 | 70312.1 | 0.4 | 0.20 | 8 | — | — | — | — | — | — |
| LNU629 | 70313.1 | 0.4 | 0.15 | 17 | 10.9 | L | 17 | 5.8 | L | 8 |
| LNU628 | 70754.2 | 0.4 | 0.10 | 17 | 11.1 | 0.14 | 18 | — | — | — |
| LNU628 | 70756.3 | 0.4 | 0.26 | 7 | — | — | — | — | — | — |
| LNU621 | 70306.1 | — | — | — | 12.4 | 0.07 | 33 | 6.0 | L | 12 |

TABLE 81-continued

Genes showing improved plant performance at low
Nitrogen growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU609 | 70773.2 | 0.4 | L | 11 | 11.3 | 0.11 | 21 | 5.9 | 0.13 | 10 |
| LNU609 | 70774.4 | 0.4 | 0.18 | 8 | — | — | — | — | — | — |
| LNU609 | 70777.3 | 0.4 | L | 8 | — | — | — | — | — | — |
| LNU602 | 70382.2 | 0.4 | 0.27 | 12 | 9.8 | 0.11 | 5 | — | — | — |
| LNU602 | 70382.5 | 0.4 | 0.12 | 9 | — | — | — | — | — | — |
| LNU602 | 70383.4 | 0.4 | L | 9 | 9.9 | 0.23 | 6 | 5.5 | 0.03 | 3 |
| LNU602 | 70384.2 | — | — | — | 11.8 | L | 27 | 5.9 | 0.18 | 9 |
| LNU602 | 70385.3 | — | — | — | 10.5 | 0.17 | 12 | 5.6 | 0.12 | 5 |
| LNU564 | 70838.2 | 0.4 | 0.10 | 8 | — | — | — | — | — | — |
| LNU564 | 70839.2 | 0.4 | 0.13 | 16 | — | — | — | — | — | — |
| LNU564 | 70839.4 | 0.4 | 0.15 | 8 | 10.6 | L | 14 | 5.6 | L | 5 |
| LNU550 | 70770.1 | — | — | — | 12.6 | L | 35 | 6.1 | L | 13 |
| LNU550 | 70770.4 | 0.3 | 0.27 | 2 | — | — | — | — | — | — |
| LNU550 | 70771.4 | — | — | — | 12.8 | L | 36 | 6.0 | L | 11 |
| LNU544 | 70234.1 | — | — | — | 9.9 | 0.15 | 5 | — | — | — |
| LNU544 | 70237.3 | 0.4 | L | 12 | — | — | — | — | — | — |
| LNU536 | 70820.3 | — | — | — | 10.1 | 0.10 | 8 | 5.5 | 0.16 | 2 |
| LNU536 | 70821.1 | — | — | — | 11.0 | L | 18 | 5.7 | L | 6 |
| LNU536 | 70825.1 | 0.4 | L | 14 | — | — | — | — | — | — |
| LNU529 | 70474.1 | — | — | — | 10.6 | 0.25 | 14 | 5.8 | L | 7 |
| LNU529 | 70475.4 | 0.4 | 0.05 | 19 | — | — | — | — | — | — |
| CONT. | — | 0.3 | — | — | 9.4 | — | — | 5.4 | — | — |
| LNU733 | 71227.2 | — | — | — | 8.4 | L | 27 | 5.2 | L | 17 |
| LNU733 | 71227.3 | — | — | — | 7.6 | L | 16 | 4.9 | L | 10 |
| LNU733 | 71228.1 | 0.3 | 0.22 | 9 | — | — | — | — | — | — |
| LNU730 | 71217.6 | — | — | — | 7.2 | 0.12 | 9 | 4.8 | 0.01 | 6 |
| LNU704 | 70798.3 | — | — | — | 7.5 | 0.14 | 13 | 4.8 | 0.13 | 7 |
| LNU692 | 71481.3 | — | — | — | — | — | — | 4.8 | 0.02 | 7 |
| LNU692 | 71483.3 | — | — | — | — | — | — | 5.1 | 0.29 | 13 |
| LNU691 | 71436.2 | — | — | — | 7.1 | 0.11 | 8 | 4.7 | 0.17 | 4 |
| LNU691 | 71436.4 | — | — | — | — | — | — | 4.8 | 0.27 | 7 |
| LNU691 | 71439.2 | — | — | — | 7.2 | 0.04 | 9 | 4.8 | L | 7 |
| LNU691 | 71441.1 | — | — | — | — | — | — | 4.7 | 0.27 | 6 |
| LNU680 | 70593.2 | — | — | — | — | — | — | 4.7 | 0.04 | 5 |
| LNU680 | 70593.5 | — | — | — | 7.5 | L | 14 | 4.9 | L | 10 |
| LNU679 | 70790.1 | 0.3 | 0.25 | 7 | — | — | — | — | — | — |
| LNU679 | 70790.2 | — | — | — | 7.6 | 0.01 | 15 | 4.9 | L | 9 |
| LNU666 | 71388.2 | — | — | — | 8.1 | 0.21 | 22 | 4.8 | 0.12 | 8 |
| LNU628 | 70756.3 | — | — | — | — | — | — | 4.6 | 0.10 | 4 |
| LNU628 | 70758.4 | — | — | — | 8.1 | 0.16 | 23 | 5.0 | 0.13 | 13 |
| LNU613 | 71619.2 | — | — | — | — | — | — | 4.7 | 0.08 | 4 |
| LNU613 | 71621.3 | — | — | — | — | — | — | 5.0 | 0.13 | 12 |
| LNU613 | 71621.4 | — | — | — | 8.2 | 0.04 | 24 | 4.9 | 0.11 | 10 |
| LNU564 | 70838.1 | — | — | — | — | — | — | 4.6 | 0.18 | 3 |
| LNU564 | 70839.2 | — | — | — | 7.1 | 0.06 | 8 | 4.7 | 0.14 | 5 |
| LNU564 | 70839.4 | — | — | — | — | — | — | 4.8 | 0.29 | 7 |
| LNU561 | 71346.8 | — | — | — | 8.9 | 0.09 | 35 | 5.3 | L | 19 |
| LNU561 | 71349.1 | 0.3 | 0.18 | 9 | — | — | — | 4.7 | 0.05 | 5 |
| LNU561 | 71349.4 | — | — | — | — | — | — | 4.6 | 0.22 | 4 |
| LNU550 | 70767.3 | — | — | — | — | — | — | 4.8 | 0.15 | 7 |
| LNU550 | 70770.4 | — | — | — | 7.0 | 0.20 | 7 | — | — | — |
| LNU550 | 70771.4 | 0.3 | 0.26 | 8 | 7.9 | 0.25 | 20 | 4.8 | 0.12 | 8 |
| LNU536 | 70820.3 | 0.3 | 0.06 | 13 | — | — | — | — | — | — |
| LNU536 | 70821.1 | — | — | — | 7.3 | 0.04 | 11 | 4.8 | L | 8 |
| LNU536 | 70821.2 | 0.3 | 0.29 | 7 | — | — | — | — | — | — |
| CONT. | — | 0.3 | — | — | 6.6 | — | — | 4.5 | — | — |
| LNU744 | 71485.1 | 0.3 | 0.27 | 27 | — | — | — | 5.7 | 0.02 | 6 |
| LNU744 | 71487.3 | 0.2 | 0.21 | 11 | — | — | — | — | — | — |
| LNU736 | 71233.1 | — | — | — | — | — | — | 5.7 | 0.04 | 5 |
| LNU733 | 71228.4 | 0.2 | L | 20 | — | — | — | — | — | — |
| LNU730 | 71215.2 | 0.2 | 0.22 | 14 | — | — | — | — | — | — |
| LNU730 | 71215.5 | 0.2 | 0.10 | 15 | 12.0 | 0.15 | 17 | 5.9 | 0.25 | 9 |
| LNU730 | 71216.4 | 0.2 | 0.08 | 16 | — | — | — | — | — | — |
| LNU730 | 71217.2 | 0.3 | 0.05 | 24 | — | — | — | — | — | — |
| LNU704 | 70796.3 | 0.2 | 0.07 | 17 | — | — | — | — | — | — |
| LNU704 | 70798.3 | 0.2 | 0.28 | 15 | — | — | — | — | — | — |
| LNU704 | 70800.4 | 0.2 | 0.08 | 11 | — | — | — | — | — | — |
| LNU701 | 71133.2 | 0.2 | 0.24 | 11 | — | — | — | — | — | — |
| LNU701 | 71133.4 | 0.3 | 0.14 | 22 | — | — | — | — | — | — |
| LNU698 | 70882.3 | 0.2 | 0.22 | 9 | — | — | — | — | — | — |
| LNU698 | 70883.1 | — | — | — | 11.3 | 0.26 | 11 | — | — | — |

TABLE 81-continued

Genes showing improved plant performance at low Nitrogen growth conditions under regulation of At6669 promoter

| Gene Name | Event # | Harvest Index Ave. | P-Val. | % Incr. | Rosette Area [cm²] Ave. | P-Val. | % Incr. | Rosette Diameter [cm] Ave. | P-Val. | % Incr. |
|---|---|---|---|---|---|---|---|---|---|---|
| LNU698 | 70883.4 | 0.2 | 0.12 | 9 | — | — | — | — | — | — |
| LNU685 | 71121.4 | 0.3 | L | 32 | — | — | — | — | — | — |
| LNU665 | 71078.1 | 0.3 | 0.17 | 23 | — | — | — | — | — | — |
| LNU664 | 71292.4 | 0.2 | 0.23 | 19 | — | — | — | — | — | — |
| LNU663 | 71071.3 | 0.2 | 0.11 | 10 | — | — | — | — | — | — |
| LNU663 | 71072.5 | 0.2 | 0.05 | 15 | — | — | — | — | — | — |
| LNU663 | 71075.3 | 0.3 | 0.15 | 23 | — | — | — | — | — | — |
| LNU640 | 71022.1 | 0.2 | 0.24 | 19 | — | — | — | — | — | — |
| LNU568 | 70845.2 | 0.2 | 0.12 | 10 | — | — | — | — | — | — |
| LNU568 | 70846.3 | — | — | — | — | — | — | 5.8 | 0.16 | 7 |
| LNU557 | 71404.2 | 0.2 | 0.09 | 12 | — | — | — | — | — | — |
| LNU548 | 70570.5 | 0.2 | 0.02 | 15 | — | — | — | — | — | — |
| LNU526 | 70814.3 | — | — | — | 10.7 | 0.24 | 5 | 5.7 | 0.17 | 6 |
| LNU526 | 70819.4 | 0.3 | L | 21 | — | — | — | — | — | — |
| CONT. | | 0.2 | — | — | 10.2 | — | — | 5.4 | — | — |
| LNU700 | 70406.3 | 0.5 | 0.08 | 13 | — | — | — | — | — | — |
| LNU675 | 70405.1 | 0.4 | 0.21 | 10 | — | — | — | — | — | — |
| LNU662 | 70342.2 | — | — | — | 9.9 | 0.02 | 14 | 5.3 | 0.09 | 6 |
| LNU641 | 70628.2 | — | — | — | — | — | — | 5.2 | 0.06 | 5 |
| LNU641 | 70632.1 | — | — | — | — | — | — | 5.3 | 0.19 | 6 |
| LNU641 | 70633.2 | 0.4 | 0.17 | 10 | — | — | — | — | — | — |
| LNU631 | 70318.2 | — | — | — | 9.6 | 0.29 | 11 | 5.4 | 0.04 | 8 |
| LNU631 | 70320.1 | — | — | — | — | — | — | 5.2 | 0.25 | 5 |
| LNU629 | 70311.2 | 0.5 | 0.05 | 15 | 9.8 | 0.09 | 12 | 5.2 | 0.16 | 4 |
| LNU629 | 70313.1 | 0.5 | 0.15 | 14 | — | — | — | — | — | — |
| LNU621 | 70306.1 | — | — | — | 9.7 | 0.15 | 12 | 5.3 | 0.24 | 7 |
| LNU621 | 70306.3 | — | — | — | 9.2 | 0.22 | 5 | 5.2 | 0.14 | 4 |
| LNU587 | 70378.1 | — | — | — | 9.8 | 0.03 | 12 | 5.4 | 0.04 | 10 |
| LNU587 | 70379.3 | 0.4 | 0.28 | 8 | — | — | — | 5.2 | 0.25 | 5 |
| LNU587 | 70380.5 | — | — | — | 9.4 | 0.14 | 8 | 5.3 | 0.25 | 6 |
| LNU582 | 70259.2 | — | — | — | 10.0 | 0.19 | 15 | 5.4 | 0.21 | 8 |
| LNU582 | 70260.1 | — | — | — | 10.0 | 0.24 | 15 | — | — | — |
| LNU560 | 70243.4 | — | — | — | 9.4 | 0.10 | 8 | 5.3 | 0.13 | 7 |
| LNU553 | 70374.1 | — | — | — | 9.5 | 0.14 | 10 | 5.3 | 0.05 | 6 |
| LNU532 | 70556.4 | — | — | — | 9.6 | 0.06 | 11 | — | — | — |
| LNU530 | 70205.6 | — | — | — | 10.3 | 0.07 | 18 | 5.6 | 0.18 | 12 |
| LNU529 | 70474.1 | — | — | — | 9.5 | 0.17 | 10 | 5.3 | 0.05 | 7 |
| LNU529 | 70477.3 | 0.4 | 0.27 | 9 | — | — | — | — | — | — |
| CONT. | | 0.4 | — | — | 8.7 | — | — | 5.0 | — | — |

Table 81. "CONT."—Control; "Ave."—Average; "% Incr." = % increment; "p-val."—p-value; L means that p-value is less than 0.01, p < 0.1 was considered as significant. The transgenes were under the transcriptional regulation of the new At6669 promoter (SEQ ID NO: 6052).

TABLE 82

Genes showing improved plant performance at low Nitrogen growth conditions under regulation of At6669 promoter

| Gene Name | Event # | Seed Yield [mg] Ave. | P-Val. | % Incr. | 1000 Seed Weight [mg] Ave. | P-Val. | % Incr. |
|---|---|---|---|---|---|---|---|
| LNU721 | 70610.6 | 236.8 | 0.02 | 55 | — | — | — |
| LNU721 | 70613.1 | 167.7 | 0.03 | 9 | — | — | — |
| LNU721 | 70613.2 | 171.4 | 0.01 | 12 | — | — | — |
| LNU721 | 70613.4 | 229.8 | 0.22 | 50 | — | — | — |
| LNU700 | 70410.4 | 163.2 | 0.11 | 7 | — | — | — |
| LNU700 | 70411.1 | 234.1 | L | 53 | — | — | — |
| LNU690 | 70694.2 | 191.0 | L | 25 | 20.8 | L | 5 |
| LNU690 | 70694.3 | 267.1 | L | 74 | — | — | — |
| LNU690 | 70695.3 | 177.3 | L | 16 | — | — | — |
| LNU680 | 70593.1 | 198.5 | 0.11 | 30 | — | — | — |
| LNU680 | 70593.5 | — | — | — | 20.9 | 0.10 | 6 |
| LNU679 | 70794.3 | 250.3 | L | 63 | 23.0 | 0.08 | 16 |
| LNU662 | 70341.3 | 236.3 | 0.11 | 54 | — | — | — |
| LNU662 | 70342.2 | — | — | — | 23.3 | 0.09 | 18 |
| LNU662 | 70343.1 | — | — | — | 24.8 | 0.24 | 25 |
| LNU631 | 70316.4 | 270.6 | L | 77 | — | — | — |
| LNU631 | 70318.1 | 177.7 | 0.03 | 16 | — | — | — |
| LNU629 | 70313.1 | 215.3 | 0.06 | 41 | — | — | — |
| LNU628 | 70754.2 | 247.1 | 0.04 | 61 | — | — | — |
| LNU628 | 70756.2 | 185.7 | 0.04 | 21 | — | — | — |
| LNU628 | 70756.3 | 239.4 | L | 56 | — | — | — |
| LNU628 | 70759.1 | 182.4 | 0.15 | 19 | — | — | — |
| LNU621 | 70305.1 | — | — | — | 22.8 | 0.23 | 15 |
| LNU621 | 70306.3 | 280.6 | 0.06 | 83 | — | — | — |
| LNU609 | 70773.2 | 252.9 | 0.05 | 65 | 23.6 | 0.15 | 20 |
| LNU609 | 70776.4 | 249.9 | 0.20 | 63 | — | — | — |
| LNU602 | 70384.2 | 170.5 | 0.27 | 11 | 24.5 | 0.09 | 24 |
| LNU602 | 70385.3 | 199.7 | 0.12 | 30 | — | — | — |
| LNU564 | 70839.2 | 215.3 | 0.26 | 41 | — | — | — |
| LNU564 | 70839.4 | 212.9 | 0.20 | 39 | — | — | — |
| LNU564 | 70843.3 | 178.4 | 0.04 | 16 | — | — | — |
| LNU550 | 70766.2 | — | — | — | 20.6 | 0.05 | 4 |
| LNU550 | 70770.1 | — | — | — | 22.4 | 0.20 | 13 |
| LNU544 | 70232.1 | — | — | — | 21.5 | 0.20 | 9 |

TABLE 82-continued

Genes showing improved plant performance at low Nitrogen growth conditions under regulation of At6669 promoter

| Gene Name | Event # | Seed Yield [mg] Ave. | P-Val. | % Incr. | 1000 Seed Weight [mg] Ave. | P-Val. | % Incr. |
|---|---|---|---|---|---|---|---|
| LNU544 | 70237.2 | — | — | — | 20.1 | 0.21 | 2 |
| LNU544 | 70237.3 | 170.2 | 0.02 | 11 | — | — | — |
| LNU536 | 70820.3 | 161.0 | 0.26 | 5 | — | — | — |
| LNU536 | 70821.1 | — | — | — | 22.9 | L | 16 |
| LNU536 | 70822.3 | 169.9 | 0.02 | 11 | — | — | — |
| LNU536 | 70825.1 | 180.6 | 0.18 | 18 | 20.4 | 0.19 | 3 |
| LNU529 | 70474.1 | 238.7 | 0.08 | 56 | 20.3 | 0.18 | 3 |
| LNU529 | 70475.2 | 177.4 | 0.09 | 16 | — | — | — |
| LNU529 | 70475.4 | 253.8 | 0.09 | 66 | — | — | — |
| LNU529 | 70477.3 | — | — | — | 20.5 | 0.27 | 4 |
| CONT. | — | 153.2 | — | — | 19.8 | — | — |
| LNU733 | 71227.2 | — | — | — | 19.0 | 0.19 | 3 |
| LNU733 | 71228.1 | 126.3 | 0.25 | 17 | — | — | — |
| LNU704 | 70797.1 | — | — | — | 20.9 | 0.07 | 14 |
| LNU691 | 71436.2 | — | — | — | 19.9 | 0.12 | 9 |
| LNU691 | 71441.1 | — | — | — | 21.4 | 0.25 | 16 |
| LNU685 | 71120.2 | 122.8 | 0.04 | 14 | — | — | — |
| LNU680 | 70593.5 | — | — | — | 20.8 | L | 13 |
| LNU679 | 70790.1 | 120.7 | 0.30 | 12 | — | — | — |
| LNU679 | 70794.3 | — | — | — | 18.9 | 0.14 | 3 |
| LNU664 | 71291.3 | — | — | — | 19.0 | 0.15 | 4 |
| LNU640 | 71022.1 | — | — | — | 18.8 | 0.26 | 3 |
| LNU628 | 70756.2 | 121.0 | 0.05 | 12 | — | — | — |
| LNU613 | 71621.3 | — | — | — | 19.2 | 0.13 | 4 |
| LNU609 | 70773.2 | 118.5 | 0.15 | 10 | 21.2 | L | 16 |
| LNU609 | 70774.4 | 120.4 | 0.19 | 11 | — | — | — |
| LNU609 | 70776.4 | — | — | — | 19.4 | 0.03 | 6 |
| LNU561 | 71346.8 | — | — | — | 22.8 | 0.11 | 24 |
| LNU561 | 71349.1 | 125.0 | 0.22 | 16 | — | — | — |
| LNU550 | 70770.1 | — | — | — | 19.8 | L | 8 |
| LNU536 | 70820.3 | 138.6 | L | 28 | — | — | — |
| LNU536 | 70821.1 | — | — | — | 21.6 | L | 17 |
| CONT. | — | 108.0 | — | — | 18.4 | — | — |
| LNU744 | 71486.3 | 55.8 | 0.25 | 7 | — | — | — |
| LNU736 | 71233.1 | — | — | — | 20.6 | 0.06 | 5 |
| LNU736 | 71233.5 | — | — | — | 28.9 | L | 47 |
| LNU733 | 71227.2 | — | — | — | 20.7 | 0.26 | 5 |
| LNU733 | 71227.3 | 57.7 | 0.25 | 10 | — | — | — |
| LNU733 | 71228.4 | — | — | — | 20.0 | 0.29 | 2 |
| LNU730 | 71215.5 | 72.2 | 0.20 | 38 | — | — | — |
| LNU730 | 71216.4 | 58.8 | 0.17 | 12 | — | — | — |
| LNU730 | 71217.2 | 59.8 | 0.08 | 14 | — | — | — |
| LNU704 | 70796.3 | — | — | — | 20.0 | 0.12 | 2 |
| LNU704 | 70797.1 | — | — | — | 20.6 | L | 5 |
| LNU701 | 71134.2 | — | — | — | 21.6 | 0.03 | 10 |
| LNU698 | 70883.1 | 60.5 | 0.08 | 16 | — | — | — |
| LNU698 | 70885.4 | — | — | — | 20.0 | 0.08 | 2 |
| LNU694 | 71129.1 | — | — | — | 20.1 | 0.11 | 2 |
| LNU685 | 71121.4 | 56.9 | 0.13 | 9 | — | — | — |
| LNU677 | 71103.3 | — | — | — | 20.4 | 0.07 | 4 |
| LNU665 | 71077.1 | — | — | — | 20.1 | 0.11 | 2 |
| LNU665 | 71078.1 | 62.0 | 0.02 | 19 | — | — | — |
| LNU664 | 71288.2 | — | — | — | 20.2 | 0.01 | 3 |
| LNU664 | 71292.1 | — | — | — | 21.8 | L | 11 |
| LNU663 | 71071.3 | — | — | — | 20.0 | 0.10 | 2 |
| LNU663 | 71071.6 | — | — | — | 22.1 | 0.06 | 12 |
| LNU568 | 70844.2 | — | — | — | 20.2 | 0.01 | 3 |
| LNU568 | 70846.3 | 60.5 | 0.01 | 16 | — | — | — |
| LNU568 | 70848.2 | — | — | — | 20.1 | 0.01 | 3 |
| LNU557 | 71400.4 | 57.5 | 0.10 | 10 | 19.8 | 0.22 | 1 |
| LNU557 | 71404.2 | 56.1 | 0.15 | 7 | — | — | — |
| LNU548 | 70570.4 | — | — | — | 21.9 | 0.07 | 12 |
| LNU526 | 70819.4 | 59.7 | 0.02 | 14 | 19.6 | — | — |
| CONT. | — | 52.3 | — | — | 19.6 | — | — |
| LNU700 | 70406.3 | 172.7 | 0.03 | 11 | — | — | — |
| LNU675 | 70403.2 | 168.2 | 0.12 | 8 | — | — | — |
| LNU675 | 70405.1 | 165.2 | 0.20 | 6 | — | — | — |
| LNU662 | 70341.3 | 176.2 | 0.02 | 13 | — | — | — |
| LNU662 | 70342.2 | — | — | — | 24.1 | L | 25 |
| LNU662 | 70343.1 | — | — | — | 24.5 | 0.09 | 27 |
| LNU662 | 70343.3 | 178.2 | 0.16 | 14 | — | — | — |
| LNU657 | 70336.1 | 181.1 | 0.24 | 16 | 21.7 | 0.01 | 12 |
| LNU641 | 70628.2 | — | — | — | 19.9 | 0.27 | 4 |
| LNU641 | 70632.3 | 178.1 | 0.01 | 14 | — | — | — |
| LNU641 | 70633.2 | 180.4 | 0.17 | 16 | — | — | — |
| LNU641 | 70633.5 | 179.1 | 0.02 | 15 | 20.1 | 0.10 | 4 |
| LNU631 | 70318.2 | 169.9 | 0.06 | 9 | — | — | — |
| LNU629 | 70310.2 | 171.5 | 0.25 | 10 | — | — | — |
| LNU629 | 70313.1 | 183.8 | 0.05 | 18 | — | — | — |
| LNU621 | 70305.1 | 185.1 | 0.04 | 19 | 23.2 | 0.06 | 20 |
| LNU602 | 70382.5 | 167.8 | 0.09 | 8 | — | — | — |
| LNU602 | 70383.4 | 175.6 | 0.02 | 13 | — | — | — |
| LNU602 | 70384.2 | — | — | — | 22.5 | 0.06 | 17 |
| LNU602 | 70385.3 | 181.1 | 0.05 | 16 | — | — | — |
| LNU600 | 70484.3 | 180.7 | 0.04 | 16 | — | — | — |
| LNU600 | 70488.1 | 171.7 | 0.07 | 10 | — | — | — |
| LNU600 | 70488.2 | 180.3 | 0.03 | 16 | — | — | — |
| LNU587 | 70380.3 | — | — | — | 20.6 | 0.27 | 7 |
| LNU587 | 70380.5 | — | — | — | 21.8 | 0.25 | 13 |
| LNU582 | 70259.3 | — | — | — | 21.3 | L | 11 |
| LNU582 | 70260.1 | 176.4 | 0.23 | 13 | — | — | — |
| LNU553 | 70373.1 | 175.8 | 0.02 | 13 | — | — | — |
| LNU544 | 70232.1 | 174.3 | 0.11 | 12 | 23.7 | 0.17 | 23 |
| LNU544 | 70237.2 | 165.3 | 0.16 | 6 | — | — | — |
| LNU544 | 70237.3 | 181.6 | 0.01 | 17 | — | — | — |
| LNU530 | 70204.1 | — | — | — | 22.2 | 0.22 | 15 |
| LNU530 | 70207.4 | — | — | — | 22.2 | 0.05 | 15 |
| LNU529 | 70475.4 | 167.8 | 0.28 | 8 | — | — | — |
| CONT. | — | 155.7 | — | — | 19.3 | — | — |

Table 82. "CONT."—Control; "Ave."—Average; "% Incr." = % increment; "p-val."—p-value; L means that p-value is less than 0.01, p < 0.1 was considered as significant. The transgenes were under the transcriptional regulation of the new At6669 promoter (SEQ ID NO: 6052).

TABLE 83

Genes showing improved plant performance at Normal growth conditions under regulation of At6669 promoter

| Gene Name | Event # | Dry Weight [mg] Ave. | P-Val. | % Incr. | Flowering Ave. | P-Val. | % Incr. | Inflorescence Emergence Ave. | P-Val. | % Incr. |
|---|---|---|---|---|---|---|---|---|---|---|
| LNU721 | 70610.6 | 749.5 | 0.19 | 8 | — | — | — | — | — | — |
| LNU690 | 70694.2 | 746.9 | 0.18 | 7 | — | — | — | — | — | — |
| LNU690 | 70695.3 | 750.6 | 0.22 | 8 | — | — | — | — | — | — |
| LNU690 | 70696.4 | — | — | — | 16.6 | 0.02 | -4 | — | — | — |
| LNU679 | 70794.3 | 755.0 | 0.10 | 9 | — | — | — | — | — | — |
| LNU662 | 70342.2 | 796.2 | 0.11 | 15 | — | — | — | — | — | — |
| LNU662 | 70343.1 | 893.1 | L | 28 | 16.4 | L | -5 | — | — | — |

TABLE 83-continued

Genes showing improved plant performance at Normal growth conditions under regulation of At6669 promoter

| Gene Name | Event # | Dry Weight [mg] Ave. | P-Val. | % Incr. | Flowering Ave. | P-Val. | % Incr. | Inflorescence Emergence Ave. | P-Val. | % Incr. |
|---|---|---|---|---|---|---|---|---|---|---|
| LNU662 | 70343.3 | 770.0 | 0.10 | 11 | 16.7 | 0.04 | −4 | — | — | — |
| LNU631 | 70316.2 | — | — | — | 16.5 | 0.01 | −5 | — | — | — |
| LNU631 | 70320.1 | 789.4 | 0.28 | 14 | — | — | — | — | — | — |
| LNU629 | 70310.2 | 754.7 | 0.02 | 9 | — | — | — | — | — | — |
| LNU621 | 70305.1 | 799.8 | 0.11 | 15 | — | — | — | — | — | — |
| LNU621 | 70306.1 | — | — | — | 16.8 | 0.10 | −3 | — | — | — |
| LNU609 | 70773.2 | — | — | — | 16.6 | 0.02 | −4 | — | — | — |
| LNU609 | 70777.1 | — | — | — | 16.6 | 0.02 | −4 | — | — | — |
| LNU609 | 70777.3 | 756.9 | 0.12 | 9 | — | — | — | — | — | — |
| LNU602 | 70382.5 | — | — | — | 16.1 | 0.12 | −7 | — | — | — |
| LNU602 | 70384.2 | 787.0 | L | 13 | — | — | — | — | — | — |
| LNU564 | 70838.2 | 751.9 | 0.30 | 8 | — | — | — | — | — | — |
| LNU564 | 70839.2 | 722.5 | 0.06 | 4 | — | — | — | — | — | — |
| LNU550 | 70767.3 | 770.0 | 0.26 | 11 | — | — | — | — | — | — |
| LNU550 | 70770.1 | 830.0 | 0.02 | 19 | — | — | — | — | — | — |
| LNU550 | 70771.4 | — | — | — | 16.5 | 0.01 | −5 | — | — | — |
| LNU544 | 70232.1 | 761.9 | 0.03 | 10 | — | — | — | — | — | — |
| LNU544 | 70234.1 | 758.1 | L | 9 | — | — | — | — | — | — |
| LNU536 | 70820.3 | 744.4 | 0.02 | 7 | — | — | — | — | — | — |
| LNU536 | 70821.1 | 791.9 | 0.07 | 14 | — | — | — | — | — | — |
| LNU529 | 70476.3 | 810.0 | 0.13 | 17 | — | — | — | — | — | — |
| CONT. | — | 695.2 | — | — | 17.3 | — | — | — | — | — |
| LNU733 | 71227.2 | 578.1 | L | 28 | — | — | — | — | — | — |
| LNU733 | 71227.3 | 481.9 | 0.13 | 7 | — | — | — | — | — | — |
| LNU730 | 71215.5 | 481.9 | 0.05 | 7 | — | — | — | — | — | — |
| LNU730 | 71216.4 | 488.1 | 0.02 | 8 | — | — | — | — | — | — |
| LNU704 | 70797.1 | 486.2 | 0.22 | 8 | — | — | — | — | — | — |
| LNU704 | 70798.3 | 540.6 | 0.02 | 20 | — | — | — | — | — | — |
| LNU704 | 70800.4 | 483.1 | 0.15 | 7 | — | — | — | — | — | — |
| LNU692 | 71481.3 | 536.2 | L | 19 | — | — | — | — | — | — |
| LNU692 | 71482.5 | 517.5 | 0.23 | 14 | — | — | — | — | — | — |
| LNU692 | 71483.3 | 483.8 | 0.16 | 7 | — | — | — | — | — | — |
| LNU691 | 71436.2 | — | — | — | 21.2 | 0.27 | −6 | — | — | — |
| LNU691 | 71441.2 | 551.9 | 0.07 | 22 | — | — | — | — | — | — |
| LNU685 | 71120.2 | 516.2 | L | 14 | — | — | — | — | — | — |
| LNU685 | 71123.5 | 486.2 | 0.02 | 8 | — | — | — | — | — | — |
| LNU680 | 70593.5 | 597.5 | 0.17 | 32 | — | — | — | — | — | — |
| LNU680 | 70595.5 | 537.5 | L | 19 | — | — | — | — | — | — |
| LNU679 | 70790.2 | — | — | — | 21.9 | 0.26 | −3 | — | — | — |
| LNU679 | 70794.2 | 511.9 | 0.22 | 13 | — | — | — | — | — | — |
| LNU666 | 71388.2 | 470.6 | 0.12 | 4 | 19.9 | 0.02 | −11 | — | — | — |
| LNU666 | 71389.1 | 559.4 | 0.15 | 24 | — | — | — | — | — | — |
| LNU666 | 71390.2 | 521.2 | 0.14 | 15 | — | — | — | — | — | — |
| LNU664 | 71291.2 | 585.0 | 0.14 | 29 | — | — | — | — | — | — |
| LNU628 | 70754.2 | 538.1 | 0.06 | 19 | — | — | — | — | — | — |
| LNU628 | 70756.2 | 488.1 | 0.01 | 8 | — | — | — | — | — | — |
| LNU628 | 70758.4 | 532.9 | 0.30 | 18 | — | — | — | — | — | — |
| LNU628 | 70759.1 | 490.0 | 0.03 | 8 | — | — | — | — | — | — |
| LNU613 | 71616.6 | 621.2 | L | 37 | — | — | — | — | — | — |
| LNU613 | 71619.2 | 513.8 | L | 14 | — | — | — | — | — | — |
| LNU613 | 71621.1 | 650.2 | 0.14 | 44 | — | — | — | — | — | — |
| LNU613 | 71621.3 | 620.0 | 0.06 | 37 | — | — | — | — | — | — |
| LNU613 | 71621.4 | 519.4 | 0.26 | 15 | — | — | — | — | — | — |
| LNU609 | 70773.2 | — | — | — | 21.4 | 0.19 | −5 | — | — | — |
| LNU564 | 70839.2 | 485.0 | 0.02 | 7 | — | — | — | — | — | — |
| LNU561 | 71346.6 | 474.4 | 0.29 | 5 | — | — | — | — | — | — |
| LNU561 | 71346.8 | 610.0 | 0.27 | 35 | 20.4 | L | −9 | — | — | — |
| LNU561 | 71348.1 | 562.5 | 0.03 | 24 | — | — | — | — | — | — |
| LNU561 | 71349.4 | 516.9 | L | 14 | — | — | — | — | — | — |
| LNU550 | 70771.4 | — | — | — | 20.6 | L | −8 | — | — | — |
| LNU536 | 70821.1 | 512.5 | L | 13 | — | — | — | — | — | — |
| LNU536 | 70821.2 | — | — | — | 21.6 | 0.29 | −4 | — | — | — |
| CONT. | — | 452.1 | — | — | 22.5 | — | — | — | — | — |
| LNU744 | 71485.1 | — | — | — | 24.0 | 0.02 | −11 | — | — | — |
| LNU744 | 71487.3 | — | — | — | 25.1 | 0.07 | −7 | — | — | — |
| LNU736 | 71233.1 | — | — | — | 24.9 | 0.07 | −7 | — | — | — |
| LNU736 | 71237.2 | — | — | — | 24.6 | 0.03 | −8 | — | — | — |
| LNU733 | 71227.2 | 791.0 | L | 18 | — | — | — | — | — | — |
| LNU733 | 71228.1 | 694.4 | 0.26 | 4 | — | — | — | — | — | — |
| LNU733 | 71228.4 | — | — | — | 24.4 | 0.08 | −9 | — | — | — |
| LNU733 | 71229.5 | — | — | — | 25.8 | 0.25 | −4 | — | — | — |

TABLE 83-continued

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LNU730 | 71215.5 | — | — | — | 24.5 | 0.02 | −9 | — | — | — |
| LNU730 | 71217.3 | — | — | — | 24.8 | 0.04 | −8 | — | — | — |
| LNU704 | 70796.3 | — | — | — | 25.8 | 0.19 | −4 | — | — | — |
| LNU704 | 70797.1 | 699.4 | 0.19 | 4 | 24.1 | 0.01 | −10 | 17.0 | L | −13 |
| LNU704 | 70798.2 | — | — | — | 24.7 | 0.05 | −8 | — | — | — |
| LNU704 | 70800.4 | — | — | — | 25.8 | 0.24 | −4 | — | — | — |
| LNU701 | 71133.4 | — | — | — | 25.8 | 0.25 | −4 | — | — | — |
| LNU698 | 70882.3 | — | — | — | 24.9 | 0.07 | −7 | — | — | — |
| LNU698 | 70883.3 | — | — | — | 25.7 | 0.19 | −4 | — | — | — |
| LNU698 | 70883.4 | — | — | — | 24.7 | 0.03 | −8 | — | — | — |
| LNU694 | 71128.4 | — | — | — | 25.4 | 0.12 | −6 | — | — | — |
| LNU685 | 71121.4 | — | — | — | 25.0 | 0.05 | −7 | — | — | — |
| LNU685 | 71122.1 | — | — | — | 25.7 | 0.18 | −4 | — | — | — |
| LNU677 | 71103.4 | — | — | — | 25.6 | 0.16 | −5 | — | — | — |
| LNU665 | 71077.1 | — | — | — | 24.8 | 0.04 | −8 | — | — | — |
| LNU664 | 71288.2 | — | — | — | 25.4 | 0.10 | −6 | — | — | — |
| LNU664 | 71291.1 | 726.2 | 0.04 | 8 | — | — | — | — | — | — |
| LNU663 | 71071.6 | — | — | — | 24.8 | 0.04 | −8 | — | — | — |
| LNU663 | 71075.3 | — | — | — | 24.9 | 0.07 | −7 | — | — | — |
| LNU640 | 71017.4 | — | — | — | 25.4 | 0.17 | −5 | — | — | — |
| LNU640 | 71022.8 | — | — | — | 24.9 | 0.04 | −7 | — | — | — |
| LNU568 | 70846.3 | 733.1 | 0.01 | 9 | — | — | — | — | — | — |
| LNU568 | 70848.2 | — | — | — | 24.8 | 0.03 | −8 | — | — | — |
| LNU557 | 71404.3 | 724.4 | 0.08 | 8 | — | — | — | — | — | — |
| LNU548 | 70569.1 | — | — | — | 25.0 | 0.14 | −7 | — | — | — |
| LNU548 | 70570.2 | 730.7 | 0.01 | 9 | 24.9 | 0.05 | −7 | — | — | — |
| LNU548 | 70570.5 | — | — | — | 24.7 | 0.03 | −8 | — | — | — |
| LNU526 | 70814.3 | 728.8 | 0.04 | 9 | 24.9 | 0.04 | −8 | — | — | — |
| LNU526 | 70816.2 | 756.4 | L | 13 | — | — | — | — | — | — |
| LNU526 | 70818.4 | — | — | — | 25.2 | 0.07 | −6 | — | — | — |
| LNU526 | 70819.2 | — | — | — | 25.5 | 0.18 | −5 | — | — | — |
| CONT. | — | 670.1 | — | — | 26.9 | — | — | 19.5 | — | — |
| LNU700 | 70407.1 | — | — | — | 17.0 | 0.20 | −3 | — | — | — |
| LNU662 | 70342.2 | 771.2 | 0.06 | 11 | — | — | — | — | — | — |
| LNU662 | 70343.1 | 858.1 | L | 24 | 16.3 | 0.13 | −7 | — | — | — |
| LNU631 | 70320.1 | — | — | — | 16.7 | 0.07 | −5 | — | — | — |
| LNU629 | 70311.2 | — | — | — | 16.4 | 0.03 | −6 | 12.8 | L | −15 |
| LNU621 | 70305.1 | 758.1 | 0.11 | 9 | — | — | — | — | — | — |
| LNU621 | 70306.1 | — | — | — | — | — | — | 14.3 | 0.24 | −4 |
| LNU621 | 70306.3 | — | — | — | 16.9 | 0.13 | −4 | 14.0 | L | −7 |
| LNU602 | 70384.2 | — | — | — | 16.1 | 0.03 | −8 | 12.7 | 0.03 | −16 |
| LNU600 | 70486.4 | — | — | — | 16.9 | 0.15 | −3 | — | — | — |
| LNU587 | 70379.3 | — | — | — | 17.0 | 0.20 | −3 | — | — | — |
| LNU587 | 70380.3 | — | — | — | 16.3 | 0.11 | −7 | 13.1 | 0.27 | −13 |
| LNU587 | 70380.5 | — | — | — | 16.7 | 0.15 | −5 | — | — | — |
| LNU560 | 70239.1 | 745.0 | 0.19 | 7 | — | — | — | — | — | — |
| LNU560 | 70241.2 | 731.9 | 0.27 | 5 | — | — | — | — | — | — |
| LNU553 | 70374.1 | 890.6 | 0.15 | 28 | — | — | — | — | — | — |
| LNU544 | 70232.1 | — | — | — | 16.9 | 0.13 | −4 | 12.7 | 0.03 | −16 |
| LNU532 | 70556.4 | 751.7 | 0.13 | 8 | — | — | — | — | — | — |
| LNU532 | 70556.5 | 755.0 | 0.18 | 9 | — | — | — | — | — | — |
| LNU530 | 70204.1 | — | — | — | 16.9 | 0.13 | −4 | — | — | — |
| CONT. | — | 694.4 | — | — | 17.5 | — | — | 15.0 | — | — |

Table 83. "CONT."—Control; "Ave."—Average. "% Incr." = % increment; "p-val."—p-value; L means that p-value is less than 0.01, p < 0.1 was considered as significant. The transgenes were under the transcriptional regulation of the new At6669 promoter (SEQ ID NO: 6052).

TABLE 84

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LNU721 | 70613.1 | 1.5 | 0.01 | 9 | 10.8 | 0.06 | 6 | 87.7 | L | 16 |
| LNU721 | 70613.4 | — | — | — | 10.6 | 0.13 | 4 | — | — | — |
| LNU721 | 70614.1 | 1.4 | 0.21 | 5 | — | — | — | 81.9 | 0.23 | 8 |
| LNU700 | 70407.1 | — | — | — | 10.5 | 0.17 | 4 | — | — | — |
| LNU700 | 70410.2 | — | — | — | 10.9 | 0.01 | 8 | — | — | — |
| LNU690 | 70695.3 | 1.6 | L | 21 | 10.8 | 0.17 | 6 | 96.2 | L | 27 |
| LNU690 | 70696.4 | — | — | — | 10.6 | 0.13 | 4 | 81.4 | 0.25 | 8 |
| LNU680 | 70593.2 | — | — | — | 10.6 | 0.25 | 5 | — | — | — |
| LNU680 | 70593.5 | — | — | — | 11.2 | 0.02 | 10 | 88.7 | 0.23 | 17 |
| LNU662 | 70342.2 | — | — | — | 10.5 | 0.18 | 4 | — | — | — |
| LNU631 | 70316.2 | — | — | — | 10.5 | 0.22 | 4 | 84.8 | 0.09 | 12 |
| LNU631 | 70318.2 | 1.6 | 0.26 | 17 | — | — | — | — | — | — |
| LNU631 | 70320.1 | 1.6 | 0.06 | 21 | — | — | — | 93.1 | 0.24 | 23 |
| LNU629 | 70310.2 | 1.6 | L | 18 | 10.6 | 0.25 | 5 | 95.3 | L | 26 |
| LNU629 | 70311.2 | 1.4 | 0.16 | 4 | 11.2 | 0.20 | 10 | 88.8 | 0.08 | 17 |
| LNU629 | 70313.1 | — | — | — | 11.0 | 0.02 | 8 | — | — | — |
| LNU621 | 70306.1 | 1.6 | L | 17 | 10.9 | 0.25 | 7 | 92.6 | 0.02 | 22 |
| LNU609 | 70773.2 | — | — | — | 10.7 | 0.06 | 5 | — | — | — |
| LNU609 | 70777.1 | — | — | — | 10.6 | 0.22 | 4 | — | — | — |
| LNU602 | 70382.5 | — | — | — | 11.1 | 0.13 | 9 | — | — | — |
| LNU550 | 70767.3 | 1.5 | 0.14 | 11 | — | — | — | 85.8 | L | 13 |
| LNU550 | 70770.1 | 1.6 | 0.01 | 18 | 11.1 | 0.03 | 9 | 90.0 | L | 19 |
| LNU550 | 70770.4 | 1.4 | 0.29 | 5 | — | — | — | — | — | — |
| LNU550 | 70771.4 | — | — | — | 10.6 | 0.08 | 5 | 82.2 | 0.15 | 9 |
| LNU544 | 70234.1 | 1.4 | 0.14 | 5 | — | — | — | — | — | — |
| LNU536 | 70821.1 | — | — | — | 10.7 | 0.13 | 5 | — | — | — |
| LNU529 | 70475.2 | 1.4 | 0.27 | 5 | — | — | — | 83.3 | 0.05 | 10 |
| LNU529 | 70477.3 | — | — | — | 10.6 | 0.13 | 4 | 83.2 | 0.23 | 10 |
| CONT. | — | 1.3 | — | — | 10.1 | — | — | 75.7 | — | — |
| LNU733 | 71227.3 | 1.2 | 0.02 | 17 | — | — | — | 64.4 | 0.03 | 16 |
| LNU704 | 70797.1 | — | — | — | 10.4 | 0.22 | 4 | — | — | — |
| LNU704 | 70798.3 | 1.2 | 0.28 | 20 | — | — | — | — | — | — |
| LNU704 | 70800.4 | — | — | — | 10.5 | 0.25 | 5 | — | — | — |
| LNU691 | 71436.2 | 1.3 | 0.18 | 32 | 11.0 | L | 10 | 80.8 | 0.18 | 46 |
| LNU685 | 71122.1 | 1.1 | 0.07 | 12 | 10.5 | 0.08 | 5 | 61.6 | 0.30 | 11 |
| LNU680 | 70593.5 | 1.2 | 0.20 | 22 | 10.7 | 0.08 | 7 | 73.8 | 0.08 | 33 |
| LNU679 | 70794.2 | — | — | — | 10.5 | 0.11 | 5 | 59.0 | 0.26 | 7 |
| LNU666 | 71388.2 | 1.2 | 0.01 | 19 | 11.2 | L | 12 | 73.2 | L | 32 |
| LNU666 | 71389.1 | 1.2 | 0.10 | 19 | — | — | — | 70.1 | 0.23 | 27 |
| LNU666 | 71390.2 | 1.1 | 0.19 | 8 | — | — | — | 61.5 | 0.21 | 11 |
| LNU640 | 71017.4 | — | — | — | 10.4 | 0.22 | 4 | — | — | — |
| LNU628 | 70754.2 | 1.2 | 0.13 | 17 | — | — | — | 65.9 | 0.09 | 19 |
| LNU628 | 70756.3 | 1.1 | 0.21 | 7 | — | — | — | — | — | — |
| LNU613 | 71616.6 | 1.2 | 0.29 | 18 | — | — | — | — | — | — |
| LNU613 | 71621.1 | 1.2 | 0.01 | 19 | 10.9 | 0.08 | 9 | 67.4 | 0.01 | 22 |
| LNU613 | 71621.3 | 1.1 | 0.11 | 10 | — | — | — | 61.9 | 0.11 | 12 |
| LNU609 | 70773.2 | — | — | — | 10.9 | 0.01 | 9 | 66.8 | 0.08 | 21 |
| LNU564 | 70838.2 | — | — | — | — | — | — | 61.0 | 0.24 | 10 |
| LNU561 | 71346.8 | 1.3 | 0.26 | 32 | — | — | — | 80.8 | 0.25 | 46 |
| LNU561 | 71348.1 | 1.1 | 0.25 | 8 | 10.4 | 0.12 | 4 | 63.2 | 0.12 | 14 |
| LNU550 | 70770.4 | 1.1 | 0.13 | 15 | 10.9 | 0.03 | 9 | 69.4 | L | 25 |
| LNU536 | 70821.1 | 1.2 | 0.07 | 18 | 11.9 | 0.01 | 19 | 70.8 | 0.01 | 28 |
| LNU536 | 70821.2 | — | — | — | 10.6 | 0.28 | 5 | — | — | — |
| CONT. | — | 1.0 | — | — | 10.0 | — | — | 55.4 | — | — |
| LNU744 | 71485.1 | 1.4 | 0.11 | 13 | — | — | — | 91.0 | 0.07 | 15 |
| LNU736 | 71233.5 | 1.4 | 0.21 | 9 | — | — | — | — | — | — |
| LNU736 | 71235.1 | 1.4 | 0.21 | 9 | — | — | — | 88.1 | 0.18 | 12 |
| LNU704 | 70796.3 | 1.3 | 0.26 | 8 | — | — | — | — | — | — |
| LNU704 | 70797.1 | 1.5 | 0.10 | 24 | — | — | — | 102.6 | L | 30 |
| LNU698 | 70882.3 | — | — | — | 12.2 | 0.13 | 5 | — | — | — |
| LNU694 | 71129.2 | 1.5 | 0.17 | 17 | — | — | — | 87.1 | 0.29 | 10 |
| LNU664 | 71288.2 | — | — | — | 12.1 | 0.12 | 4 | — | — | — |
| LNU663 | 71071.6 | 1.4 | 0.29 | 14 | — | — | — | 93.0 | 0.16 | 18 |
| LNU663 | 71075.3 | — | — | — | — | — | — | 87.6 | 0.19 | 11 |
| LNU640 | 71017.4 | — | — | — | — | — | — | 89.2 | 0.14 | 13 |
| LNU548 | 70569.1 | — | — | — | 12.3 | 0.08 | 6 | — | — | — |
| LNU526 | 70814.3 | — | — | — | 12.0 | 0.17 | 3 | — | — | — |
| LNU526 | 70816.2 | — | — | — | 11.9 | 0.26 | 3 | — | — | — |
| CONT. | — | 1.2 | — | — | 11.6 | — | — | 79.0 | — | — |
| LNU700 | 70410.2 | — | — | — | 10.5 | 0.28 | 3 | — | — | — |
| LNU675 | 70405.1 | 1.5 | 0.06 | 10 | — | — | — | — | — | — |

TABLE 84-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LNU675 | 70405.3 | — | — | — | 10.6 | 0.16 | 5 | — | — | — |
| LNU662 | 70342.2 | 1.6 | 0.25 | 17 | 11.0 | 0.03 | 8 | 95.1 | L | 17 |
| LNU662 | 70343.1 | 1.6 | 0.28 | 16 | — | — | — | 93.8 | 0.12 | 15 |
| LNU629 | 70311.2 | — | — | — | 11.1 | 0.16 | 10 | — | — | — |
| LNU621 | 70306.1 | 1.6 | 0.02 | 14 | — | — | — | — | — | — |
| LNU621 | 70306.3 | 1.6 | 0.12 | 12 | — | — | — | 87.3 | 0.27 | 7 |
| LNU600 | 70486.4 | 1.7 | L | 19 | — | — | — | 92.9 | 0.09 | 14 |
| LNU587 | 70381.1 | 1.6 | 0.08 | 11 | — | — | — | — | — | — |
| LNU582 | 70259.2 | — | — | — | 10.7 | 0.29 | 5 | — | — | — |
| LNU582 | 70259.3 | 1.6 | 0.07 | 11 | — | — | — | — | — | — |
| LNU532 | 70556.4 | — | — | — | — | — | — | 86.9 | 0.19 | 7 |
| CONT. | — | 1.4 | — | — | 10.1 | — | — | 81.3 | — | — |

Table 84. "CONT."—Control; "Ave."—Average; "% Incr." = % increment; "p-val."—p-value; L means that p-value is less than 0.01, p < 0.1 was considered as significant. The transgenes were under the transcriptional regulation of the new At6669 promoter (SEQ ID NO: 6052).

TABLE 85

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU721 | 70613.1 | — | — | — | 11.7 | 0.23 | 17 | — | — | — |
| LNU690 | 70695.3 | — | — | — | 12.8 | 0.07 | 27 | — | — | — |
| LNU680 | 70593.5 | — | — | — | 11.9 | 0.21 | 18 | — | — | — |
| LNU662 | 70343.1 | — | — | — | — | — | — | 0.6 | 0.30 | 9 |
| LNU662 | 70343.3 | — | — | — | 12.1 | 0.18 | 20 | — | — | — |
| LNU631 | 70318.2 | — | — | — | 12.0 | 0.18 | 20 | — | — | — |
| LNU631 | 70320.1 | — | — | — | 12.3 | 0.12 | 23 | 0.6 | 0.24 | 9 |
| LNU629 | 70310.2 | — | — | — | 12.6 | 0.08 | 25 | — | — | — |
| LNU629 | 70311.2 | — | — | — | 11.8 | 0.20 | 18 | — | — | — |
| LNU628 | 70754.2 | 0.9 | 0.29 | 14 | — | — | — | — | — | — |
| LNU621 | 70306.1 | — | — | — | 12.3 | 0.12 | 22 | — | — | — |
| LNU550 | 70767.3 | — | — | — | — | — | — | 0.6 | 0.25 | 9 |
| LNU550 | 70770.1 | — | — | — | 11.8 | 0.20 | 18 | — | — | — |
| LNU529 | 70475.4 | 0.9 | 0.29 | 13 | — | — | — | — | — | — |
| CONT. | — | 0.8 | — | — | 10.1 | — | — | 0.5 | — | — |
| LNU733 | 71227.2 | — | — | — | 7.9 | 0.22 | 18 | — | — | — |
| LNU733 | 71227.3 | — | — | — | 7.8 | 0.22 | 17 | 0.4 | 0.25 | 12 |
| LNU704 | 70798.3 | — | — | — | 8.3 | 0.10 | 24 | — | — | — |
| LNU691 | 71436.2 | — | — | — | 9.7 | L | 46 | 0.5 | 0.04 | 22 |
| LNU691 | 71441.2 | 0.7 | 0.28 | 19 | — | — | — | 0.4 | 0.27 | 11 |
| LNU685 | 71121.4 | 0.7 | 0.19 | 24 | — | — | — | — | — | — |
| LNU680 | 70593.5 | — | — | — | 9.0 | 0.02 | 35 | 0.5 | 0.13 | 16 |
| LNU666 | 71388.2 | — | — | — | 8.8 | 0.02 | 32 | 0.5 | 0.11 | 16 |
| LNU666 | 71389.1 | — | — | — | 8.4 | 0.07 | 26 | 0.5 | 0.17 | 15 |
| LNU628 | 70754.2 | — | — | — | 8.0 | 0.14 | 20 | 0.5 | 0.12 | 16 |
| LNU613 | 71616.6 | — | — | — | 8.1 | 0.15 | 21 | 0.5 | 0.18 | 15 |
| LNU613 | 71621.1 | — | — | — | 8.3 | 0.10 | 24 | 0.5 | 0.13 | 16 |
| LNU609 | 70773.2 | — | — | — | 8.0 | 0.14 | 20 | — | — | — |
| LNU561 | 71346.8 | — | — | — | 9.8 | L | 46 | 0.5 | 0.09 | 19 |
| LNU561 | 71348.1 | — | — | — | 7.7 | 0.26 | 15 | — | — | — |
| LNU550 | 70767.3 | — | — | — | — | — | — | 0.5 | 0.19 | 14 |
| LNU550 | 70770.4 | — | — | — | 8.4 | 0.06 | 25 | — | — | — |
| LNU536 | 70820.3 | — | — | — | 7.8 | 0.26 | 17 | — | — | — |
| LNU536 | 70821.1 | 0.7 | 0.22 | 23 | 8.5 | 0.04 | 28 | — | — | — |
| CONT. | — | 0.6 | — | — | 6.7 | — | — | 0.4 | — | — |
| LNU704 | 70797.1 | — | — | — | 10.5 | 0.05 | 31 | 0.5 | 0.20 | 14 |
| LNU698 | 70882.3 | 0.7 | 0.30 | 7 | — | — | — | — | — | — |
| LNU664 | 71288.2 | 0.7 | 0.22 | 9 | — | — | — | — | — | — |
| LNU663 | 71071.6 | — | — | — | 9.4 | 0.24 | 18 | — | — | — |
| LNU568 | 70845.2 | 0.7 | 0.24 | 9 | — | — | — | — | — | — |
| LNU548 | 70569.1 | 0.8 | 0.15 | 12 | — | — | — | — | — | — |
| LNU548 | 70570.4 | 0.7 | 0.22 | 10 | — | — | — | — | — | — |

TABLE 85-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU526 | 70814.3 | 0.7 | 0.27 | 8 | — | — | — | — | — | — |
| CONT. | — | 0.7 | — | — | 8.0 | — | — | 0.4 | — | — |
| LNU662 | 70342.2 | — | — | — | 12.6 | 0.26 | 17 | — | — | — |
| LNU662 | 70343.1 | — | — | — | 12.5 | 0.29 | 16 | 0.6 | 0.24 | 10 |
| LNU629 | 70311.2 | 0.8 | 0.29 | 15 | 12.9 | 0.22 | 20 | 0.6 | 0.07 | 19 |
| LNU621 | 70306.3 | — | — | — | — | — | — | 0.6 | 0.16 | 12 |
| LNU600 | 70486.4 | — | — | — | — | — | — | 0.6 | 0.07 | 16 |
| LNU600 | 70488.2 | 0.8 | 0.15 | 21 | — | — | — | — | — | — |
| LNU582 | 70259.3 | — | — | — | — | — | — | 0.6 | 0.20 | 12 |
| LNU530 | 70204.1 | 0.8 | 0.30 | 15 | — | — | — | — | — | — |
| CONT. | — | 0.7 | — | — | 10.8 | — | — | 0.5 | — | — |

Table 85. "CONT."—Control; "Ave."—Average; "% Incr." = % increment; "p-val."—p-value; L means that p-value is less than 0.01, p < 0.1 was considered as significant. The transgenes were under the transcriptional regulation of the new At6669 promoter (SEQ ID NO: 6052).

TABLE 86

Genes showing improved plant performance at Normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU721 | 70613.1 | — | — | — | 11.0 | L | 16 | 5.8 | L | 7 |
| LNU721 | 70613.4 | 0.4 | 0.25 | 10 | — | — | — | — | — | — |
| LNU721 | 70614.1 | 0.4 | L | 10 | 10.2 | 0.23 | 8 | 5.6 | 0.29 | 4 |
| LNU700 | 70410.2 | 0.4 | 0.17 | 10 | — | — | — | — | — | — |
| LNU700 | 70410.4 | 0.4 | 0.30 | 2 | — | — | — | — | — | — |
| LNU690 | 70695.3 | — | — | — | 12.0 | L | 27 | 6.0 | L | 11 |
| LNU690 | 70696.4 | — | — | — | 10.2 | 0.25 | 8 | — | — | — |
| LNU680 | 70593.1 | 0.4 | 0.29 | 4 | — | — | — | — | — | — |
| LNU680 | 70593.5 | — | — | — | 11.1 | 0.23 | 17 | 5.7 | 0.30 | 6 |
| LNU662 | 70342.1 | — | — | — | — | — | — | 5.5 | 0.21 | 3 |
| LNU631 | 70316.2 | — | — | — | 10.6 | 0.09 | 12 | 5.7 | 0.02 | 5 |
| LNU631 | 70318.1 | 0.4 | 0.07 | 8 | — | — | — | — | — | — |
| LNU631 | 70318.2 | 0.4 | 0.21 | 6 | — | — | — | 5.9 | 0.24 | 8 |
| LNU631 | 70320.1 | — | — | — | 11.6 | 0.24 | 23 | 6.1 | L | 12 |
| LNU629 | 70310.2 | — | — | — | 11.9 | L | 26 | 6.0 | 0.20 | 10 |
| LNU629 | 70311.2 | — | — | — | 11.1 | 0.08 | 17 | 5.7 | 0.03 | 5 |
| LNU629 | 70313.1 | 0.4 | 0.23 | 6 | — | — | — | — | — | — |
| LNU628 | 70754.2 | 0.4 | L | 20 | — | — | — | — | — | — |
| LNU621 | 70306.1 | 0.4 | 0.02 | 10 | 11.6 | 0.02 | 22 | 5.9 | 0.12 | 9 |
| LNU602 | 70382.2 | 0.4 | 0.02 | 6 | — | — | — | — | — | — |
| LNU550 | 70767.3 | — | — | — | 10.7 | L | 13 | 5.8 | 0.09 | 8 |
| LNU550 | 70770.1 | — | — | — | 11.3 | L | 19 | 5.8 | L | 7 |
| LNU550 | 70771.4 | — | — | — | 10.3 | 0.15 | 9 | — | — | — |
| LNU544 | 70234.1 | 0.4 | 0.08 | 6 | — | — | — | — | — | — |
| LNU544 | 70234.3 | 0.4 | 0.28 | 8 | — | — | — | — | — | — |
| LNU529 | 70475.2 | 0.4 | 0.10 | 7 | 10.4 | 0.05 | 10 | 5.6 | 0.05 | 4 |
| LNU529 | 70477.3 | — | — | — | 10.4 | 0.23 | 10 | — | — | — |
| CONT. | — | 0.4 | — | — | 9.5 | — | — | 5.4 | — | — |
| LNU733 | 71227.3 | — | — | — | 8.0 | 0.03 | 16 | 5.2 | 0.03 | 10 |
| LNU704 | 70798.3 | 0.3 | 0.05 | 15 | — | — | — | — | — | — |
| LNU704 | 70800.2 | 0.3 | 0.09 | 9 | — | — | — | — | — | — |
| LNU691 | 71436.2 | — | — | — | 10.1 | 0.18 | 46 | 5.6 | 0.10 | 18 |
| LNU691 | 71436.4 | 0.3 | 0.09 | 8 | — | — | — | — | — | — |
| LNU691 | 71441.2 | — | — | — | — | — | — | 5.0 | 0.29 | 6 |
| LNU685 | 71122.1 | — | — | — | 7.7 | 0.30 | 11 | — | — | — |
| LNU680 | 70593.2 | 0.3 | 0.05 | 10 | — | — | — | — | — | — |
| LNU680 | 70593.5 | — | — | — | 9.2 | 0.08 | 33 | 5.4 | 0.03 | 13 |
| LNU680 | 70595.5 | 0.3 | 0.13 | 11 | — | — | — | — | — | — |
| LNU679 | 70794.2 | — | — | — | 7.4 | 0.26 | 7 | — | — | — |
| LNU666 | 71388.2 | — | — | — | 9.1 | L | 32 | 5.5 | L | 16 |
| LNU666 | 71389.1 | 0.3 | 0.29 | 5 | 8.8 | 0.23 | 27 | 5.3 | 0.15 | 13 |
| LNU666 | 71390.2 | — | — | — | 7.7 | 0.21 | 11 | 5.0 | 0.09 | 6 |
| LNU628 | 70754.2 | — | — | — | 8.2 | 0.09 | 19 | 5.3 | 0.01 | 13 |

TABLE 86-continued

Genes showing improved plant performance at Normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU628 | 70756.3 | 0.3 | 0.11 | 13 | — | — | — | — | — | — |
| LNU613 | 71616.6 | 0.3 | 0.17 | 7 | — | — | — | 5.3 | 0.13 | 11 |
| LNU613 | 71619.2 | 0.3 | 0.21 | 6 | — | — | — | — | — | — |
| LNU613 | 71621.1 | 0.3 | 0.27 | 16 | 8.4 | 0.01 | 22 | 5.2 | 0.02 | 9 |
| LNU613 | 71621.3 | 0.3 | 0.11 | 8 | 7.7 | 0.11 | 12 | 5.0 | 0.09 | 6 |
| LNU613 | 71621.4 | 0.3 | 0.16 | 7 | — | — | — | — | — | — |
| LNU609 | 70773.2 | — | — | — | 8.3 | 0.08 | 21 | — | — | — |
| LNU564 | 70838.2 | — | — | — | 7.6 | 0.24 | 10 | — | — | — |
| LNU561 | 71346.6 | 0.3 | 0.04 | 11 | — | — | — | — | — | — |
| LNU561 | 71346.8 | — | — | — | 10.1 | 0.25 | 46 | 5.7 | 0.19 | 20 |
| LNU561 | 71348.1 | 0.3 | 0.24 | 7 | 7.9 | 0.12 | 14 | 5.0 | 0.14 | 5 |
| LNU550 | 70770.4 | — | — | — | 8.7 | L | 25 | 5.2 | 0.05 | 10 |
| LNU550 | 70771.4 | 0.3 | 0.18 | 13 | — | — | — | — | — | — |
| LNU536 | 70821.1 | — | — | — | 8.8 | 0.01 | 28 | 5.3 | 0.01 | 11 |
| CONT. | — | 0.3 | — | — | 6.9 | — | — | 4.7 | — | — |
| LNU744 | 71485.1 | — | — | — | 11.4 | 0.07 | 15 | 5.7 | 0.21 | 7 |
| LNU744 | 71487.3 | 0.2 | 0.15 | 8 | — | — | — | — | — | — |
| LNU704 | 70796.3 | — | — | — | 11.0 | 0.18 | 12 | 5.7 | 0.16 | 6 |
| LNU704 | 70797.1 | — | — | — | 12.8 | L | 30 | 6.1 | 0.01 | 13 |
| LNU701 | 71133.4 | 0.2 | 0.05 | 14 | — | — | — | — | — | — |
| LNU698 | 70882.3 | 0.2 | 0.25 | 12 | — | — | — | — | — | — |
| LNU698 | 70883.4 | — | — | — | — | — | — | 5.6 | 0.27 | 5 |
| LNU694 | 71129.2 | — | — | — | 10.9 | 0.29 | 10 | — | — | — |
| LNU677 | 71105.3 | 0.2 | 0.19 | 9 | — | — | — | — | — | — |
| LNU665 | 71077.1 | 0.2 | 0.13 | 14 | — | — | — | — | — | — |
| LNU665 | 71081.2 | 0.3 | L | 30 | — | — | — | — | — | — |
| LNU663 | 71071.6 | — | — | — | 11.6 | 0.16 | 18 | — | — | — |
| LNU663 | 71072.5 | 0.2 | 0.17 | 24 | — | — | — | — | — | — |
| LNU663 | 71075.3 | — | — | — | 10.9 | 0.19 | 11 | 5.7 | 0.20 | 5 |
| LNU640 | 71017.4 | — | — | — | 11.1 | 0.14 | 13 | 5.6 | 0.20 | 5 |
| LNU568 | 70848.2 | — | — | — | — | — | — | 5.6 | 0.28 | 4 |
| LNU557 | 71402.2 | 0.2 | 0.27 | 6 | — | — | — | — | — | — |
| LNU557 | 71402.5 | 0.2 | 0.19 | 20 | — | — | — | — | — | — |
| LNU526 | 70814.3 | — | — | — | — | — | — | 5.6 | 0.23 | 5 |
| LNU526 | 70816.2 | 0.2 | 0.01 | 22 | — | — | — | — | — | — |
| CONT. | — | 0.2 | — | — | 9.9 | — | — | 5.4 | — | — |
| LNU662 | 70342.2 | — | — | — | 11.9 | L | 17 | 5.9 | 0.06 | 6 |
| LNU662 | 70343.1 | — | — | — | 11.7 | 0.12 | 15 | 6.2 | 0.22 | 10 |
| LNU641 | 70632.1 | 0.4 | 0.19 | 15 | — | — | — | — | — | — |
| LNU631 | 70320.1 | 0.4 | 0.25 | 14 | — | — | — | — | — | — |
| LNU629 | 70312.1 | 0.4 | 0.02 | 31 | — | — | — | — | — | — |
| LNU621 | 70306.3 | — | — | — | 10.9 | 0.27 | 7 | 6.1 | 0.13 | 9 |
| LNU600 | 70486.4 | — | — | — | 11.6 | 0.09 | 14 | 6.2 | L | 11 |
| LNU587 | 70378.1 | 0.4 | 0.15 | 17 | — | — | — | — | — | — |
| LNU587 | 70379.3 | — | — | — | — | — | — | 5.8 | 0.14 | 4 |
| LNU582 | 70259.3 | — | — | — | — | — | — | 6.0 | 0.15 | 8 |
| LNU553 | 70372.2 | — | — | — | — | — | — | 5.9 | 0.17 | 6 |
| LNU553 | 70375.1 | 0.4 | 0.09 | 20 | — | — | — | — | — | — |
| LNU544 | 70234.1 | 0.4 | 0.18 | 15 | — | — | — | — | — | — |
| LNU544 | 70234.3 | 0.4 | 0.08 | 21 | — | — | — | — | — | — |
| LNU532 | 70556.2 | 0.4 | 0.05 | 24 | — | — | — | — | — | — |
| LNU532 | 70556.4 | — | — | — | 10.9 | 0.19 | 7 | — | — | — |
| LNU530 | 70203.2 | 0.4 | 0.27 | 12 | — | — | — | — | — | — |
| LNU529 | 70475.2 | 0.4 | 0.14 | 16 | — | — | — | — | — | — |
| LNU529 | 70477.3 | 0.4 | 0.15 | 16 | — | — | — | — | — | — |
| CONT. | — | 0.3 | — | — | 10.2 | — | — | 5.6 | — | — |

Table 86. "CONT."—Control; "Ave."—Average; "% Incr." = % increment; "p-val."—p-value; L means that p-value is less than 0.01, p < 0.1 was considered as significant. The transgenes were under the transcriptional regulation of the new At6669 promoter (SEQ ID NO: 6052).

TABLE 87

Genes showing improved plant performance at Normal growth conditions under regulation of At6669 promoter

| Gene Name | Event # | Seed Yield [mg] Ave. | P-Val. | % Incr. | 1000 Seed Weight [mg] Ave. | P-Val. | % Incr. |
|---|---|---|---|---|---|---|---|
| LNU721 | 70610.6 | 268.2 | 0.29 | 7 | — | — | — |
| LNU721 | 70613.4 | 274.2 | 0.04 | 9 | — | — | — |
| LNU721 | 70614.1 | 283.6 | 0.08 | 13 | — | — | — |
| LNU700 | 70410.2 | 279.2 | 0.14 | 11 | — | — | — |
| LNU690 | 70694.2 | — | — | — | 22.6 | 0.29 | 10 |
| LNU680 | 70593.2 | 262.4 | 0.24 | 5 | — | — | — |
| LNU679 | 70794.3 | — | — | — | 21.5 | 0.06 | 5 |
| LNU662 | 70342.2 | — | — | — | 22.7 | L | 11 |
| LNU662 | 70343.1 | — | — | — | 29.6 | 0.06 | 45 |
| LNU662 | 70343.3 | 274.1 | 0.07 | 9 | — | — | — |
| LNU631 | 70318.1 | 270.6 | 0.23 | 8 | — | — | — |
| LNU631 | 70318.2 | 280.3 | 0.02 | 12 | — | — | — |
| LNU629 | 70310.2 | 287.8 | 0.30 | 15 | — | — | — |
| LNU629 | 70311.2 | 267.7 | 0.26 | 7 | — | — | — |
| LNU628 | 70754.2 | 284.0 | 0.23 | 13 | — | — | — |
| LNU621 | 70304.2 | — | — | — | 21.9 | L | 7 |
| LNU621 | 70305.1 | — | — | — | 23.6 | 0.15 | 15 |
| LNU609 | 70773.2 | — | — | — | 22.0 | 0.11 | 8 |
| LNU609 | 70774.4 | 273.5 | 0.16 | 9 | — | — | — |
| LNU602 | 70382.5 | 273.0 | 0.06 | 9 | — | — | — |
| LNU602 | 70383.4 | 275.8 | 0.03 | 10 | — | — | — |
| LNU602 | 70384.2 | — | — | — | 23.8 | 0.26 | 16 |
| LNU564 | 70839.4 | 280.5 | 0.29 | 12 | — | — | — |
| LNU550 | 70766.2 | — | — | — | 21.5 | 0.04 | 5 |
| LNU550 | 70767.3 | 280.8 | 0.02 | 12 | — | — | — |
| LNU550 | 70770.1 | 271.1 | 0.10 | 8 | — | — | — |
| LNU544 | 70232.1 | — | — | — | 24.5 | 0.05 | 19 |
| LNU544 | 70234.1 | 290.6 | 0.04 | 16 | — | — | — |
| LNU536 | 70821.1 | — | — | — | 24.9 | 0.05 | 21 |
| LNU529 | 70475.2 | 284.4 | 0.29 | 13 | — | — | — |
| CONT. | — | 250.9 | — | — | 20.5 | — | — |
| LNU733 | 71228.1 | 142.0 | 0.18 | 11 | — | — | — |
| LNU730 | 71216.4 | — | — | — | 19.2 | 0.03 | 4 |
| LNU730 | 71217.6 | — | — | — | 21.2 | 0.25 | 15 |
| LNU704 | 70797.1 | — | — | — | 21.1 | 0.12 | 14 |
| LNU704 | 70798.3 | 175.4 | L | 37 | — | — | — |
| LNU691 | 71436.2 | — | — | — | 22.2 | L | 20 |
| LNU691 | 71436.4 | — | — | — | 18.9 | 0.23 | 3 |
| LNU691 | 71441.2 | 155.2 | L | 21 | — | — | — |
| LNU685 | 71120.2 | 162.3 | 0.23 | 27 | 19.8 | 0.04 | 7 |
| LNU680 | 70593.2 | 151.3 | 0.30 | 18 | — | — | — |
| LNU680 | 70593.5 | 141.2 | 0.26 | 10 | 20.6 | L | 12 |
| LNU680 | 70595.5 | 169.1 | L | 32 | — | — | — |
| LNU679 | 70790.2 | 140.0 | 0.14 | 9 | — | — | — |
| LNU679 | 70794.2 | 149.1 | 0.02 | 16 | — | — | — |
| LNU679 | 70794.3 | 152.1 | 0.02 | 19 | 19.8 | 0.22 | 8 |
| LNU666 | 71389.1 | 165.8 | 0.05 | 30 | — | — | — |
| LNU664 | 71291.2 | — | — | — | 19.4 | 0.01 | 5 |
| LNU628 | 70756.3 | 155.0 | 0.25 | 21 | 19.0 | 0.24 | 3 |
| LNU613 | 71616.6 | 187.4 | L | 46 | — | — | — |
| LNU613 | 71619.2 | 153.8 | L | 20 | — | — | — |
| LNU613 | 71621.1 | 211.9 | L | 65 | 19.7 | 0.04 | 7 |
| LNU613 | 71621.3 | 188.9 | 0.02 | 47 | — | — | — |
| LNU613 | 71621.4 | 157.2 | 0.05 | 23 | — | — | — |
| LNU609 | 70773.2 | — | — | — | 21.3 | 0.04 | 16 |
| LNU609 | 70776.4 | — | — | — | 19.6 | 0.17 | 6 |
| LNU609 | 70777.3 | — | — | — | 21.4 | 0.29 | 16 |
| LNU561 | 71346.6 | 148.7 | 0.07 | 16 | — | — | — |
| LNU561 | 71346.8 | — | — | — | 24.7 | 0.03 | 34 |
| LNU561 | 71348.1 | 169.9 | L | 33 | — | — | — |
| LNU561 | 71349.4 | — | — | — | 19.5 | 0.16 | 6 |
| LNU536 | 70821.1 | 138.3 | 0.19 | 8 | 19.8 | L | 8 |
| LNU536 | 70825.1 | 143.0 | 0.08 | 12 | — | — | — |
| CONT. | — | 128.1 | — | — | 18.4 | — | — |
| LNU736 | 71233.5 | — | — | — | 27.0 | L | 38 |
| LNU736 | 71235.1 | — | — | — | 20.4 | 0.29 | 4 |
| LNU733 | 71227.2 | 157.2 | 0.30 | 19 | — | — | — |
| LNU733 | 71228.1 | 148.5 | 0.29 | 13 | — | — | — |
| LNU704 | 70797.1 | — | — | — | 21.7 | L | 11 |
| LNU701 | 71131.3 | 158.7 | 0.23 | 20 | — | — | — |
| LNU701 | 71134.2 | — | — | — | 21.1 | 0.18 | 8 |
| LNU694 | 71129.2 | — | — | — | 20.4 | 0.17 | 4 |
| LNU665 | 71077.1 | 148.7 | 0.26 | 13 | 19.9 | 0.27 | 2 |
| LNU665 | 71081.2 | 152.3 | 0.08 | 16 | 20.4 | 0.12 | 4 |
| LNU664 | 71292.1 | — | — | — | 21.2 | 0.23 | 8 |
| LNU663 | 71071.3 | 165.2 | 0.16 | 25 | — | — | — |
| LNU663 | 71071.6 | — | — | — | 21.8 | 0.03 | 11 |
| LNU663 | 71072.5 | 159.9 | L | 21 | — | — | — |
| LNU568 | 70846.3 | 144.6 | 0.09 | 10 | — | — | — |
| LNU557 | 71402.5 | 159.2 | 0.15 | 21 | 20.1 | 0.12 | 3 |
| LNU548 | 70570.4 | — | — | — | 22.3 | 0.02 | 14 |
| LNU526 | 70816.2 | 182.2 | 0.01 | 38 | — | — | — |
| CONT. | — | 131.8 | — | — | 19.6 | — | — |
| LNU700 | 70410.2 | — | — | — | 20.1 | 0.26 | 3 |
| LNU662 | 70342.2 | — | — | — | 24.4 | 0.01 | 25 |
| LNU662 | 70343.1 | — | — | — | 24.3 | 0.23 | 25 |
| LNU629 | 70312.1 | 279.1 | 0.13 | 18 | — | — | — |
| LNU621 | 70305.1 | — | — | — | 24.1 | 0.03 | 24 |
| LNU600 | 70488.1 | — | — | — | 21.1 | 0.02 | 9 |
| LNU587 | 70380.5 | — | — | — | 24.2 | 0.07 | 24 |
| LNU587 | 70381.1 | — | — | — | 20.5 | 0.14 | 5 |
| LNU582 | 70256.1 | — | — | — | 21.3 | 0.22 | 9 |
| LNU582 | 70259.3 | — | — | — | 22.1 | 0.03 | 13 |
| LNU560 | 70243.4 | — | — | — | 20.2 | 0.23 | 4 |
| LNU553 | 70375.1 | — | — | — | 20.6 | 0.18 | 6 |
| LNU544 | 70232.1 | — | — | — | 21.6 | 0.03 | 11 |
| LNU532 | 70556.4 | — | — | — | 24.6 | 0.07 | 26 |
| LNU530 | 70204.1 | — | — | — | 21.0 | 0.08 | 8 |
| LNU530 | 70207.4 | — | — | — | 25.0 | L | 28 |
| LNU529 | 70477.3 | 270.7 | 0.20 | 14 | — | — | — |
| CONT. | — | 237.2 | — | — | 19.5 | — | — |

Table 87. "CONT."—Control; "Ave."—Average; "% Incr." = % increment; "p-val."—p-value; L means that p-value is less than 0.01, p < 0.1 was considered as significant. The transgenes were under the transcriptional regulation of the new At6669 promoter (SEQ ID NO: 6052).

Example 20

Evaluation of Transgenic *Arabidopsis* Nue, Yield and Plant Growth Rate Under Low or Normal Nitrogen Fertilization in Greenhouse Assay Assay 2: Nitrogen Use Efficiency Measured Until Bolting Stage: Plant Biomass and Plant Growth Rate at Limited and Optimal Nitrogen Concentration Under Greenhouse Conditions—

This assay follows the plant biomass formation and the rosette area growth of plants grown in the greenhouse at limiting and non-limiting nitrogen growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing nitrogen limiting conditions, which were achieved by irrigating the plants with a solution containing 1.5 mM inorganic nitrogen in the form of $KNO_3$, supplemented with 1 mM $KH_2PO_4$, 1 mM $MgSO_4$, 3.6 mM KCl, 2 mM $CaCl_2$ and microelements, while normal nitrogen levels were achieved by applying a solution of 6 mM inorganic nitrogen also in the form of $KNO_3$ with 1 mM $KH_2PO_4$, 1 mM $MgSO_4$, 2 mM $CaCl_2$ and microelements. All plants were grown in the greenhouse until bolting. Plant biomass (the above ground tissue) was weighted in directly after harvesting the rosette (plant fresh weight [FW]). Following plants were dried in an oven at 50° C. for 48 hours and weighted (plant dry weight [DW]).

Each construct was validated at its $T_2$ generation. Transgenic plants transformed with a construct conformed by an empty vector carrying the At6669 promoter and the selectable marker was used as control.

The plants were analyzed for their overall size, growth rate, fresh weight and dry matter. Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital Imaging—

A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubes were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which is developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf Analysis—

Using the digital analysis leaves data was calculated, including leaf number, rosette area, rosette diameter, and leaf blade area.

Vegetative Growth Rate:

the relative growth rate (RGR) of leaf number (Formula VI, described above), rosette area (Formula VII described above) and plot coverage (Formula IX, described above) was calculated using the indicated formulas.

Plant Fresh and Dry Weight—

On about day 80 from sowing, the plants were harvested and directly weighted for the determination of the plant fresh weight (FW) and left to dry at 50° C. in a drying chamber for about 48 hours before weighting to determine plant dry weight (DW).

Statistical Analyses—

To identify genes conferring significantly improved tolerance to abiotic stresses and improved nitrogen use efficiency, the results obtained from the transgenic plants were compared to those obtained from control plants when grown under identical growth conditions. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

The genes listed in Tables 88-89 improved plant NUE when grown at limiting nitrogen concentration levels. These genes produced larger plants with a larger photosynthetic area, biomass (fresh weight, dry weight, leaf number, rosette diameter, rosette area and plot coverage) when grown under limiting nitrogen conditions (nutrient deficiency stress) as compared to control plants grown under identical growth conditions.

TABLE 88

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU745 | 70911.4 | — | — | — | 850.0 | 0.18 | 7 | 11.3 | 0.19 | 11 |
| LNU745 | 70912.3 | — | — | — | 862.5 | 0.13 | 9 | 11.0 | 0.01 | 8 |
| LNU745 | 70914.2 | 94.1 | 0.23 | 8 | 867.9 | 0.05 | 10 | — | — | — |
| LNU724 | 71513.4 | 102.4 | 0.06 | 17 | 878.6 | 0.05 | 11 | — | — | — |
| LNU723 | 71196.6 | — | — | — | — | — | — | 10.7 | 0.18 | 5 |
| LNU722 | 71188.3 | — | — | — | 931.2 | L | 18 | 10.8 | 0.11 | 6 |
| LNU716 | 70760.4 | — | — | — | — | — | — | 11.1 | 0.18 | 9 |
| LNU716 | 70760.8 | — | — | — | 891.7 | L | 13 | 10.9 | 0.04 | 6 |
| LNU716 | 70761.5 | 96.2 | 0.12 | 10 | — | — | — | — | — | — |
| LNU683 | 71293.1 | 115.0 | 0.09 | 32 | 925.0 | L | 17 | 11.2 | 0.15 | 10 |
| LNU683 | 71294.2 | — | — | — | — | — | — | 10.5 | 0.27 | 3 |
| LNU682 | 71431.3 | — | — | — | 843.8 | 0.06 | 7 | — | — | — |
| LNU670 | 71083.1 | — | — | — | — | — | — | 10.8 | 0.21 | 5 |
| LNU670 | 71084.1 | — | — | — | 937.5 | L | 18 | 11.1 | 0.07 | 9 |
| LNU670 | 71084.4 | — | — | — | — | — | — | 10.8 | 0.08 | 5 |
| LNU670 | 71088.2 | 94.5 | 0.26 | 8 | — | — | — | — | — | — |
| LNU656 | 71385.1 | 112.2 | 0.08 | 29 | — | — | — | — | — | — |
| LNU613 | 71621.3 | 115.0 | 0.17 | 32 | 837.5 | 0.12 | 6 | — | — | — |
| LNU613 | 71621.4 | — | — | — | — | — | — | 11.2 | 0.15 | 10 |
| LNU597 | 72367.6 | 103.8 | 0.09 | 19 | 837.5 | 0.12 | 6 | — | — | — |
| LNU597 | 72369.1 | 105.6 | 0.01 | 21 | 862.5 | 0.26 | 9 | — | — | — |
| LNU590 | 70263.2 | 114.4 | 0.29 | 31 | 917.9 | 0.08 | 16 | — | — | — |
| LNU590 | 70263.3 | 102.5 | 0.06 | 18 | 843.8 | 0.06 | 7 | 11.5 | 0.26 | 13 |
| LNU590 | 70264.2 | — | — | — | — | — | — | 10.7 | 0.09 | 5 |

TABLE 88-continued

Genes showing improved plant biomass production at limiting nitrogen growth conditions

| Gene Name | Event # | Dry Weight [mg] Ave. | P-Val. | % Incr. | Fresh Weight [mg] Ave. | P-Val. | % Incr. | Leaf Number Ave. | P-Val. | % Incr. |
|---|---|---|---|---|---|---|---|---|---|---|
| LNU590 | 70267.5 | — | — | — | 885.7 | 0.01 | 12 | — | — | — |
| LNU577 | 72121.2 | — | — | — | 887.5 | L | 12 | 10.8 | 0.06 | 5 |
| LNU577 | 72126.6 | 95.6 | 0.14 | 10 | 868.8 | 0.01 | 10 | — | — | — |
| LNU556 | 72361.2 | 105.8 | L | 21 | — | — | — | — | — | — |
| LNU556 | 72362.2 | — | — | — | 877.7 | 0.18 | 11 | — | — | — |
| LNU556 | 72363.2 | — | — | — | 827.7 | 0.23 | 5 | — | — | — |
| LNU556 | 72363.4 | — | — | — | 868.8 | 0.17 | 10 | — | — | — |
| LNU554 | 70482.1 | — | — | — | 843.8 | 0.14 | 7 | 10.9 | 0.15 | 6 |
| LNU554 | 70482.4 | 93.8 | 0.24 | 8 | — | — | — | — | — | — |
| LNU532 | 70556.4 | — | — | — | — | — | — | 10.6 | 0.17 | 4 |
| LNU532 | 70557.1 | 97.3 | 0.09 | 12 | — | — | — | — | — | — |
| CONT. | — | 87.2 | — | — | 791.6 | — | — | 10.2 | — | — |
| LNU721 | 70610.4 | 79.4 | 0.08 | 22 | 773.2 | 0.05 | 23 | 9.7 | 0.16 | 3 |
| LNU721 | 70610.6 | 79.4 | 0.08 | 22 | — | — | — | — | — | — |
| LNU721 | 70613.1 | — | — | — | — | — | — | 10.2 | 0.23 | 9 |
| LNU721 | 70613.4 | — | — | — | — | — | — | 10.2 | L | 9 |
| LNU721 | 70614.3 | — | — | — | — | — | — | 9.8 | 0.21 | 4 |
| LNU675 | 70401.2 | 84.4 | 0.03 | 29 | 725.0 | 0.16 | 15 | 10.2 | 0.06 | 8 |
| LNU675 | 70402.1 | — | — | — | — | — | — | 10.1 | 0.08 | 7 |
| LNU675 | 70403.1 | — | — | — | — | — | — | 10.2 | 0.19 | 8 |
| LNU675 | 70405.1 | 86.9 | 0.06 | 33 | — | — | — | 10.0 | 0.19 | 6 |
| LNU675 | 70405.3 | 83.8 | 0.05 | 28 | 731.2 | 0.17 | 16 | 10.4 | 0.28 | 10 |
| LNU657 | 70334.10 | 75.0 | 0.29 | 15 | — | — | — | 10.2 | 0.06 | 8 |
| LNU657 | 70334.8 | — | — | — | — | — | — | 9.8 | 0.08 | 4 |
| LNU657 | 70336.1 | — | — | — | — | — | — | 10.2 | L | 8 |
| LNU656 | 71384.2 | 80.0 | 0.24 | 23 | — | — | — | 10.6 | 0.27 | 12 |
| LNU656 | 71384.3 | 82.5 | 0.14 | 27 | — | — | — | 10.6 | L | 13 |
| LNU656 | 71385.1 | 87.4 | 0.02 | 34 | 800.0 | 0.03 | 27 | 11.2 | 0.08 | 20 |
| LNU641 | 70628.3 | 88.8 | 0.02 | 36 | 781.2 | 0.20 | 24 | — | — | — |
| LNU641 | 70632.3 | — | — | — | — | — | — | 10.4 | L | 11 |
| LNU625 | 70964.2 | 78.1 | 0.10 | 20 | 731.2 | 0.17 | 16 | — | — | — |
| LNU625 | 70964.4 | 74.4 | 0.29 | 14 | — | — | — | — | — | — |
| LNU625 | 70965.4 | 81.9 | 0.05 | 26 | 793.8 | 0.07 | 26 | 10.7 | 0.18 | 14 |
| LNU612 | 71334.3 | — | — | — | 712.5 | 0.28 | 13 | — | — | — |
| LNU612 | 71334.4 | 83.8 | 0.03 | 28 | 718.8 | 0.28 | 14 | 9.9 | 0.02 | 6 |
| LNU612 | 71335.1 | — | — | — | — | — | — | 10.4 | 0.03 | 11 |
| LNU612 | 71335.4 | — | — | — | 781.2 | 0.14 | 24 | — | — | — |
| LNU612 | 71336.4 | 74.4 | 0.25 | 14 | — | — | — | — | — | — |
| LNU605 | 71352.1 | — | — | — | 700.0 | 0.28 | 11 | — | — | — |
| LNU605 | 71355.2 | — | — | — | — | — | — | 9.7 | 0.16 | 3 |
| LNU605 | 71356.2 | 75.0 | 0.19 | 15 | 725.0 | 0.18 | 15 | — | — | — |
| LNU600 | 70484.3 | 81.2 | 0.05 | 25 | 768.8 | 0.06 | 22 | 9.9 | 0.02 | 6 |
| LNU600 | 70484.5 | — | — | — | — | — | — | 10.4 | 0.09 | 10 |
| LNU600 | 70486.2 | — | — | — | — | — | — | 10.3 | L | 10 |
| LNU600 | 70488.1 | 93.8 | 0.02 | 44 | 768.8 | 0.06 | 22 | — | — | — |
| LNU593 | 71844.3 | 73.1 | 0.28 | 12 | — | — | — | 10.4 | L | 10 |
| LNU593 | 71848.2 | — | — | — | — | — | — | 10.1 | 0.02 | 8 |
| LNU593 | 71848.5 | — | — | — | — | — | — | 10.6 | 0.11 | 12 |
| LNU593 | 71849.1 | 85.0 | 0.10 | 30 | 737.5 | 0.14 | 17 | 10.9 | L | 16 |
| LNU587 | 70378.1 | — | — | — | 700.0 | 0.28 | 11 | 10.6 | L | 13 |
| LNU587 | 70379.3 | 83.8 | 0.08 | 28 | 718.8 | 0.19 | 14 | 9.9 | 0.03 | 5 |
| LNU587 | 70380.3 | — | — | — | — | — | — | 9.6 | 0.24 | 2 |
| LNU587 | 70380.5 | 74.4 | 0.23 | 14 | — | — | — | 10.6 | 0.27 | 12 |
| LNU587 | 70381.1 | — | — | — | — | — | — | 9.8 | 0.08 | 4 |
| LNU582 | 70256.1 | 83.8 | 0.03 | 28 | 800.0 | 0.03 | 27 | 10.3 | L | 10 |
| LNU582 | 70258.2 | — | — | — | — | — | — | 10.4 | 0.28 | 10 |
| LNU582 | 70260.1 | 85.0 | 0.02 | 30 | — | — | — | 10.1 | L | 7 |
| LNU572 | 71406.2 | 84.4 | 0.03 | 29 | — | — | — | 10.2 | 0.19 | 8 |
| LNU572 | 71408.2 | 75.6 | 0.24 | 16 | — | — | — | — | — | — |
| LNU571 | 71842.1 | — | — | — | — | — | — | 9.9 | 0.26 | 5 |
| LNU571 | 71842.3 | 80.6 | 0.25 | 24 | 718.8 | 0.28 | 14 | — | — | — |
| LNU566 | 71834.2 | 86.2 | 0.02 | 32 | 800.0 | 0.03 | 27 | — | — | — |
| LNU566 | 71834.3 | 96.2 | L | 48 | 843.8 | 0.01 | 34 | 10.5 | 0.25 | 12 |
| LNU566 | 71835.1 | 76.2 | 0.15 | 17 | — | — | — | 9.9 | 0.13 | 6 |
| LNU566 | 71837.1 | 73.8 | 0.25 | 13 | — | — | — | — | — | — |
| LNU560 | 70239.1 | 80.6 | 0.10 | 24 | 768.8 | 0.06 | 22 | — | — | — |
| LNU560 | 70241.2 | — | — | — | — | — | — | 9.8 | 0.05 | 4 |
| LNU560 | 70241.4 | — | — | — | 774.1 | 0.05 | 23 | — | — | — |
| LNU553 | 70370.2 | 83.1 | 0.05 | 28 | 725.0 | 0.18 | 15 | — | — | — |
| LNU553 | 70373.1 | 77.5 | 0.25 | 19 | — | — | — | — | — | — |
| LNU553 | 70374.2 | — | — | — | 725.0 | 0.18 | 15 | — | — | — |
| LNU530 | 70203.2 | — | — | — | — | — | — | 10.7 | 0.02 | 14 |

TABLE 88-continued

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU530 | 70203.3 | — | — | — | — | — | — | 10.6 | L | 13 |
| LNU530 | 70204.1 | — | — | — | 900.0 | 0.16 | 43 | 10.1 | L | 8 |
| LNU530 | 70205.6 | 75.3 | 0.18 | 15 | — | — | — | — | — | — |
| LNU530 | 70207.4 | 78.8 | 0.22 | 21 | 731.2 | 0.14 | 16 | 10.4 | 0.03 | 11 |
| CONT. | — | 65.2 | — | — | 628.6 | — | — | 9.4 | — | — |
| LNU738 | 71742.2 | — | — | — | — | — | — | 9.9 | 0.05 | 7 |
| LNU738 | 71743.2 | 98.8 | 0.02 | 16 | 1012.5 | 0.02 | 11 | 9.6 | 0.15 | 4 |
| LNU727 | 71675.4 | 100.6 | 0.08 | 18 | — | — | — | — | — | — |
| LNU720 | 71755.2 | 97.0 | 0.14 | 14 | — | — | — | — | — | — |
| LNU720 | 71756.2 | 103.8 | L | 22 | — | — | — | 10.5 | L | 13 |
| LNU720 | 71756.3 | — | — | — | — | — | — | 9.9 | 0.05 | 7 |
| LNU661 | 72705.3 | 108.8 | 0.02 | 28 | 1093.8 | 0.02 | 20 | — | — | — |
| LNU661 | 72705.6 | — | — | — | — | — | — | 9.9 | 0.08 | 7 |
| LNU619 | 71361.2 | — | — | — | — | — | — | 9.8 | 0.25 | 5 |
| LNU619 | 71363.1 | 92.5 | 0.14 | 9 | — | — | — | — | — | — |
| LNU618 | 72133.2 | 106.9 | L | 26 | 1131.2 | 0.01 | 25 | 9.6 | 0.20 | 4 |
| LNU618 | 72135.3 | 93.1 | 0.08 | 10 | — | — | — | — | — | — |
| LNU598 | 71775.4 | 95.6 | 0.17 | 13 | 943.8 | 0.29 | 4 | — | — | — |
| LNU598 | 71777.3 | 92.5 | 0.09 | 9 | 981.2 | 0.09 | 8 | 9.8 | 0.25 | 5 |
| LNU594 | 71738.4 | — | — | — | — | — | — | 9.6 | 0.20 | 4 |
| LNU594 | 71739.1 | 91.9 | 0.22 | 8 | — | — | — | 10.1 | 0.01 | 9 |
| LNU594 | 71741.2 | 95.0 | 0.03 | 12 | — | — | — | — | — | — |
| LNU584 | 71748.2 | — | — | — | — | — | — | 9.8 | 0.13 | 6 |
| LNU584 | 71751.1 | 107.5 | L | 27 | 1068.8 | L | 18 | 9.9 | 0.21 | 7 |
| LNU576 | 71662.3 | 91.9 | 0.13 | 8 | 981.2 | 0.05 | 8 | — | — | — |
| LNU576 | 71662.5 | 108.1 | L | 27 | 1062.5 | 0.20 | 17 | 9.9 | 0.17 | 7 |
| LNU573 | 72592.1 | 97.5 | 0.01 | 15 | — | — | — | — | — | — |
| LNU555 | 71655.2 | 107.5 | 0.11 | 27 | — | — | — | — | — | — |
| LNU555 | 71656.5 | 98.1 | 0.26 | 15 | — | — | — | 9.6 | 0.15 | 4 |
| LNU555 | 71656.6 | 92.0 | 0.10 | 8 | — | — | — | — | — | — |
| LNU547 | 70970.2 | — | — | — | 1043.8 | 0.26 | 15 | — | — | — |
| LNU547 | 70971.1 | — | — | — | 1035.7 | 0.26 | 14 | — | — | — |
| LNU540 | 70984.4 | 92.5 | 0.14 | 9 | — | — | — | — | — | — |
| LNU540 | 70984.7 | — | — | — | — | — | — | 9.8 | 0.25 | 5 |
| LNU540 | 70985.2 | 91.9 | 0.10 | 8 | — | — | — | — | — | — |
| LNU528 | 70565.1 | — | — | — | — | — | — | 9.8 | 0.13 | 6 |
| LNU528 | 70566.8 | 90.6 | 0.17 | 7 | — | — | — | 9.8 | 0.06 | 5 |
| LNU527 | 70977.2 | 107.5 | L | 27 | 1025.0 | 0.11 | 13 | 10.2 | L | 11 |
| LNU527 | 70978.4 | 104.4 | 0.05 | 23 | 1006.3 | 0.03 | 11 | 10.1 | 0.09 | 9 |
| LNU527 | 70979.2 | — | — | — | — | — | — | 10.1 | 0.05 | 9 |
| LNU527 | 70980.3 | 91.2 | 0.14 | 7 | — | — | — | — | — | — |
| LNU527 | 70980.5 | 110.6 | L | 30 | 1137.5 | L | 25 | 9.9 | 0.08 | 7 |
| LNU523 | 71605.3 | — | — | — | — | — | — | 9.7 | 0.21 | 5 |
| LNU523 | 71605.4 | 105.6 | 0.05 | 24 | 975.0 | 0.08 | 7 | 10.4 | 0.09 | 13 |
| LNU523 | 71605.6 | — | — | — | — | — | — | 10.4 | L | 12 |
| LNU523 | 71607.4 | 102.1 | 0.03 | 20 | 1057.1 | L | 16 | — | — | — |
| CONT. | — | 85.0 | — | — | 908.2 | — | — | 9.3 | — | — |
| LNU736 | 71233.1 | — | — | — | 1119.6 | 0.22 | 6 | — | — | — |
| LNU736 | 71237.2 | — | — | — | 1150.0 | 0.10 | 9 | — | — | — |
| LNU701 | 71131.3 | — | — | — | — | — | — | 10.8 | 0.24 | 3 |
| LNU701 | 71133.2 | — | — | — | 1187.5 | 0.03 | 13 | — | — | — |
| LNU701 | 71133.5 | — | — | — | — | — | — | 11.0 | 0.05 | 5 |
| LNU698 | 70882.3 | — | — | — | 1129.5 | 0.30 | 7 | — | — | — |
| LNU698 | 70883.3 | — | — | — | — | — | — | 11.3 | 0.05 | 8 |
| LNU694 | 71129.2 | 100.0 | 0.20 | 9 | 1193.8 | 0.05 | 13 | — | — | — |
| LNU677 | 71103.4 | — | — | — | 1131.2 | 0.16 | 7 | 11.1 | 0.27 | 6 |
| LNU677 | 71106.1 | — | — | — | — | — | — | 11.1 | 0.17 | 6 |
| LNU666 | 71388.2 | — | — | — | — | — | — | 11.1 | 0.11 | 6 |
| LNU666 | 71390.2 | 114.4 | 0.03 | 25 | 1168.8 | 0.06 | 11 | 11.2 | 0.07 | 7 |
| LNU665 | 71082.1 | 103.3 | 0.09 | 13 | — | — | — | — | — | — |
| LNU665 | 71082.4 | — | — | — | — | — | — | 11.0 | 0.23 | 5 |
| LNU663 | 71071.3 | — | — | — | 1193.8 | 0.29 | 13 | 10.8 | 0.13 | 3 |
| LNU663 | 71071.6 | — | — | — | 1250.0 | L | 19 | 11.3 | 0.18 | 8 |
| LNU663 | 71072.5 | — | — | — | — | — | — | 11.1 | 0.17 | 6 |
| LNU617 | 70293.4 | — | — | — | — | — | — | 11.1 | 0.17 | 6 |
| LNU617 | 70293.6 | — | — | — | — | — | — | 10.9 | 0.17 | 4 |
| LNU617 | 70295.2 | 109.4 | 0.02 | 19 | 1231.2 | 0.05 | 17 | — | — | — |
| LNU617 | 70295.5 | — | — | — | 1131.2 | 0.18 | 7 | — | — | — |
| LNU596 | 72118.2 | — | — | — | — | — | — | 11.4 | 0.22 | 9 |
| LNU575 | 70253.3 | — | — | — | 1200.0 | 0.03 | 14 | 11.1 | 0.03 | 6 |
| LNU575 | 70253.4 | — | — | — | 1193.8 | 0.03 | 13 | — | — | — |
| LNU575 | 70254.1 | — | — | — | — | — | — | 11.3 | 0.05 | 8 |

TABLE 88-continued

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU570 | 70579.4 | — | — | — | 1192.9 | 0.03 | 13 | 11.0 | 0.05 | 5 |
| LNU568 | 70844.4 | 106.2 | 0.08 | 16 | — | — | — | — | — | — |
| LNU568 | 70846.3 | — | — | — | 1131.2 | 0.18 | 7 | 10.9 | 0.03 | 4 |
| LNU562 | 70244.2 | — | — | — | 1162.5 | 0.09 | 10 | — | — | — |
| LNU562 | 70247.3 | — | — | — | 1137.5 | 0.23 | 8 | — | — | — |
| LNU548 | 70569.1 | — | — | — | 1156.2 | 0.12 | 10 | — | — | — |
| LNU526 | 70818.4 | — | — | — | — | — | — | 11.2 | 0.01 | 7 |
| CONT. | — | 91.8 | — | — | 1053.3 | — | — | 10.5 | — | — |
| LNU658 | 70683.2 | 73.5 | 0.09 | 11 | — | — | — | 9.6 | 0.04 | 7 |
| LNU658 | 70687.2 | 74.8 | 0.07 | 13 | 885.7 | 0.30 | 4 | — | — | — |
| LNU658 | 70687.3 | — | — | — | — | — | — | 9.8 | L | 8 |
| LNU647 | 70587.2 | 75.0 | 0.08 | 13 | 1018.8 | 0.14 | 20 | 9.8 | 0.09 | 9 |
| LNU647 | 70589.8 | 71.2 | 0.23 | 8 | 931.2 | 0.03 | 10 | — | — | — |
| LNU644 | 70329.2 | 75.0 | 0.08 | 13 | 987.5 | 0.02 | 16 | — | — | — |
| LNU644 | 70330.1 | 73.6 | 0.23 | 11 | — | — | — | — | — | — |
| LNU644 | 70331.1 | 71.9 | 0.11 | 9 | — | — | — | 9.6 | 0.15 | 6 |
| LNU644 | 70332.2 | — | — | — | 937.5 | 0.08 | 11 | 9.6 | 0.21 | 7 |
| LNU644 | 70333.4 | 75.6 | 0.13 | 14 | — | — | — | 9.8 | L | 8 |
| LNU643 | 70322.1 | 76.2 | 0.06 | 15 | 1012.5 | 0.24 | 19 | — | — | — |
| LNU643 | 70323.1 | 71.9 | 0.11 | 9 | 918.8 | 0.09 | 8 | — | — | — |
| LNU643 | 70325.2 | 75.0 | 0.20 | 13 | — | — | — | 9.7 | 0.11 | 7 |
| LNU643 | 70325.6 | 75.0 | L | 13 | 906.2 | 0.27 | 7 | 9.4 | 0.01 | 5 |
| LNU643 | 70326.5 | 90.6 | L | 37 | 1262.5 | 0.05 | 49 | 10.3 | L | 14 |
| LNU642 | 70582.3 | 75.0 | 0.01 | 13 | 987.5 | 0.15 | 16 | 9.8 | L | 8 |
| LNU642 | 70582.5 | 81.9 | 0.29 | 24 | — | — | — | — | — | — |
| LNU642 | 70583.1 | — | — | — | — | — | — | 9.9 | L | 10 |
| LNU642 | 70583.7 | — | — | — | — | — | — | 9.5 | 0.27 | 5 |
| LNU620 | 70302.1 | 69.4 | 0.19 | 5 | — | — | — | — | — | — |
| LNU620 | 70302.3 | — | — | — | — | — | — | 9.6 | 0.04 | 7 |
| LNU620 | 70303.1 | — | — | — | — | — | — | 9.8 | 0.03 | 8 |
| LNU620 | 70303.4 | — | — | — | — | — | — | 9.2 | 0.20 | 2 |
| LNU617 | 70293.2 | — | — | — | 1021.4 | 0.18 | 20 | 10.1 | L | 12 |
| LNU617 | 70293.6 | 71.9 | 0.04 | 9 | 925.0 | 0.05 | 9 | 9.5 | 0.27 | 5 |
| LNU617 | 70295.2 | — | — | — | 956.2 | 0.17 | 13 | 9.6 | 0.04 | 7 |
| LNU617 | 70295.5 | — | — | — | — | — | — | 10.2 | 0.28 | 13 |
| LNU617 | 70297.1 | — | — | — | — | — | — | 9.2 | 0.20 | 2 |
| LNU606 | 70289.2 | 81.5 | 0.26 | 23 | 1020.5 | 0.29 | 20 | 9.9 | 0.14 | 10 |
| LNU606 | 70290.2 | 75.0 | 0.20 | 13 | 900.0 | 0.25 | 6 | 10.1 | 0.06 | 12 |
| LNU606 | 70290.3 | 76.9 | 0.10 | 16 | 1037.5 | 0.09 | 22 | 9.8 | 0.09 | 9 |
| LNU606 | 70291.2 | 84.4 | 0.04 | 28 | 1131.2 | 0.18 | 33 | 9.6 | 0.15 | 6 |
| LNU604 | 70280.3 | — | — | — | 943.8 | 0.21 | 11 | — | — | — |
| LNU604 | 70281.2 | — | — | — | — | — | — | 9.2 | 0.06 | 3 |
| LNU604 | 70282.1 | — | — | — | — | — | — | 9.4 | 0.01 | 5 |
| LNU604 | 70283.2 | 74.4 | 0.27 | 12 | — | — | — | 9.4 | 0.22 | 5 |
| LNU592 | 70268.1 | 70.6 | 0.08 | 7 | — | — | — | 10.2 | 0.05 | 13 |
| LNU592 | 70270.1 | 86.9 | 0.03 | 31 | 1131.2 | 0.18 | 33 | 9.6 | 0.15 | 6 |
| LNU592 | 70272.1 | — | — | — | — | — | — | 9.9 | 0.18 | 10 |
| LNU592 | 70273.2 | — | — | — | — | — | — | 9.6 | 0.21 | 7 |
| LNU590 | 70262.2 | — | — | — | — | — | — | 9.2 | 0.26 | 3 |
| LNU590 | 70263.2 | 75.0 | 0.08 | 13 | 918.8 | 0.06 | 8 | 9.6 | 0.15 | 6 |
| LNU590 | 70263.3 | 78.2 | 0.09 | 18 | 1030.4 | 0.13 | 21 | — | — | — |
| LNU590 | 70264.2 | 74.4 | 0.16 | 12 | — | — | — | 9.4 | 0.01 | 5 |
| LNU590 | 70267.5 | 85.6 | 0.14 | 29 | 1175.0 | 0.22 | 39 | — | — | — |
| LNU575 | 70250.3 | 78.8 | L | 19 | 962.5 | L | 13 | 9.2 | 0.20 | 2 |
| LNU575 | 70253.3 | 77.5 | 0.30 | 17 | — | — | — | — | — | — |
| LNU575 | 70253.4 | 68.7 | 0.28 | 4 | — | — | — | 9.3 | 0.05 | 3 |
| LNU575 | 70254.1 | — | — | — | — | — | — | 9.4 | 0.13 | 4 |
| LNU575 | 70255.1 | 72.1 | 0.13 | 9 | — | — | — | — | — | — |
| LNU570 | 70578.4 | 73.1 | 0.07 | 11 | 956.2 | 0.08 | 13 | — | — | — |
| LNU562 | 70244.2 | — | — | — | 1075.0 | 0.24 | 27 | — | — | — |
| LNU562 | 70246.3 | 74.4 | 0.04 | 12 | — | — | — | 9.9 | 0.14 | 10 |
| LNU562 | 70247.1 | — | — | — | 887.5 | 0.27 | 5 | — | — | — |
| LNU562 | 70247.3 | — | — | — | 1000.0 | L | 18 | 9.5 | L | 5 |
| LNU558 | 70467.3 | 74.4 | 0.16 | 12 | 956.2 | 0.17 | 13 | — | — | — |
| LNU558 | 70470.3 | — | — | — | — | — | — | 9.5 | 0.27 | 5 |
| LNU558 | 70470.5 | — | — | — | 921.4 | 0.10 | 9 | — | — | — |
| LNU554 | 70478.1 | 88.1 | 0.12 | 33 | 1168.8 | 0.02 | 38 | 9.6 | 0.04 | 7 |
| LNU554 | 70481.2 | 79.4 | 0.22 | 20 | — | — | — | 9.8 | 0.29 | 8 |
| LNU554 | 70482.4 | 83.1 | L | 26 | 1050.0 | L | 24 | 9.8 | 0.09 | 9 |
| LNU534 | 70499.4 | 75.0 | L | 13 | 906.2 | 0.15 | 7 | 9.4 | 0.13 | 4 |
| LNU534 | 70501.1 | 77.5 | 0.23 | 17 | — | — | — | 10.2 | 0.17 | 14 |
| LNU534 | 70501.4 | 68.7 | 0.28 | 4 | — | — | — | 9.6 | L | 6 |

TABLE 88-continued

Genes showing improved plant biomass production at limiting nitrogen growth conditions

| Gene Name | Event # | Dry Weight [mg] Ave. | P-Val. | % Incr. | Fresh Weight [mg] Ave. | P-Val. | % Incr. | Leaf Number Ave. | P-Val. | % Incr. |
|---|---|---|---|---|---|---|---|---|---|---|
| LNU534 | 70501.5 | — | — | — | 956.2 | 0.02 | 13 | — | — | — |
| LNU531 | 70211.1 | — | — | — | — | — | — | 9.7 | 0.25 | 7 |
| LNU531 | 70211.3 | 71.2 | 0.08 | 8 | 912.5 | 0.09 | 8 | 10.2 | 0.29 | 14 |
| LNU531 | 70212.2 | 76.2 | L | 15 | 956.2 | 0.01 | 13 | 9.8 | L | 9 |
| CONT. | — | 66.2 | — | — | 848.2 | — | — | 9.0 | — | — |
| LNU745 | 70911.1 | 166.2 | 0.05 | 10 | — | — | — | — | — | — |
| LNU745 | 70912.3 | — | — | — | 1581.2 | 0.17 | 6 | — | — | — |
| LNU745 | 70912.4 | — | — | — | — | — | — | 9.2 | 0.02 | 6 |
| LNU745 | 70914.2 | — | — | — | 1700.0 | 0.19 | 14 | 9.2 | 0.13 | 6 |
| LNU745 | 70914.4 | 164.4 | 0.19 | 9 | — | — | — | — | — | — |
| LNU724 | 71510.1 | — | — | — | — | — | — | 9.3 | 0.09 | 8 |
| LNU724 | 71512.3 | — | — | — | 1743.8 | 0.12 | 17 | — | — | — |
| LNU724 | 71513.4 | — | — | — | — | — | — | 9.2 | 0.13 | 6 |
| LNU723 | 71191.3 | — | — | — | — | — | — | 9.1 | 0.21 | 5 |
| LNU684 | 71635.1 | 181.2 | 0.29 | 20 | 1800.0 | L | 21 | — | — | — |
| LNU684 | 71637.1 | 164.4 | 0.08 | 9 | 1606.2 | 0.09 | 8 | — | — | — |
| LNU684 | 71639.5 | 165.9 | 0.06 | 10 | — | — | — | 9.2 | 0.19 | 7 |
| LNU660 | 71068.2 | 181.9 | L | 20 | 1712.5 | 0.08 | 15 | — | — | — |
| LNU660 | 71070.1 | 163.1 | 0.13 | 8 | — | — | — | — | — | — |
| LNU655 | 72292.1 | 163.0 | 0.23 | 8 | — | — | — | — | — | — |
| LNU655 | 72293.3 | — | — | — | 1608.9 | 0.12 | 8 | — | — | — |
| LNU625 | 70966.3 | 166.2 | 0.05 | 10 | — | — | — | — | — | — |
| LNU612 | 71334.4 | — | — | — | 1581.2 | 0.21 | 6 | — | — | — |
| LNU612 | 71335.4 | 178.7 | 0.15 | 18 | 1708.9 | 0.02 | 15 | — | — | — |
| LNU612 | 71336.4 | — | — | — | 1560.7 | 0.27 | 5 | — | — | — |
| LNU605 | 71352.1 | 170.0 | 0.02 | 12 | — | — | — | — | — | — |
| LNU605 | 71352.2 | — | — | — | 1681.2 | 0.02 | 13 | 9.3 | L | 8 |
| LNU605 | 71357.2 | — | — | — | — | — | — | 9.1 | 0.21 | 5 |
| LNU597 | 72367.3 | — | — | — | 1568.8 | 0.27 | 5 | — | — | — |
| LNU597 | 72367.4 | 160.7 | 0.18 | 6 | 1614.3 | 0.07 | 8 | 9.2 | L | 7 |
| LNU593 | 71848.5 | — | — | — | — | — | — | 8.9 | 0.22 | 2 |
| LNU593 | 71849.1 | 171.9 | 0.29 | 14 | 1628.6 | 0.07 | 9 | — | — | — |
| LNU577 | 72121.1 | 176.9 | 0.07 | 17 | 1668.8 | 0.02 | 12 | — | — | — |
| LNU577 | 72121.2 | — | — | — | — | — | — | 8.9 | 0.15 | 3 |
| LNU577 | 72126.1 | — | — | — | — | — | — | 9.4 | 0.14 | 8 |
| LNU572 | 71406.2 | — | — | — | 1556.2 | 0.30 | 4 | — | — | — |
| LNU572 | 71407.1 | — | — | — | — | — | — | 9.1 | 0.05 | 5 |
| LNU572 | 71408.6 | — | — | — | — | — | — | 9.1 | 0.21 | 5 |
| LNU571 | 71842.1 | — | — | — | — | — | — | 9.1 | 0.21 | 5 |
| LNU571 | 71842.3 | 166.2 | 0.05 | 10 | 1675.0 | 0.22 | 12 | — | — | — |
| LNU566 | 71834.2 | 182.5 | 0.06 | 21 | — | — | — | 9.1 | 0.07 | 5 |
| LNU556 | 72363.4 | — | — | — | — | — | — | 9.0 | 0.08 | 4 |
| LNU531 | 70209.4 | 165.1 | 0.21 | 9 | — | — | — | — | — | — |
| LNU531 | 70211.1 | 169.3 | 0.25 | 12 | 1824.1 | 0.03 | 22 | — | — | — |
| LNU531 | 70211.3 | 180.0 | L | 19 | 1687.5 | 0.02 | 13 | — | — | — |
| CONT. | — | 151.3 | — | — | 1492.2 | — | — | 8.7 | — | — |
| LNU747 | 70616.4 | — | — | — | 913.4 | 0.04 | 9 | 10.0 | 0.25 | 5 |
| LNU747 | 70618.1 | — | — | — | — | — | — | 9.9 | 0.04 | 4 |
| LNU697 | 70702.2 | — | — | — | 962.5 | L | 15 | 10.0 | 0.25 | 5 |
| LNU697 | 70705.2 | 78.1 | 0.26 | 12 | 912.5 | 0.05 | 9 | — | — | — |
| LNU673 | 70395.5 | — | — | — | — | — | — | 10.2 | L | 7 |
| LNU669 | 70388.2 | 85.6 | 0.08 | 22 | 1021.4 | L | 22 | — | — | — |
| LNU669 | 70389.2 | 76.2 | 0.13 | 9 | — | — | — | — | — | — |
| LNU669 | 70393.2 | — | — | — | — | — | — | 9.8 | 0.12 | 3 |
| LNU653 | 70659.4 | 80.6 | 0.03 | 15 | 987.5 | 0.02 | 18 | — | — | — |
| LNU651 | 70666.1 | 75.8 | 0.27 | 8 | — | — | — | — | — | — |
| LNU650 | 70874.3 | — | — | — | 918.8 | 0.27 | 10 | — | — | — |
| LNU650 | 70877.4 | — | — | — | 906.2 | 0.21 | 8 | — | — | — |
| LNU630 | 70862.4 | 74.7 | 0.23 | 7 | 895.5 | 0.29 | 7 | 10.1 | L | 6 |
| LNU630 | 70864.2 | 80.0 | 0.03 | 14 | — | — | — | — | — | — |
| LNU623 | 71010.3 | — | — | — | 931.2 | 0.04 | 11 | 10.5 | L | 10 |
| LNU610 | 70781.1 | 84.2 | 0.25 | 20 | 962.5 | 0.26 | 15 | 9.9 | 0.04 | 4 |
| LNU563 | 70987.3 | 76.2 | 0.13 | 9 | 887.5 | 0.17 | 6 | — | — | — |
| LNU563 | 70987.5 | 77.5 | 0.14 | 11 | 918.8 | 0.06 | 10 | — | — | — |
| LNU547 | 70970.2 | 75.6 | 0.29 | 8 | — | — | — | — | — | — |
| LNU547 | 70972.1 | — | — | — | 961.6 | 0.03 | 15 | — | — | — |
| LNU540 | 70984.2 | — | — | — | — | — | — | 9.9 | 0.14 | 4 |
| LNU540 | 70984.4 | 87.5 | L | 25 | 1031.2 | 0.27 | 23 | 10.5 | 0.28 | 10 |
| LNU540 | 70985.2 | 82.5 | 0.17 | 18 | 918.8 | 0.06 | 10 | 10.0 | 0.02 | 5 |
| LNU540 | 70986.1 | 75.6 | 0.20 | 8 | 937.5 | 0.02 | 12 | — | — | — |
| LNU528 | 70566.5 | 80.6 | 0.03 | 15 | 912.5 | 0.05 | 9 | — | — | — |
| LNU527 | 70977.2 | — | — | — | — | — | — | 10.2 | L | 7 |

TABLE 88-continued

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU527 | 70978.4 | — | — | — | 875.0 | 0.26 | 4 | — | — | — |
| LNU522 | 70804.4 | 77.5 | 0.08 | 11 | 881.2 | 0.27 | 5 | 9.9 | 0.14 | 4 |
| CONT. | — | 69.9 | — | — | 838.5 | — | — | 9.5 | — | — |
| LNU722 | 71185.4 | 89.4 | 0.22 | 11 | 1143.8 | 0.17 | 14 | — | — | — |
| LNU716 | 70760.4 | 101.9 | 0.02 | 26 | 1162.5 | 0.16 | 16 | — | — | — |
| LNU716 | 70760.7 | — | — | — | — | — | — | 9.9 | 0.14 | 4 |
| LNU716 | 70760.8 | 90.0 | 0.20 | 12 | — | — | — | — | — | — |
| LNU716 | 70762.2 | 91.9 | 0.25 | 14 | 1106.2 | 0.28 | 10 | — | — | — |
| LNU683 | 71294.2 | 90.6 | 0.19 | 12 | 1200.0 | 0.06 | 19 | 10.0 | 0.22 | 5 |
| LNU682 | 71432.3 | 92.5 | 0.15 | 15 | 1193.8 | 0.09 | 19 | — | — | — |
| LNU682 | 71433.5 | 92.5 | 0.20 | 15 | 1112.5 | 0.29 | 11 | — | — | — |
| LNU670 | 71088.7 | 92.5 | 0.10 | 15 | 1187.5 | 0.08 | 18 | — | — | — |
| LNU668 | 71415.1 | — | — | — | 1193.8 | 0.07 | 19 | 10.2 | 0.01 | 7 |
| LNU668 | 71415.3 | — | — | — | 1175.0 | 0.10 | 17 | — | — | — |
| LNU668 | 71415.5 | — | — | — | 1193.8 | 0.07 | 19 | 10.0 | 0.07 | 5 |
| LNU658 | 70687.3 | 92.5 | 0.10 | 15 | 1256.2 | 0.03 | 25 | — | — | — |
| LNU647 | 70589.6 | 96.1 | 0.05 | 19 | 1185.7 | 0.08 | 18 | — | — | — |
| LNU647 | 70589.8 | 103.8 | L | 29 | 1293.8 | 0.01 | 29 | 10.4 | 0.13 | 10 |
| LNU646 | 72145.3 | — | — | — | — | — | — | 9.8 | 0.15 | 3 |
| LNU646 | 72148.5 | 93.8 | 0.09 | 16 | 1300.0 | 0.02 | 29 | — | — | — |
| LNU646 | 72150.2 | 92.5 | 0.10 | 15 | — | — | — | 9.9 | 0.06 | 5 |
| LNU644 | 70330.1 | 98.1 | 0.03 | 22 | 1243.8 | 0.09 | 24 | 9.9 | 0.06 | 5 |
| LNU644 | 70332.2 | 95.0 | 0.06 | 18 | 1268.8 | 0.02 | 26 | — | — | — |
| LNU643 | 70323.1 | — | — | — | 1250.0 | 0.03 | 24 | 10.4 | 0.20 | 9 |
| LNU643 | 70325.2 | — | — | — | 1156.2 | 0.19 | 15 | — | — | — |
| LNU643 | 70325.6 | — | — | — | 1187.5 | 0.08 | 18 | 10.4 | 0.20 | 9 |
| LNU643 | 70326.5 | 100.6 | 0.02 | 25 | 1193.8 | 0.28 | 19 | 10.2 | 0.12 | 8 |
| LNU642 | 70582.3 | — | — | — | 1150.0 | 0.15 | 14 | — | — | — |
| LNU642 | 70582.5 | — | — | — | 1143.8 | 0.15 | 14 | 10.0 | 0.07 | 5 |
| LNU620 | 70300.2 | — | — | — | 1325.0 | 0.05 | 32 | — | — | — |
| LNU620 | 70302.3 | 93.8 | 0.09 | 16 | 1137.5 | 0.18 | 13 | 10.2 | 0.01 | 7 |
| LNU620 | 70303.4 | 88.8 | 0.26 | 10 | 1162.5 | 0.13 | 16 | 9.9 | 0.18 | 5 |
| LNU606 | 70290.2 | — | — | — | 1181.2 | 0.11 | 17 | 9.8 | 0.15 | 3 |
| LNU604 | 70280.3 | 96.2 | 0.04 | 19 | 1193.8 | 0.09 | 19 | 10.1 | 0.16 | 7 |
| LNU604 | 70282.1 | 95.6 | 0.10 | 18 | 1156.2 | 0.19 | 15 | — | — | — |
| LNU604 | 70285.2 | — | — | — | — | — | — | 10.2 | 0.24 | 8 |
| LNU596 | 72118.2 | 101.2 | 0.01 | 25 | 1256.2 | 0.03 | 25 | 10.4 | L | 10 |
| LNU596 | 72119.1 | — | — | — | 1106.2 | 0.28 | 10 | — | — | — |
| LNU596 | 72120.2 | 88.8 | 0.26 | 10 | 1175.0 | 0.09 | 17 | — | — | — |
| LNU592 | 70268.1 | 93.8 | 0.12 | 16 | — | — | — | 10.3 | 0.28 | 9 |
| LNU592 | 70270.1 | 91.2 | 0.15 | 13 | — | — | — | — | — | — |
| LNU569 | 72151.2 | — | — | — | — | — | — | 9.9 | 0.06 | 5 |
| LNU569 | 72151.3 | — | — | — | 1151.8 | 0.14 | 15 | — | — | — |
| LNU569 | 72153.1 | — | — | — | 1141.1 | 0.16 | 13 | 10.2 | 0.01 | 7 |
| CONT. | — | 80.7 | — | — | 1005.4 | — | — | 9.5 | — | — |
| LNU744 | 71486.3 | 85.1 | 0.18 | 11 | — | — | — | 9.7 | 0.09 | 7 |
| LNU744 | 71487.3 | — | — | — | 900.0 | 0.21 | 7 | 9.8 | 0.28 | 8 |
| LNU738 | 71742.2 | 85.0 | 0.07 | 11 | — | — | — | — | — | — |
| LNU738 | 71743.1 | — | — | — | — | — | — | 9.5 | 0.26 | 5 |
| LNU727 | 71671.4 | — | — | — | — | — | — | 9.5 | 0.26 | 5 |
| LNU727 | 71674.1 | 96.2 | L | 26 | 918.8 | 0.19 | 9 | 10.2 | 0.03 | 13 |
| LNU720 | 71754.3 | 91.9 | 0.15 | 20 | 906.2 | 0.26 | 8 | — | — | — |
| LNU720 | 71755.2 | 81.9 | 0.24 | 7 | — | — | — | — | — | — |
| LNU720 | 71755.4 | — | — | — | 943.8 | 0.18 | 12 | — | — | — |
| LNU720 | 71756.1 | 91.4 | 0.08 | 20 | 928.6 | 0.13 | 10 | 9.9 | 0.16 | 10 |
| LNU707 | 71788.2 | 87.5 | 0.05 | 14 | — | — | — | 9.4 | 0.04 | 4 |
| LNU707 | 71788.5 | 85.0 | 0.07 | 11 | 975.0 | 0.02 | 16 | — | — | — |
| LNU707 | 71789.2 | 83.1 | 0.16 | 9 | 956.2 | 0.03 | 14 | — | — | — |
| LNU707 | 71789.3 | — | — | — | 887.5 | 0.29 | 6 | 9.6 | 0.13 | 6 |
| LNU692 | 71482.2 | — | — | — | 943.8 | 0.10 | 12 | — | — | — |
| LNU692 | 71482.5 | 85.6 | 0.13 | 12 | 931.2 | 0.23 | 11 | 9.4 | 0.04 | 4 |
| LNU692 | 71483.3 | 94.4 | 0.02 | 23 | 925.0 | 0.13 | 10 | 9.5 | 0.07 | 5 |
| LNU691 | 71436.2 | — | — | — | — | — | — | 9.8 | 0.19 | 9 |
| LNU691 | 71441.1 | — | — | — | — | — | — | 9.4 | 0.21 | 4 |
| LNU690 | 70694.2 | — | — | — | 946.4 | 0.04 | 13 | — | — | — |
| LNU690 | 70695.2 | 82.5 | 0.23 | 8 | — | — | — | — | — | — |
| LNU690 | 70695.3 | 81.2 | 0.27 | 6 | 1018.8 | L | 21 | — | — | — |
| LNU690 | 70696.4 | 83.1 | 0.24 | 9 | — | — | — | — | — | — |
| LNU684 | 71635.5 | — | — | — | 900.9 | 0.20 | 7 | 9.9 | L | 10 |
| LNU684 | 71637.1 | — | — | — | 958.3 | 0.23 | 14 | — | — | — |
| LNU684 | 71639.3 | 100.5 | L | 32 | 978.6 | 0.02 | 16 | 9.4 | 0.15 | 4 |
| LNU684 | 71639.5 | 90.0 | 0.01 | 18 | — | — | — | 9.8 | 0.06 | 9 |

TABLE 88-continued

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU660 | 71069.5 | — | — | — | 900.0 | 0.21 | 7 | 9.4 | 0.21 | 4 |
| LNU619 | 71358.4 | — | — | — | — | — | — | 9.4 | 0.15 | 4 |
| LNU619 | 71361.2 | — | — | — | 918.8 | 0.28 | 9 | — | — | — |
| LNU619 | 71363.1 | 86.9 | 0.18 | 14 | — | — | — | 9.6 | 0.13 | 6 |
| LNU598 | 71772.2 | — | — | — | 937.5 | 0.06 | 11 | — | — | — |
| LNU598 | 71777.3 | 85.0 | 0.07 | 11 | — | — | — | 9.4 | 0.07 | 4 |
| LNU594 | 71738.4 | — | — | — | — | — | — | 9.4 | 0.15 | 4 |
| LNU594 | 71739.3 | 87.5 | 0.03 | 14 | 918.8 | 0.19 | 9 | 9.9 | 0.01 | 9 |
| LNU584 | 71748.2 | 96.9 | 0.09 | 27 | 1068.8 | 0.25 | 27 | — | — | — |
| LNU584 | 71748.4 | 88.1 | 0.03 | 15 | 900.0 | 0.26 | 7 | 9.5 | 0.07 | 5 |
| LNU584 | 71751.1 | 86.9 | 0.26 | 14 | — | — | — | 9.8 | L | 8 |
| LNU576 | 71658.1 | — | — | — | 945.8 | 0.06 | 12 | — | — | — |
| LNU576 | 71659.3 | — | — | — | — | — | — | 9.2 | 0.21 | 2 |
| LNU576 | 71662.3 | 85.6 | 0.07 | 12 | — | — | — | — | — | — |
| LNU576 | 71662.5 | 88.1 | 0.03 | 15 | — | — | — | 10.1 | L | 12 |
| LNU561 | 71346.6 | — | — | — | 979.2 | 0.01 | 16 | — | — | — |
| LNU561 | 71346.8 | — | — | — | 925.0 | 0.08 | 10 | — | — | — |
| LNU555 | 71655.3 | 83.8 | 0.16 | 10 | 931.2 | 0.23 | 11 | 9.4 | 0.15 | 4 |
| LNU555 | 71655.4 | 86.9 | 0.09 | 14 | — | — | — | 9.9 | L | 9 |
| LNU555 | 71656.3 | 91.9 | 0.03 | 20 | 1000.0 | 0.23 | 19 | — | — | — |
| LNU555 | 71656.5 | 86.9 | 0.05 | 14 | 1006.3 | L | 20 | — | — | — |
| LNU523 | 71604.5 | 85.6 | 0.13 | 12 | — | — | — | — | — | — |
| LNU523 | 71605.3 | 87.5 | 0.12 | 14 | 893.8 | 0.28 | 6 | 9.4 | 0.04 | 4 |
| LNU523 | 71607.4 | — | — | — | 968.8 | 0.12 | 15 | — | — | — |
| CONT. | — | 76.4 | — | — | 841.1 | — | — | 9.0 | — | — |

Table 88. "CONT."—Control; "Ave."—Average; "% Incr." = % increment; "p-val."—p-value; L means that p-value is less than 0.01, p < 0.1 was considered as significant.

TABLE 89

Genes showing improved plant biomass production at limiting nitrogen growth conditions

| Gene Name | Event # | Plot Coverage [cm$^2$] | | | Rosette Area [cm$^2$] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU745 | 70911.4 | 63.4 | 0.11 | 37 | 7.9 | 0.11 | 37 | 4.8 | 0.17 | 21 |
| LNU745 | 70912.3 | 58.4 | L | 26 | 7.3 | L | 26 | 4.6 | 0.02 | 15 |
| LNU745 | 70914.2 | 55.1 | 0.27 | 19 | 6.9 | 0.27 | 19 | 4.4 | 0.03 | 11 |
| LNU723 | 71191.3 | 53.5 | 0.04 | 15 | 6.7 | 0.04 | 15 | 4.3 | 0.11 | 7 |
| LNU722 | 71188.2 | 53.5 | 0.03 | 15 | 6.7 | 0.03 | 15 | 4.3 | 0.11 | 8 |
| LNU722 | 71188.3 | 54.9 | 0.22 | 19 | 6.9 | 0.22 | 19 | 4.4 | 0.19 | 11 |
| LNU716 | 70760.4 | 55.8 | 0.05 | 21 | 7.0 | 0.05 | 21 | 4.5 | 0.05 | 14 |
| LNU716 | 70760.7 | 52.5 | 0.06 | 13 | 6.6 | 0.06 | 13 | 4.2 | 0.18 | 6 |
| LNU716 | 70760.8 | 52.2 | 0.20 | 13 | 6.5 | 0.20 | 13 | 4.3 | 0.27 | 7 |
| LNU683 | 71293.1 | 58.7 | 0.03 | 27 | 7.3 | 0.03 | 27 | 4.6 | 0.03 | 14 |
| LNU683 | 71294.2 | 59.7 | 0.01 | 29 | 7.5 | 0.01 | 29 | 4.6 | L | 16 |
| LNU683 | 71294.5 | 50.6 | 0.15 | 9 | 6.3 | 0.15 | 9 | 4.2 | 0.15 | 6 |
| LNU683 | 71298.2 | 54.9 | 0.02 | 19 | 6.9 | 0.02 | 19 | 4.4 | 0.04 | 10 |
| LNU682 | 71432.5 | 51.4 | 0.09 | 11 | 6.4 | 0.09 | 11 | 4.2 | 0.27 | 5 |
| LNU670 | 71083.1 | 52.2 | 0.12 | 13 | 6.5 | 0.12 | 13 | 4.2 | 0.14 | 6 |
| LNU670 | 71084.1 | 61.1 | 0.01 | 32 | 7.6 | 0.01 | 32 | 4.6 | 0.09 | 15 |
| LNU670 | 71084.4 | 50.8 | 0.18 | 10 | 6.4 | 0.18 | 10 | 4.3 | 0.12 | 8 |
| LNU656 | 71385.1 | 49.2 | 0.30 | 6 | 6.2 | 0.30 | 6 | — | — | — |
| LNU613 | 71621.3 | 51.6 | 0.13 | 11 | 6.5 | 0.13 | 11 | 4.2 | 0.19 | 6 |
| LNU613 | 71621.4 | 59.6 | L | 29 | 7.4 | L | 29 | 4.6 | 0.02 | 15 |
| LNU597 | 72369.1 | 49.8 | 0.22 | 8 | 6.2 | 0.22 | 8 | — | — | — |
| LNU597 | 72369.4 | — | — | — | — | — | — | 4.2 | 0.20 | 5 |
| LNU590 | 70262.2 | 56.2 | 0.18 | 21 | 7.0 | 0.18 | 21 | 4.5 | 0.13 | 12 |
| LNU590 | 70263.2 | 55.3 | 0.17 | 19 | 6.9 | 0.17 | 19 | 4.3 | 0.20 | 8 |
| LNU590 | 70263.3 | 64.3 | L | 39 | 8.0 | L | 39 | 4.7 | L | 17 |
| LNU577 | 72121.2 | 55.6 | 0.02 | 20 | 6.9 | 0.02 | 20 | 4.4 | 0.08 | 10 |
| LNU577 | 72126.6 | 53.5 | 0.16 | 15 | 6.7 | 0.16 | 15 | — | — | — |
| LNU556 | 72363.4 | 51.5 | 0.19 | 11 | 6.4 | 0.19 | 11 | — | — | — |
| LNU554 | 70478.1 | 60.2 | L | 30 | 7.5 | L | 30 | 4.6 | L | 16 |
| LNU554 | 70481.1 | — | — | — | — | — | — | 4.4 | 0.11 | 10 |
| LNU554 | 70481.2 | 50.0 | 0.22 | 8 | 6.3 | 0.22 | 8 | 4.2 | 0.27 | 5 |

TABLE 89-continued

Genes showing improved plant biomass production at limiting nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU554 | 70482.1 | 58.7 | L | 27 | 7.3 | L | 27 | 4.6 | L | 14 |
| LNU532 | 70556.4 | 53.9 | 0.15 | 16 | 6.7 | 0.15 | 16 | — | — | — |
| LNU532 | 70556.5 | — | — | — | — | — | — | 4.3 | 0.20 | 9 |
| CONT. | | 46.3 | — | — | 5.8 | — | — | 4.0 | — | — |
| LNU675 | 70401.2 | 72.6 | L | 31 | 9.1 | L | 31 | 5.0 | L | 16 |
| LNU675 | 70402.1 | 61.2 | 0.25 | 11 | 7.6 | 0.25 | 11 | — | — | — |
| LNU675 | 70403.1 | 65.1 | 0.08 | 18 | 8.1 | 0.08 | 18 | 4.7 | 0.07 | 9 |
| LNU675 | 70405.1 | 63.3 | 0.13 | 14 | 7.9 | 0.13 | 14 | 4.7 | 0.11 | 9 |
| LNU675 | 70405.3 | 75.2 | L | 36 | 9.4 | L | 36 | 5.0 | L | 16 |
| LNU656 | 71384.2 | — | — | — | — | — | — | 4.9 | 0.26 | 13 |
| LNU656 | 71384.3 | — | — | — | — | — | — | 4.9 | 0.20 | 14 |
| LNU656 | 71385.1 | 81.5 | L | 47 | 10.2 | L | 47 | 5.3 | L | 21 |
| LNU641 | 70628.2 | 66.0 | 0.09 | 19 | 8.2 | 0.09 | 19 | 4.7 | 0.19 | 8 |
| LNU641 | 70628.3 | 71.8 | 0.28 | 30 | 9.0 | 0.28 | 30 | 5.0 | 0.21 | 15 |
| LNU641 | 70632.3 | 63.6 | 0.25 | 15 | 8.0 | 0.25 | 15 | 4.7 | 0.26 | 7 |
| LNU625 | 70965.4 | 69.4 | 0.25 | 25 | 8.7 | 0.25 | 25 | 4.9 | 0.27 | 12 |
| LNU612 | 71335.1 | 69.5 | 0.04 | 26 | 8.7 | 0.04 | 26 | 4.9 | 0.05 | 13 |
| LNU600 | 70484.5 | 67.8 | 0.22 | 23 | 8.5 | 0.22 | 23 | 4.7 | 0.13 | 8 |
| LNU600 | 70486.2 | — | — | — | — | — | — | 4.6 | 0.29 | 6 |
| LNU600 | 70488.1 | 77.4 | L | 40 | 9.7 | L | 40 | 5.3 | L | 22 |
| LNU593 | 71844.3 | 68.5 | 0.25 | 24 | 8.6 | 0.25 | 24 | 4.8 | 0.14 | 11 |
| LNU593 | 71848.5 | 75.2 | L | 36 | 9.4 | L | 36 | 5.1 | L | 16 |
| LNU593 | 71849.1 | 72.5 | L | 31 | 9.1 | L | 31 | 4.9 | 0.10 | 13 |
| LNU587 | 70378.1 | 73.3 | L | 32 | 9.2 | L | 32 | 5.0 | 0.04 | 14 |
| LNU587 | 70379.3 | 63.8 | 0.16 | 15 | 8.0 | 0.16 | 15 | 4.7 | 0.13 | 8 |
| LNU587 | 70380.5 | 65.8 | 0.15 | 19 | 8.2 | 0.15 | 19 | 4.7 | 0.12 | 8 |
| LNU582 | 70256.1 | 70.9 | 0.02 | 28 | 8.9 | 0.02 | 28 | 4.9 | 0.02 | 13 |
| LNU582 | 70258.2 | 66.1 | 0.26 | 20 | 8.3 | 0.26 | 20 | 4.8 | 0.15 | 10 |
| LNU572 | 71406.2 | 64.7 | 0.16 | 17 | 8.1 | 0.16 | 17 | 4.7 | 0.21 | 7 |
| LNU566 | 71834.2 | 61.8 | 0.22 | 12 | 7.7 | 0.22 | 12 | 4.6 | 0.27 | 6 |
| LNU566 | 71834.3 | 64.6 | 0.16 | 17 | 8.1 | 0.16 | 17 | 4.7 | 0.12 | 7 |
| LNU566 | 71835.1 | 63.0 | 0.14 | 14 | 7.9 | 0.14 | 14 | 4.6 | 0.18 | 6 |
| LNU566 | 71837.1 | 63.9 | 0.12 | 16 | 8.0 | 0.12 | 16 | 4.7 | 0.10 | 9 |
| LNU560 | 70240.5 | 64.5 | 0.27 | 17 | 8.1 | 0.27 | 17 | — | — | — |
| LNU560 | 70243.3 | 71.1 | 0.01 | 29 | 8.9 | 0.01 | 29 | 4.8 | 0.05 | 11 |
| LNU530 | 70203.2 | 62.2 | 0.19 | 12 | 7.8 | 0.19 | 12 | 4.6 | 0.24 | 6 |
| LNU530 | 70203.3 | 71.5 | 0.02 | 29 | 8.9 | 0.02 | 29 | 4.9 | 0.05 | 13 |
| LNU530 | 70207.4 | 79.5 | L | 44 | 9.9 | L | 44 | 5.3 | L | 21 |
| CONT. | | 55.3 | — | — | 6.9 | — | — | 4.3 | — | — |
| LNU738 | 71742.4 | 46.4 | 0.15 | 7 | 5.8 | 0.15 | 7 | 4.2 | 0.16 | 4 |
| LNU738 | 71743.2 | 50.2 | 0.01 | 16 | 6.3 | 0.01 | 16 | 4.3 | 0.02 | 7 |
| LNU720 | 71755.4 | 47.8 | 0.24 | 11 | 6.0 | 0.24 | 11 | — | — | — |
| LNU720 | 71756.2 | 57.5 | 0.01 | 33 | 7.2 | 0.01 | 33 | 4.6 | L | 15 |
| LNU661 | 72705.3 | 51.7 | 0.08 | 20 | 6.5 | 0.08 | 20 | 4.3 | 0.08 | 8 |
| LNU661 | 72705.6 | 53.0 | 0.02 | 23 | 6.6 | 0.02 | 23 | 4.4 | 0.04 | 10 |
| LNU619 | 71363.1 | 47.5 | 0.07 | 10 | 5.9 | 0.07 | 10 | 4.3 | 0.01 | 7 |
| LNU618 | 72133.2 | 54.2 | 0.18 | 25 | 6.8 | 0.18 | 25 | 4.5 | 0.26 | 13 |
| LNU618 | 72135.3 | 47.4 | 0.07 | 10 | 5.9 | 0.07 | 10 | 4.2 | 0.24 | 4 |
| LNU618 | 72138.1 | 49.0 | 0.12 | 13 | 6.1 | 0.12 | 13 | 4.2 | 0.03 | 5 |
| LNU598 | 71775.2 | 52.0 | L | 20 | 6.5 | L | 20 | 4.5 | 0.04 | 11 |
| LNU598 | 71777.3 | 54.5 | L | 26 | 6.8 | L | 26 | 4.5 | L | 11 |
| LNU594 | 71739.1 | 53.2 | L | 23 | 6.6 | L | 23 | 4.4 | L | 9 |
| LNU584 | 71748.4 | 47.2 | 0.07 | 9 | 5.9 | 0.07 | 9 | 4.1 | 0.24 | 3 |
| LNU584 | 71751.1 | 54.1 | 0.02 | 25 | 6.8 | 0.02 | 25 | 4.4 | 0.20 | 11 |
| LNU584 | 71751.4 | 48.6 | 0.25 | 12 | 6.1 | 0.25 | 12 | 4.2 | 0.11 | 4 |
| LNU576 | 71658.1 | — | — | — | — | — | — | 4.4 | 0.29 | 10 |
| LNU576 | 71659.3 | 47.5 | 0.24 | 10 | 5.9 | 0.24 | 10 | — | — | — |
| LNU576 | 71662.3 | 53.0 | 0.11 | 22 | 6.6 | 0.11 | 22 | 4.3 | 0.24 | 8 |
| LNU576 | 71662.5 | 53.1 | 0.13 | 23 | 6.6 | 0.13 | 23 | 4.5 | 0.02 | 11 |
| LNU573 | 72592.1 | 49.3 | 0.17 | 14 | 6.2 | 0.17 | 14 | 4.3 | 0.03 | 8 |
| LNU555 | 71655.2 | 51.1 | L | 18 | 6.4 | L | 18 | 4.2 | 0.02 | 6 |
| LNU555 | 71655.4 | 55.4 | 0.30 | 28 | 6.9 | 0.30 | 28 | 4.6 | 0.18 | 14 |
| LNU555 | 71656.5 | 53.7 | L | 24 | 6.7 | L | 24 | 4.6 | L | 14 |
| LNU555 | 71656.6 | 49.8 | 0.04 | 15 | 6.2 | 0.04 | 15 | 4.3 | L | 7 |
| LNU547 | 70970.2 | 50.6 | 0.18 | 17 | 6.3 | 0.18 | 17 | 4.3 | 0.16 | 7 |
| LNU547 | 70971.1 | 48.4 | 0.08 | 12 | 6.1 | 0.08 | 12 | 4.3 | 0.02 | 7 |
| LNU547 | 70971.4 | 45.7 | 0.26 | 6 | 5.7 | 0.26 | 6 | 4.2 | 0.15 | 5 |
| LNU547 | 70972.1 | 47.4 | 0.06 | 10 | 5.9 | 0.06 | 10 | — | — | — |
| LNU540 | 70984.4 | 51.1 | 0.05 | 18 | 6.4 | 0.05 | 18 | 4.3 | 0.06 | 6 |
| LNU540 | 70985.2 | 48.0 | 0.04 | 11 | 6.0 | 0.04 | 11 | 4.3 | L | 7 |
| LNU527 | 70977.2 | 53.7 | 0.16 | 24 | 6.7 | 0.16 | 24 | 4.5 | 0.01 | 12 |

TABLE 89-continued

Genes showing improved plant biomass production at limiting nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU527 | 70978.4 | 47.8 | 0.24 | 11 | 6.0 | 0.24 | 11 | — | — | — |
| LNU527 | 70980.3 | 47.8 | 0.19 | 10 | 6.0 | 0.19 | 10 | 4.2 | 0.06 | 5 |
| LNU527 | 70980.5 | 55.8 | L | 29 | 7.0 | L | 29 | 4.5 | L | 12 |
| LNU523 | 71604.5 | 48.1 | 0.21 | 11 | 6.0 | 0.21 | 11 | 4.3 | 0.12 | 7 |
| LNU523 | 71605.3 | 51.9 | 0.27 | 20 | 6.5 | 0.27 | 20 | 4.4 | 0.27 | 9 |
| LNU523 | 71605.4 | 59.5 | 0.05 | 38 | 7.4 | 0.05 | 38 | 4.6 | L | 15 |
| LNU523 | 71605.6 | 51.3 | 0.21 | 19 | 6.4 | 0.21 | 19 | — | — | — |
| CONT. | — | 43.2 | — | — | 5.4 | — | — | 4.0 | — | — |
| LNU736 | 71235.1 | — | — | — | — | — | — | 5.6 | 0.26 | 13 |
| LNU736 | 71235.4 | 76.1 | 0.27 | 10 | 9.5 | 0.27 | 10 | 5.1 | 0.21 | 4 |
| LNU701 | 71133.2 | 76.8 | 0.22 | 11 | 9.6 | 0.22 | 11 | 5.4 | 0.24 | 9 |
| LNU701 | 71133.5 | 82.5 | 0.12 | 19 | 10.3 | 0.12 | 19 | 5.3 | 0.22 | 7 |
| LNU694 | 71129.2 | 78.4 | 0.12 | 13 | 9.8 | 0.12 | 13 | — | — | — |
| LNU677 | 71106.1 | 85.2 | 0.07 | 23 | 10.7 | 0.07 | 23 | 5.5 | 0.26 | 12 |
| LNU666 | 71388.2 | 97.0 | 0.08 | 40 | 12.1 | 0.08 | 40 | 5.9 | 0.07 | 19 |
| LNU666 | 71390.2 | 86.5 | L | 25 | 10.8 | L | 25 | 5.7 | L | 16 |
| LNU663 | 71071.3 | 83.1 | 0.12 | 20 | 10.4 | 0.12 | 20 | 5.5 | 0.10 | 11 |
| LNU663 | 71071.6 | 84.2 | 0.09 | 22 | 10.5 | 0.09 | 22 | 5.4 | 0.17 | 9 |
| LNU617 | 70293.2 | 77.7 | 0.02 | 12 | 9.7 | 0.02 | 12 | 5.1 | 0.05 | 4 |
| LNU617 | 70295.2 | 84.0 | 0.27 | 21 | 10.5 | 0.27 | 21 | 5.5 | 0.28 | 11 |
| LNU617 | 70295.5 | 82.6 | 0.28 | 19 | 10.3 | 0.28 | 19 | — | — | — |
| LNU596 | 72118.2 | 86.7 | L | 25 | 10.8 | L | 25 | 5.5 | L | 12 |
| LNU575 | 70253.3 | 83.7 | L | 21 | 10.5 | L | 21 | 5.5 | 0.13 | 11 |
| LNU575 | 70253.4 | 81.4 | 0.09 | 18 | 10.2 | 0.09 | 18 | 5.2 | 0.20 | 6 |
| LNU575 | 70254.1 | 94.8 | L | 37 | 11.9 | L | 37 | 5.5 | 0.06 | 12 |
| LNU570 | 70579.4 | 77.1 | 0.03 | 11 | 9.6 | 0.03 | 11 | 5.2 | 0.03 | 5 |
| LNU568 | 70846.1 | 72.8 | 0.29 | 5 | 9.1 | 0.29 | 5 | 5.2 | 0.06 | 6 |
| LNU568 | 70846.3 | 84.3 | 0.28 | 22 | 10.5 | 0.28 | 22 | 5.5 | 0.29 | 12 |
| LNU562 | 70246.3 | — | — | — | — | — | — | 5.1 | 0.14 | 3 |
| LNU557 | 71400.4 | 74.9 | 0.09 | 8 | 9.4 | 0.09 | 8 | 5.3 | 0.02 | 6 |
| LNU557 | 71402.5 | — | — | — | — | — | — | 5.3 | 0.29 | 7 |
| LNU548 | 70569.1 | 81.8 | L | 18 | 10.2 | L | 18 | 5.5 | L | 12 |
| CONT. | — | 69.3 | — | — | 8.7 | — | — | 4.9 | — | — |
| LNU647 | 70587.2 | 52.3 | 0.26 | 10 | 6.5 | 0.26 | 10 | 4.4 | 0.16 | 5 |
| LNU647 | 70589.8 | — | — | — | — | — | — | 4.5 | 0.27 | 7 |
| LNU644 | 70329.2 | 51.1 | 0.20 | 7 | 6.4 | 0.20 | 7 | — | — | — |
| LNU643 | 70322.1 | 51.7 | 0.16 | 8 | 6.5 | 0.16 | 8 | 4.4 | 0.23 | 4 |
| LNU643 | 70323.1 | — | — | — | — | — | — | 4.4 | 0.22 | 4 |
| LNU643 | 70325.2 | 51.7 | 0.24 | 8 | 6.5 | 0.24 | 8 | — | — | — |
| LNU643 | 70326.5 | 68.1 | L | 43 | 8.5 | L | 43 | 5.1 | L | 21 |
| LNU642 | 70582.3 | 51.4 | 0.16 | 7 | 6.4 | 0.16 | 7 | — | — | — |
| LNU606 | 70290.3 | 54.7 | 0.02 | 14 | 6.8 | 0.02 | 14 | 4.5 | 0.10 | 6 |
| LNU606 | 70291.2 | 59.3 | 0.25 | 24 | 7.4 | 0.25 | 24 | 4.7 | 0.27 | 11 |
| LNU592 | 70268.1 | 52.5 | 0.06 | 10 | 6.6 | 0.06 | 10 | 4.4 | 0.24 | 5 |
| LNU592 | 70270.1 | 61.5 | 0.02 | 29 | 7.7 | 0.02 | 29 | 4.7 | L | 11 |
| LNU590 | 70263.3 | 55.0 | 0.05 | 15 | 6.9 | 0.05 | 15 | — | — | — |
| LNU590 | 70267.5 | 58.3 | 0.18 | 22 | 7.3 | 0.18 | 22 | 4.8 | L | 14 |
| LNU570 | 70578.4 | — | — | — | — | — | — | 4.4 | 0.21 | 4 |
| LNU554 | 70478.1 | 57.8 | 0.16 | 21 | 7.2 | 0.16 | 21 | 4.6 | 0.12 | 9 |
| LNU554 | 70482.4 | 54.0 | 0.13 | 13 | 6.7 | 0.13 | 13 | 4.6 | 0.10 | 8 |
| CONT. | — | 47.8 | — | — | 6.0 | — | — | 4.2 | — | — |
| LNU745 | 70911.1 | 26.4 | 0.22 | 7 | 3.3 | 0.22 | 7 | — | — | — |
| LNU724 | 71510.1 | 27.9 | 0.15 | 13 | 3.5 | 0.15 | 13 | 3.0 | 0.22 | 4 |
| LNU724 | 71512.3 | 30.9 | 0.25 | 26 | 3.9 | 0.25 | 26 | 3.3 | 0.05 | 12 |
| LNU724 | 71513.4 | 28.5 | 0.29 | 16 | 3.6 | 0.29 | 16 | 3.1 | 0.07 | 8 |
| LNU723 | 71191.3 | 29.1 | L | 18 | 3.6 | L | 18 | 3.1 | 0.18 | 5 |
| LNU723 | 71192.2 | 30.3 | L | 23 | 3.8 | L | 23 | 3.1 | 0.04 | 7 |
| LNU707 | 71788.2 | 27.0 | 0.06 | 10 | 3.4 | 0.06 | 10 | 3.0 | 0.15 | 4 |
| LNU707 | 71789.2 | 31.4 | 0.22 | 28 | 3.9 | 0.22 | 28 | 3.3 | 0.26 | 12 |
| LNU684 | 71635.1 | 28.9 | 0.18 | 17 | 3.6 | 0.18 | 17 | 3.1 | 0.27 | 6 |
| LNU684 | 71637.1 | 28.5 | 0.18 | 16 | 3.6 | 0.18 | 16 | 3.2 | 0.09 | 8 |
| LNU684 | 71639.3 | 29.1 | 0.01 | 18 | 3.6 | 0.01 | 18 | 3.1 | 0.05 | 6 |
| LNU684 | 71639.5 | 28.6 | 0.02 | 16 | 3.6 | 0.02 | 16 | 3.1 | 0.09 | 5 |
| LNU660 | 71065.2 | — | — | — | — | — | — | 3.1 | 0.22 | 7 |
| LNU660 | 71068.2 | 28.2 | 0.12 | 15 | 3.5 | 0.12 | 15 | 3.1 | 0.05 | 7 |
| LNU655 | 72292.1 | 30.4 | 0.04 | 24 | 3.8 | 0.04 | 24 | 3.2 | 0.06 | 10 |
| LNU625 | 70966.3 | 28.9 | L | 17 | 3.6 | L | 17 | 3.1 | 0.07 | 8 |
| LNU612 | 71334.3 | 30.8 | 0.06 | 25 | 3.8 | 0.06 | 25 | 3.3 | 0.13 | 13 |
| LNU612 | 71334.4 | 26.0 | 0.24 | 6 | 3.2 | 0.24 | 6 | 3.0 | 0.20 | 4 |
| LNU612 | 71335.1 | 27.7 | 0.09 | 13 | 3.5 | 0.09 | 13 | 3.1 | 0.02 | 8 |
| LNU612 | 71335.4 | 32.9 | 0.15 | 34 | 4.1 | 0.15 | 34 | 3.4 | 0.05 | 16 |

TABLE 89-continued

Genes showing improved plant biomass production at limiting nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU612 | 71336.4 | 27.0 | 0.25 | 10 | 3.4 | 0.25 | 10 | — | — | — |
| LNU605 | 71352.1 | 28.6 | 0.23 | 16 | 3.6 | 0.23 | 16 | — | — | — |
| LNU605 | 71352.2 | 34.0 | 0.11 | 38 | 4.2 | 0.11 | 38 | 3.4 | 0.14 | 16 |
| LNU605 | 71356.2 | 30.4 | 0.02 | 24 | 3.8 | 0.02 | 24 | 3.2 | 0.05 | 10 |
| LNU597 | 72367.3 | 27.6 | 0.25 | 12 | 3.5 | 0.25 | 12 | — | — | — |
| LNU597 | 72369.4 | 30.0 | 0.07 | 22 | 3.7 | 0.07 | 22 | 3.2 | 0.01 | 9 |
| LNU593 | 71846.1 | 28.0 | 0.07 | 14 | 3.5 | 0.07 | 14 | 3.1 | 0.20 | 6 |
| LNU593 | 71848.5 | 30.0 | 0.08 | 22 | 3.8 | 0.08 | 22 | 3.2 | 0.03 | 11 |
| LNU577 | 72121.1 | 29.3 | 0.30 | 19 | 3.7 | 0.30 | 19 | — | — | — |
| LNU577 | 72126.6 | 27.3 | 0.10 | 11 | 3.4 | 0.10 | 11 | 3.0 | 0.19 | 4 |
| LNU572 | 71406.2 | 28.0 | 0.13 | 14 | 3.5 | 0.13 | 14 | 3.2 | 0.04 | 9 |
| LNU572 | 71408.2 | — | — | — | — | — | — | 3.1 | 0.12 | 6 |
| LNU572 | 71408.6 | 29.2 | L | 19 | 3.6 | L | 19 | 3.2 | 0.01 | 10 |
| LNU571 | 71838.4 | 27.8 | 0.02 | 13 | 3.5 | 0.02 | 13 | 3.2 | 0.03 | 9 |
| LNU571 | 71839.2 | — | — | — | — | — | — | 3.1 | 0.08 | 6 |
| LNU571 | 71842.1 | 27.8 | 0.03 | 13 | 3.5 | 0.03 | 13 | 3.0 | 0.15 | 4 |
| LNU571 | 71842.3 | 28.2 | 0.17 | 15 | 3.5 | 0.17 | 15 | 3.2 | L | 9 |
| LNU566 | 71835.1 | 26.2 | 0.20 | 6 | 3.3 | 0.20 | 6 | — | — | — |
| LNU566 | 71837.1 | 28.7 | 0.18 | 17 | 3.6 | 0.18 | 17 | 3.1 | 0.21 | 8 |
| LNU556 | 72364.2 | 29.7 | L | 21 | 3.7 | L | 21 | 3.3 | 0.01 | 12 |
| LNU531 | 70209.4 | 28.8 | 0.09 | 17 | 3.6 | 0.09 | 17 | 3.2 | 0.04 | 9 |
| LNU531 | 70210.1 | 30.1 | 0.13 | 22 | 3.8 | 0.13 | 22 | 3.2 | 0.02 | 10 |
| LNU531 | 70211.1 | 30.6 | L | 24 | 3.8 | L | 24 | 3.2 | 0.03 | 8 |
| LNU531 | 70211.3 | 32.6 | 0.02 | 33 | 4.1 | 0.02 | 33 | 3.3 | 0.12 | 14 |
| CONT. | — | 24.6 | — | — | 3.1 | — | — | 2.9 | — | — |
| LNU747 | 70616.4 | 52.9 | 0.09 | 10 | 6.6 | 0.09 | 10 | 4.6 | 0.01 | 9 |
| LNU697 | 70702.2 | 61.1 | L | 28 | 7.6 | L | 28 | 4.8 | L | 14 |
| LNU697 | 70705.2 | 54.7 | 0.11 | 14 | 6.8 | 0.11 | 14 | 4.6 | 0.07 | 9 |
| LNU673 | 70395.5 | 58.5 | 0.20 | 22 | 7.3 | 0.20 | 22 | 4.7 | 0.12 | 12 |
| LNU669 | 70388.2 | 57.3 | L | 20 | 7.2 | L | 20 | 4.6 | L | 9 |
| LNU669 | 70389.2 | 53.1 | 0.03 | 11 | 6.6 | 0.03 | 11 | 4.3 | 0.11 | 2 |
| LNU653 | 70659.4 | 58.5 | 0.22 | 22 | 7.3 | 0.22 | 22 | 4.7 | 0.08 | 13 |
| LNU651 | 70666.1 | 50.5 | 0.18 | 5 | 6.3 | 0.18 | 5 | — | — | — |
| LNU650 | 70877.2 | 53.0 | 0.14 | 11 | 6.6 | 0.14 | 11 | 4.4 | 0.19 | 4 |
| LNU650 | 70877.4 | 51.9 | 0.07 | 8 | 6.5 | 0.07 | 8 | 4.4 | L | 5 |
| LNU630 | 70862.4 | — | — | — | 6.5 | 0.13 | 8 | 4.4 | 0.25 | 6 |
| LNU630 | 70864.2 | 52.4 | 0.06 | 9 | 6.6 | 0.06 | 9 | 4.3 | 0.10 | 4 |
| LNU623 | 71007.4 | 54.5 | 0.19 | 14 | 6.8 | 0.19 | 14 | 4.5 | L | 7 |
| LNU623 | 71010.3 | 59.5 | L | 24 | 7.4 | L | 24 | 4.7 | L | 13 |
| LNU614 | 70726.6 | — | — | — | — | — | — | 4.3 | 0.24 | 3 |
| LNU610 | 70781.1 | 59.2 | 0.09 | 24 | 7.4 | 0.09 | 24 | 4.5 | 0.17 | 8 |
| LNU563 | 70987.3 | 61.5 | L | 28 | 7.7 | L | 28 | 4.9 | 0.01 | 16 |
| LNU563 | 70987.5 | 51.9 | 0.12 | 8 | 6.5 | 0.12 | 8 | 4.3 | 0.04 | 3 |
| LNU563 | 70990.1 | — | — | — | 6.4 | 0.13 | 6 | 4.4 | 0.18 | 6 |
| LNU547 | 70970.2 | 52.0 | 0.16 | 9 | 6.5 | 0.16 | 9 | 4.4 | 0.13 | 5 |
| LNU547 | 70971.1 | — | — | — | — | — | — | 4.3 | 0.12 | 3 |
| LNU547 | 70972.1 | 58.0 | 0.20 | 21 | 7.3 | 0.20 | 21 | — | — | — |
| LNU540 | 70984.4 | 65.2 | 0.10 | 36 | 8.1 | 0.10 | 36 | 4.9 | 0.11 | 16 |
| LNU540 | 70985.2 | 56.0 | 0.06 | 17 | 7.0 | 0.06 | 17 | 4.6 | L | 10 |
| LNU540 | 70986.1 | 54.4 | L | 13 | 6.8 | L | 13 | 4.6 | 0.02 | 10 |
| LNU528 | 70566.5 | 58.5 | 0.04 | 22 | 7.3 | 0.04 | 22 | 4.7 | L | 12 |
| LNU527 | 70978.4 | 53.6 | 0.02 | 12 | 6.7 | 0.02 | 12 | 4.5 | L | 6 |
| LNU527 | 70980.5 | 52.0 | 0.06 | 9 | 6.5 | 0.06 | 9 | 4.5 | L | 7 |
| LNU522 | 70804.4 | 55.5 | L | 16 | 6.9 | L | 16 | 4.6 | L | 9 |
| CONT. | — | 47.9 | — | — | 6.0 | — | — | 4.2 | — | — |
| LNU722 | 71185.4 | — | — | — | — | — | — | 4.6 | 0.20 | 6 |
| LNU716 | 70760.4 | 57.9 | 0.04 | 16 | 7.2 | 0.11 | 13 | 4.6 | 0.16 | 6 |
| LNU716 | 70760.8 | 58.5 | 0.03 | 17 | 7.3 | 0.08 | 15 | 4.7 | 0.08 | 8 |
| LNU716 | 70762.2 | 59.4 | 0.02 | 19 | 7.4 | 0.06 | 16 | 4.7 | 0.06 | 9 |
| LNU683 | 71294.2 | 60.2 | 0.08 | 21 | 7.5 | 0.11 | 18 | 4.6 | 0.17 | 7 |
| LNU683 | 71294.5 | 56.6 | 0.27 | 13 | — | — | — | 4.6 | 0.20 | 7 |
| LNU670 | 71088.7 | 56.5 | 0.22 | 13 | — | — | — | 4.6 | 0.25 | 6 |
| LNU668 | 71412.1 | 55.0 | 0.15 | 10 | — | — | — | — | — | — |
| LNU668 | 71415.1 | 63.8 | 0.03 | 28 | 8.0 | 0.04 | 25 | 4.8 | 0.11 | 11 |
| LNU668 | 71415.3 | 55.3 | 0.12 | 11 | 6.9 | 0.27 | 8 | — | — | — |
| LNU668 | 71415.5 | 55.2 | 0.28 | 11 | — | — | — | — | — | — |
| LNU658 | 70683.2 | 57.7 | 0.05 | 16 | 7.2 | 0.12 | 13 | 4.7 | 0.24 | 8 |
| LNU658 | 70687.2 | 54.2 | 0.22 | 9 | — | — | — | 4.6 | 0.14 | 7 |
| LNU658 | 70687.3 | 60.3 | 0.01 | 21 | 7.5 | 0.04 | 18 | 4.8 | 0.09 | 12 |
| LNU647 | 70587.2 | — | — | — | — | — | — | 4.6 | 0.12 | 7 |
| LNU647 | 70589.6 | 56.5 | 0.22 | 13 | — | — | — | 4.7 | 0.14 | 9 |

TABLE 89-continued

Genes showing improved plant biomass production at limiting nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU647 | 70589.8 | 62.6 | L | 25 | 7.8 | 0.02 | 23 | 4.9 | 0.07 | 13 |
| LNU646 | 72145.3 | 53.9 | 0.26 | 8 | — | — | — | — | — | — |
| LNU646 | 72148.5 | 61.3 | 0.26 | 23 | 7.7 | 0.28 | 20 | 5.0 | 0.16 | 15 |
| LNU646 | 72150.4 | 56.8 | 0.06 | 14 | 7.1 | 0.15 | 11 | 4.7 | 0.08 | 9 |
| LNU644 | 70331.1 | — | — | — | — | — | — | 4.5 | 0.27 | 5 |
| LNU644 | 70332.2 | 59.4 | 0.25 | 19 | 7.4 | 0.29 | 16 | — | — | — |
| LNU643 | 70322.1 | 54.1 | 0.22 | 8 | — | — | — | — | — | — |
| LNU643 | 70323.1 | 58.3 | 0.07 | 17 | 7.8 | 0.03 | 22 | 4.9 | 0.03 | 15 |
| LNU643 | 70325.2 | 60.4 | 0.24 | 21 | 7.5 | 0.27 | 18 | 4.8 | 0.15 | 11 |
| LNU643 | 70325.6 | 67.2 | L | 35 | 8.4 | 0.01 | 32 | 5.0 | L | 16 |
| LNU643 | 70326.5 | 65.4 | 0.16 | 31 | 8.2 | 0.17 | 28 | 4.9 | 0.25 | 14 |
| LNU642 | 70582.3 | 60.0 | 0.05 | 20 | 7.5 | 0.08 | 18 | 4.7 | 0.09 | 9 |
| LNU642 | 70582.5 | 61.7 | 0.16 | 24 | 7.7 | 0.18 | 21 | 4.8 | 0.09 | 11 |
| LNU642 | 70583.2 | 58.7 | 0.03 | 18 | 7.3 | 0.07 | 15 | 4.7 | 0.08 | 8 |
| LNU620 | 70299.2 | 56.5 | 0.18 | 13 | 7.1 | 0.28 | 11 | 4.6 | 0.11 | 7 |
| LNU620 | 70300.2 | 65.7 | 0.01 | 32 | 8.2 | 0.02 | 29 | 5.0 | 0.07 | 15 |
| LNU620 | 70302.1 | — | — | — | — | — | — | 4.6 | 0.24 | 6 |
| LNU620 | 70302.3 | 62.7 | L | 26 | 7.8 | 0.02 | 23 | 4.8 | 0.02 | 12 |
| LNU620 | 70303.4 | 61.3 | 0.10 | 23 | 7.7 | 0.12 | 20 | 4.8 | 0.04 | 10 |
| LNU606 | 70289.1 | 59.8 | 0.14 | 20 | 7.5 | 0.17 | 17 | 4.7 | 0.23 | 10 |
| LNU606 | 70290.2 | 56.6 | 0.08 | 13 | 7.1 | 0.18 | 11 | 4.5 | 0.22 | 5 |
| LNU606 | 70290.3 | 55.6 | 0.15 | 11 | 6.9 | 0.29 | 9 | — | — | — |
| LNU604 | 70280.3 | 60.8 | 0.01 | 22 | 7.6 | 0.03 | 19 | 4.7 | 0.08 | 8 |
| LNU604 | 70282.1 | 54.1 | 0.21 | 8 | — | — | — | — | — | — |
| LNU604 | 70284.1 | 57.1 | 0.07 | 14 | 7.1 | 0.16 | 12 | 4.5 | 0.24 | 5 |
| LNU604 | 70285.2 | 56.0 | 0.29 | 12 | — | — | — | — | — | — |
| LNU596 | 72118.2 | 64.0 | 0.04 | 28 | 8.0 | 0.04 | 25 | 4.8 | 0.10 | 11 |
| LNU596 | 72120.2 | 55.3 | 0.13 | 11 | 6.9 | 0.29 | 8 | 4.5 | 0.28 | 5 |
| LNU596 | 72120.4 | 59.9 | 0.06 | 20 | 7.5 | 0.10 | 17 | 4.7 | 0.07 | 10 |
| LNU592 | 70268.1 | 65.0 | L | 30 | 8.1 | L | 27 | 4.8 | 0.03 | 12 |
| LNU592 | 70270.1 | 62.2 | 0.09 | 25 | 7.8 | 0.11 | 22 | 4.9 | 0.01 | 14 |
| LNU569 | 72151.2 | 59.6 | 0.14 | 19 | 7.5 | 0.17 | 17 | 4.6 | 0.22 | 6 |
| LNU569 | 72151.3 | 54.6 | 0.19 | 9 | — | — | — | — | — | — |
| LNU569 | 72153.1 | 56.6 | 0.07 | 13 | 7.1 | 0.17 | 11 | 4.6 | 0.13 | 7 |
| CONT. | — | 49.9 | — | — | 6.4 | — | — | 4.3 | — | — |
| LNU744 | 71485.1 | 46.3 | 0.01 | 21 | 5.8 | 0.01 | 21 | 4.1 | 0.21 | 9 |
| LNU744 | 71485.5 | — | — | — | — | — | — | 4.0 | 0.24 | 6 |
| LNU744 | 71486.3 | 50.7 | 0.09 | 32 | 6.3 | 0.09 | 32 | 4.2 | 0.06 | 12 |
| LNU744 | 71487.3 | 52.8 | 0.17 | 38 | 6.6 | 0.17 | 38 | 4.4 | 0.04 | 17 |
| LNU738 | 71742.2 | 54.6 | L | 43 | 6.8 | L | 43 | 4.5 | 0.01 | 21 |
| LNU738 | 71743.2 | 50.8 | 0.22 | 33 | 6.3 | 0.22 | 33 | 4.4 | 0.17 | 18 |
| LNU727 | 71671.4 | 58.9 | 0.05 | 54 | 7.4 | 0.05 | 54 | 4.6 | L | 23 |
| LNU727 | 71674.1 | 62.5 | 0.02 | 63 | 7.8 | 0.02 | 63 | 4.7 | L | 26 |
| LNU720 | 71754.3 | 54.3 | L | 42 | 6.8 | L | 42 | 4.5 | L | 20 |
| LNU720 | 71755.2 | 45.6 | 0.01 | 19 | 5.7 | 0.01 | 19 | 4.0 | 0.10 | 7 |
| LNU720 | 71756.1 | 51.1 | 0.05 | 33 | 6.4 | 0.05 | 33 | 4.3 | 0.13 | 14 |
| LNU707 | 71788.2 | 49.7 | L | 30 | 6.2 | L | 30 | 4.4 | L | 18 |
| LNU707 | 71789.2 | 41.0 | 0.29 | 7 | 5.1 | 0.29 | 7 | — | — | — |
| LNU707 | 71789.3 | 52.7 | 0.01 | 38 | 6.6 | 0.01 | 38 | 4.4 | L | 18 |
| LNU692 | 71482.2 | 47.2 | 0.16 | 23 | 5.9 | 0.16 | 23 | 4.2 | 0.03 | 12 |
| LNU692 | 71482.5 | 53.7 | L | 40 | 6.7 | L | 40 | 4.5 | 0.04 | 19 |
| LNU692 | 71483.2 | 44.6 | 0.07 | 16 | 5.6 | 0.07 | 16 | 4.1 | 0.07 | 10 |
| LNU692 | 71483.3 | 51.0 | L | 33 | 6.4 | L | 33 | 4.4 | L | 17 |
| LNU691 | 71436.4 | 47.2 | L | 23 | 5.9 | L | 23 | 4.2 | L | 12 |
| LNU691 | 71441.1 | 45.6 | 0.08 | 19 | 5.7 | 0.08 | 19 | 4.0 | 0.06 | 6 |
| LNU690 | 70695.3 | 53.7 | 0.03 | 40 | 6.7 | 0.03 | 40 | 4.4 | 0.12 | 18 |
| LNU690 | 70696.4 | — | — | — | — | — | — | 4.0 | 0.15 | 7 |
| LNU684 | 71635.5 | 58.8 | 0.05 | 54 | 7.4 | 0.05 | 54 | 4.7 | 0.07 | 27 |
| LNU684 | 71639.3 | 58.2 | 0.13 | 52 | 7.3 | 0.13 | 52 | 4.6 | 0.15 | 24 |
| LNU684 | 71639.5 | 60.5 | 0.07 | 58 | 7.6 | 0.07 | 58 | 4.7 | L | 25 |
| LNU660 | 71065.4 | 45.2 | 0.02 | 18 | 5.6 | 0.02 | 18 | 4.2 | L | 12 |
| LNU660 | 71068.2 | 48.3 | L | 26 | 6.0 | L | 26 | 4.3 | L | 14 |
| LNU660 | 71069.5 | 46.4 | 0.07 | 21 | 5.8 | 0.07 | 21 | 4.1 | 0.09 | 10 |
| LNU660 | 71070.1 | 48.7 | 0.05 | 27 | 6.1 | 0.05 | 27 | 4.3 | 0.21 | 15 |
| LNU619 | 71358.4 | 53.3 | 0.26 | 39 | 6.7 | 0.26 | 39 | 4.3 | 0.30 | 14 |
| LNU619 | 71360.1 | 46.5 | 0.02 | 22 | 5.8 | 0.02 | 22 | 4.1 | 0.14 | 11 |
| LNU619 | 71363.1 | 58.9 | L | 54 | 7.4 | L | 54 | 4.9 | L | 30 |
| LNU598 | 71777.3 | 49.3 | 0.16 | 29 | 6.2 | 0.16 | 29 | 4.3 | 0.08 | 14 |
| LNU598 | 71777.4 | 46.0 | L | 20 | 5.7 | L | 20 | 4.1 | 0.02 | 9 |
| LNU594 | 71738.4 | 56.0 | L | 46 | 7.0 | L | 46 | 4.5 | L | 21 |
| LNU594 | 71739.3 | 59.7 | L | 56 | 7.5 | L | 56 | 4.7 | L | 26 |

TABLE 89-continued

Genes showing improved plant biomass production at limiting nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU584 | 71748.2 | 51.7 | L | 35 | 6.5 | L | 35 | 4.4 | L | 17 |
| LNU584 | 71748.4 | 46.9 | 0.13 | 23 | 5.9 | 0.13 | 23 | 4.1 | 0.18 | 11 |
| LNU584 | 71751.1 | 56.1 | L | 46 | 7.0 | L | 46 | 4.4 | L | 18 |
| LNU576 | 71659.3 | 41.3 | 0.24 | 8 | 5.2 | 0.24 | 8 | 4.0 | 0.13 | 6 |
| LNU576 | 71662.3 | 55.2 | 0.12 | 44 | 6.9 | 0.12 | 44 | 4.6 | L | 23 |
| LNU576 | 71662.5 | 51.2 | 0.04 | 34 | 6.4 | 0.04 | 34 | 4.3 | 0.02 | 16 |
| LNU576 | 71662.6 | — | — | — | — | — | — | 3.9 | 0.30 | 4 |
| LNU561 | 71349.1 | 48.9 | 0.12 | 28 | 6.1 | 0.12 | 28 | 4.1 | 0.12 | 11 |
| LNU555 | 71655.3 | 52.2 | 0.11 | 36 | 6.5 | 0.11 | 36 | 4.3 | 0.07 | 16 |
| LNU555 | 71655.4 | 45.5 | 0.01 | 19 | 5.7 | 0.01 | 19 | 4.0 | 0.13 | 6 |
| LNU555 | 71656.5 | 47.9 | 0.21 | 25 | 6.0 | 0.21 | 25 | 4.2 | 0.27 | 12 |
| LNU523 | 71604.5 | 52.2 | 0.09 | 36 | 6.5 | 0.09 | 36 | 4.3 | L | 16 |
| LNU523 | 71605.3 | 45.7 | 0.12 | 19 | 5.7 | 0.12 | 19 | 4.0 | 0.27 | 7 |
| LNU523 | 71605.4 | 46.2 | 0.09 | 21 | 5.8 | 0.09 | 21 | 4.0 | 0.10 | 8 |
| CONT. | — | 38.3 | — | — | 4.8 | — | — | 3.7 | — | — |

Table 89: "CONT."—Control; "Ave."—Average; "% Incr." = % increment; "p-val."—p-value; L means that p-value is less than 0.01, p < 0.1 was considered as significant.

The genes listed in Table 90 improved plant NUE when grown at limiting nitrogen concentration levels. These genes produced faster developing plants when grown under limiting nitrogen growth conditions, compared to control plants, grown under identical conditions as measured by growth rate of leaf number, rosette diameter and plot coverage.

TABLE 90

Genes showing improved rosette growth performance at limiting nitrogen growth conditions

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU745 | 70911.4 | — | — | — | 7.4 | 0.03 | 36 | 0.4 | 0.06 | 29 |
| LNU745 | 70912.3 | — | — | — | 6.9 | 0.09 | 27 | 0.4 | 0.24 | 17 |
| LNU745 | 70914.2 | — | — | — | 6.4 | 0.23 | 19 | 0.4 | 0.23 | 17 |
| LNU722 | 71188.2 | — | — | — | 6.4 | 0.24 | 18 | — | — | — |
| LNU722 | 71188.3 | — | — | — | 6.4 | 0.24 | 18 | 0.4 | 0.29 | 15 |
| LNU716 | 70760.4 | — | — | — | 6.5 | 0.20 | 20 | 0.4 | 0.14 | 21 |
| LNU716 | 70761.5 | — | — | — | 6.5 | 0.22 | 20 | — | — | — |
| LNU683 | 71293.1 | — | — | — | 6.9 | 0.09 | 27 | — | — | — |
| LNU683 | 71294.2 | — | — | — | 7.0 | 0.06 | 30 | 0.4 | 0.16 | 20 |
| LNU683 | 71298.1 | — | — | — | 6.4 | 0.30 | 18 | — | — | — |
| LNU683 | 71298.2 | — | — | — | 6.4 | 0.21 | 19 | — | — | — |
| LNU670 | 71084.1 | — | — | — | 7.2 | 0.04 | 33 | 0.4 | 0.13 | 22 |
| LNU670 | 71084.4 | — | — | — | — | — | — | 0.4 | 0.24 | 17 |
| LNU656 | 71384.3 | — | — | — | 6.7 | 0.17 | 23 | — | — | — |
| LNU613 | 71621.4 | — | — | — | 7.0 | 0.06 | 29 | 0.4 | 0.19 | 19 |
| LNU590 | 70262.2 | — | — | — | 6.6 | 0.16 | 22 | 0.4 | 0.23 | 18 |
| LNU590 | 70263.2 | — | — | — | 6.5 | 0.20 | 20 | — | — | — |
| LNU590 | 70263.3 | — | — | — | 7.5 | 0.02 | 38 | 0.4 | 0.18 | 19 |
| LNU577 | 72121.2 | — | — | — | 6.5 | 0.19 | 20 | — | — | — |
| LNU577 | 72126.6 | — | — | — | 6.3 | 0.26 | 17 | — | — | — |
| LNU554 | 70478.1 | — | — | — | 7.0 | 0.06 | 30 | 0.4 | 0.19 | 19 |
| LNU554 | 70481.1 | — | — | — | — | — | — | 0.4 | 0.25 | 17 |
| LNU554 | 70482.1 | — | — | — | 6.8 | 0.10 | 26 | 0.4 | 0.13 | 21 |
| CONT. | — | — | — | — | 5.4 | — | — | 0.3 | — | — |
| LNU675 | 70401.2 | — | — | — | 9.0 | 0.06 | 32 | 0.4 | 0.16 | 19 |
| LNU675 | 70403.1 | 0.7 | 0.24 | 13 | — | — | — | — | — | — |
| LNU675 | 70405.3 | 0.7 | 0.25 | 13 | 9.3 | 0.03 | 37 | 0.4 | 0.17 | 19 |
| LNU657 | 70334.10 | 0.7 | 0.22 | 13 | — | — | — | — | — | — |
| LNU656 | 71384.2 | 0.7 | 0.27 | 12 | 8.3 | 0.22 | 21 | 0.4 | 0.13 | 22 |
| LNU656 | 71384.3 | 0.7 | 0.28 | 13 | 8.5 | 0.16 | 25 | 0.4 | 0.28 | 16 |
| LNU656 | 71385.1 | 0.8 | 0.02 | 28 | 10.2 | L | 49 | 0.5 | 0.03 | 31 |

TABLE 90-continued

Genes showing improved rosette growth performance at limiting nitrogen growth conditions

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU641 | 70628.2 | 0.8 | 0.03 | 26 | 8.2 | 0.24 | 20 | — | — | — |
| LNU641 | 70628.3 | 0.7 | 0.24 | 15 | 8.9 | 0.09 | 30 | 0.4 | 0.16 | 20 |
| LNU641 | 70632.3 | 0.7 | 0.25 | 12 | — | — | — | — | — | — |
| LNU625 | 70965.4 | — | — | — | 8.6 | 0.13 | 27 | 0.4 | 0.24 | 17 |
| LNU612 | 71335.1 | — | — | — | 8.4 | 0.16 | 23 | — | — | — |
| LNU605 | 71356.2 | 0.7 | 0.08 | 21 | — | — | — | — | — | — |
| LNU600 | 70484.3 | 0.7 | 0.07 | 18 | — | — | — | — | — | — |
| LNU600 | 70484.5 | 0.7 | 0.21 | 16 | 8.3 | 0.20 | 22 | — | — | — |
| LNU600 | 70486.4 | — | — | — | 8.5 | 0.17 | 25 | 0.4 | 0.22 | 18 |
| LNU600 | 70488.1 | 0.7 | 0.29 | 13 | 9.7 | 0.02 | 42 | 0.5 | 0.06 | 27 |
| LNU593 | 71844.3 | — | — | — | 8.6 | 0.13 | 26 | 0.4 | 0.20 | 18 |
| LNU593 | 71848.5 | — | — | — | 9.2 | 0.04 | 34 | 0.4 | 0.14 | 20 |
| LNU593 | 71849.1 | 0.7 | 0.02 | 25 | 9.1 | 0.05 | 33 | 0.4 | 0.28 | 15 |
| LNU587 | 70378.1 | — | — | — | 9.0 | 0.06 | 32 | 0.4 | 0.21 | 17 |
| LNU587 | 70380.5 | — | — | — | 8.1 | 0.25 | 19 | — | — | — |
| LNU582 | 70256.1 | — | — | — | 8.7 | 0.09 | 28 | 0.4 | 0.25 | 16 |
| LNU582 | 70258.2 | — | — | — | 8.2 | 0.23 | 20 | — | — | — |
| LNU572 | 71406.2 | 0.7 | 0.15 | 15 | — | — | — | — | — | — |
| LNU571 | 71839.2 | 0.7 | 0.05 | 21 | — | — | — | — | — | — |
| LNU571 | 71842.1 | — | — | — | 8.1 | 0.27 | 19 | — | — | — |
| LNU566 | 71834.3 | 0.7 | 0.06 | 21 | 8.1 | 0.28 | 18 | — | — | — |
| LNU566 | 71835.1 | 0.7 | 0.22 | 12 | — | — | — | 0.4 | 0.29 | 14 |
| LNU560 | 70240.5 | — | — | — | 8.0 | 0.29 | 18 | 0.4 | 0.21 | 18 |
| LNU560 | 70241.2 | 0.7 | 0.28 | 11 | — | — | — | — | — | — |
| LNU560 | 70241.4 | — | — | — | 8.1 | 0.29 | 18 | — | — | — |
| LNU560 | 70243.3 | — | — | — | 8.7 | 0.10 | 27 | — | — | — |
| LNU553 | 70370.2 | — | — | — | 8.1 | 0.28 | 18 | — | — | — |
| LNU553 | 70373.1 | — | — | — | 8.3 | 0.21 | 22 | 0.4 | 0.25 | 17 |
| LNU530 | 70203.2 | 0.7 | 0.09 | 19 | — | — | — | — | — | — |
| LNU530 | 70203.3 | — | — | — | 8.9 | 0.07 | 30 | 0.4 | 0.18 | 19 |
| LNU530 | 70207.4 | — | — | — | 9.8 | 0.01 | 44 | 0.4 | 0.09 | 24 |
| CONT. | — | 0.6 | — | — | 6.8 | — | — | 0.4 | — | — |
| LNU738 | 71743.2 | — | — | — | 6.1 | 0.16 | 17 | 0.4 | 0.30 | 8 |
| LNU720 | 71756.2 | — | — | — | 6.9 | L | 33 | 0.4 | 0.07 | 15 |
| LNU720 | 71756.3 | — | — | — | 6.0 | 0.29 | 15 | — | — | — |
| LNU661 | 72705.3 | — | — | — | 6.3 | 0.09 | 21 | 0.4 | 0.22 | 10 |
| LNU661 | 72705.6 | — | — | — | 6.4 | 0.06 | 24 | 0.4 | 0.29 | 9 |
| LNU619 | 71361.2 | 0.7 | 0.11 | 19 | — | — | — | — | — | — |
| LNU619 | 71363.1 | — | — | — | — | — | — | 0.4 | 0.25 | 9 |
| LNU618 | 72133.2 | — | — | — | 6.5 | 0.06 | 25 | 0.4 | 0.18 | 12 |
| LNU598 | 71775.2 | — | — | — | 6.2 | 0.11 | 20 | 0.4 | 0.11 | 13 |
| LNU598 | 71777.3 | — | — | — | 6.6 | 0.03 | 27 | 0.4 | 0.22 | 10 |
| LNU594 | 71739.1 | — | — | — | 6.4 | 0.05 | 24 | — | — | — |
| LNU584 | 71751.1 | — | — | — | 6.6 | 0.04 | 26 | 0.4 | 0.09 | 15 |
| LNU584 | 71751.4 | — | — | — | 5.9 | 0.28 | 14 | — | — | — |
| LNU576 | 71658.1 | — | — | — | 6.2 | 0.17 | 19 | — | — | — |
| LNU576 | 71662.3 | — | — | — | 6.4 | 0.07 | 23 | — | — | — |
| LNU576 | 71662.5 | — | — | — | 6.3 | 0.10 | 21 | 0.4 | 0.26 | 10 |
| LNU573 | 72592.1 | — | — | — | 5.9 | 0.26 | 13 | — | — | — |
| LNU555 | 71655.2 | — | — | — | 6.2 | 0.12 | 19 | 0.4 | 0.29 | 9 |
| LNU555 | 71655.4 | — | — | — | 6.5 | 0.06 | 26 | 0.4 | 0.13 | 13 |
| LNU555 | 71656.5 | — | — | — | 6.4 | 0.07 | 23 | 0.4 | 0.03 | 19 |
| LNU555 | 71656.6 | — | — | — | 6.0 | 0.20 | 15 | — | — | — |
| LNU547 | 70970.2 | — | — | — | 6.0 | 0.22 | 16 | 0.4 | 0.24 | 10 |
| LNU547 | 70971.1 | — | — | — | — | — | — | 0.4 | 0.25 | 9 |
| LNU540 | 70984.4 | — | — | — | 6.2 | 0.12 | 19 | — | — | — |
| LNU540 | 70985.2 | — | — | — | — | — | — | 0.4 | 0.24 | 9 |
| LNU528 | 70566.5 | 0.7 | 0.16 | 18 | — | — | — | — | — | — |
| LNU527 | 70977.2 | 0.7 | 0.07 | 20 | 6.6 | 0.04 | 26 | 0.4 | 0.08 | 15 |
| LNU527 | 70980.5 | — | — | — | 6.7 | 0.02 | 29 | 0.4 | 0.12 | 13 |
| LNU523 | 71604.5 | — | — | — | — | — | — | 0.4 | 0.26 | 9 |
| LNU523 | 71605.3 | — | — | — | 6.2 | 0.12 | 20 | — | — | — |
| LNU523 | 71605.4 | — | — | — | 7.1 | L | 37 | 0.4 | 0.04 | 18 |
| LNU523 | 71605.6 | — | — | — | 6.2 | 0.13 | 19 | 0.4 | 0.29 | 9 |
| CONT. | — | 0.6 | — | — | 5.2 | — | — | 0.3 | — | — |
| LNU736 | 71235.1 | — | — | — | 9.3 | 0.19 | 20 | 0.5 | 0.11 | 14 |
| LNU701 | 71133.5 | — | — | — | 9.2 | 0.20 | 18 | — | — | — |
| LNU677 | 71103.4 | 0.7 | 0.26 | 11 | — | — | — | — | — | — |
| LNU677 | 71106.1 | — | — | — | 9.6 | 0.12 | 23 | 0.5 | 0.24 | 11 |
| LNU666 | 71388.2 | — | — | — | 10.9 | 0.01 | 39 | 0.5 | 0.05 | 17 |
| LNU666 | 71390.2 | — | — | — | 9.7 | 0.10 | 25 | 0.5 | 0.05 | 18 |

TABLE 90-continued

Genes showing improved rosette growth performance at limiting nitrogen growth conditions

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU665 | 71082.4 | — | — | — | 9.4 | 0.20 | 20 | 0.5 | 0.18 | 12 |
| LNU663 | 71071.3 | — | — | — | 9.4 | 0.18 | 20 | 0.5 | 0.14 | 13 |
| LNU663 | 71071.6 | — | — | — | 9.5 | 0.14 | 21 | 0.4 | 0.30 | 9 |
| LNU663 | 71072.5 | 0.8 | 0.21 | 12 | — | — | — | — | — | — |
| LNU617 | 70295.2 | — | — | — | 9.4 | 0.16 | 21 | — | — | — |
| LNU617 | 70295.5 | — | — | — | 9.3 | 0.20 | 19 | — | — | — |
| LNU596 | 72118.2 | — | — | — | 9.6 | 0.11 | 23 | 0.5 | 0.27 | 10 |
| LNU596 | 72120.2 | — | — | — | 9.4 | 0.21 | 20 | 0.5 | 0.27 | 10 |
| LNU575 | 70250.3 | 0.8 | 0.26 | 12 | — | — | — | — | — | — |
| LNU575 | 70253.3 | — | — | — | 9.5 | 0.13 | 22 | 0.5 | 0.13 | 13 |
| LNU575 | 70253.4 | — | — | — | 9.2 | 0.23 | 17 | — | — | — |
| LNU575 | 70254.1 | — | — | — | 10.7 | 0.01 | 37 | 0.5 | 0.23 | 10 |
| LNU570 | 70579.4 | 0.8 | 0.25 | 11 | — | — | — | — | — | — |
| LNU568 | 70844.4 | — | — | — | 9.1 | 0.30 | 16 | — | — | — |
| LNU568 | 70846.3 | — | — | — | 9.5 | 0.15 | 22 | — | — | — |
| LNU548 | 70569.1 | — | — | — | 9.2 | 0.21 | 18 | 0.5 | 0.09 | 15 |
| LNU526 | 70818.4 | 0.8 | 0.24 | 11 | — | — | — | — | — | — |
| CONT. | — | 0.7 | — | — | 7.8 | — | — | 0.4 | — | — |
| LNU658 | 70687.3 | 0.7 | 0.21 | 24 | — | — | — | — | — | — |
| LNU643 | 70326.5 | 0.7 | 0.16 | 27 | 9.1 | L | 45 | 0.5 | L | 22 |
| LNU642 | 70582.5 | — | — | — | 7.3 | 0.30 | 16 | 0.5 | 0.15 | 11 |
| LNU642 | 70583.1 | 0.7 | 0.21 | 24 | — | — | — | — | — | — |
| LNU620 | 70303.1 | — | — | — | 7.3 | 0.27 | 17 | — | — | — |
| LNU617 | 70293.2 | 0.8 | 0.12 | 31 | — | — | — | — | — | — |
| LNU617 | 70295.5 | 0.8 | 0.14 | 29 | — | — | — | — | — | — |
| LNU606 | 70290.2 | 0.7 | 0.22 | 24 | — | — | — | — | — | — |
| LNU606 | 70290.3 | — | — | — | 7.3 | 0.26 | 16 | — | — | — |
| LNU606 | 70291.2 | — | — | — | 7.9 | 0.10 | 25 | 0.5 | 0.12 | 12 |
| LNU592 | 70270.1 | — | — | — | 8.1 | 0.05 | 29 | 0.4 | 0.12 | 11 |
| LNU590 | 70267.5 | — | — | — | 7.7 | 0.12 | 23 | 0.5 | 0.07 | 13 |
| LNU575 | 70253.3 | — | — | — | 7.5 | 0.22 | 19 | 0.4 | 0.16 | 11 |
| LNU554 | 70478.1 | — | — | — | 7.8 | 0.12 | 23 | 0.5 | 0.13 | 12 |
| LNU534 | 70501.1 | 0.7 | 0.21 | 24 | — | — | — | — | — | — |
| LNU531 | 70211.3 | 0.7 | 0.17 | 27 | — | — | — | — | — | — |
| CONT. | — | 0.6 | — | — | 6.3 | — | — | 0.4 | — | — |
| LNU724 | 71512.3 | — | — | — | 4.0 | 0.09 | 26 | 0.3 | 0.09 | 13 |
| LNU724 | 71513.4 | — | — | — | 3.6 | 0.30 | 15 | — | — | — |
| LNU723 | 71191.3 | — | — | — | 3.7 | 0.21 | 18 | — | — | — |
| LNU723 | 71192.2 | — | — | — | 3.9 | 0.11 | 23 | — | — | — |
| LNU707 | 71789.2 | — | — | — | 4.0 | 0.07 | 27 | 0.3 | 0.27 | 9 |
| LNU684 | 71635.1 | — | — | — | 3.7 | 0.22 | 18 | — | — | — |
| LNU684 | 71637.1 | — | — | — | 3.7 | 0.26 | 16 | 0.3 | 0.30 | 8 |
| LNU684 | 71639.3 | — | — | — | 3.7 | 0.20 | 18 | — | — | — |
| LNU684 | 71639.5 | 0.7 | 0.25 | 14 | 3.7 | 0.23 | 17 | — | — | — |
| LNU660 | 71065.2 | — | — | — | — | — | — | 0.3 | 0.17 | 10 |
| LNU660 | 71068.2 | — | — | — | 3.7 | 0.27 | 16 | 0.3 | 0.14 | 11 |
| LNU655 | 72291.4 | — | — | — | 4.0 | 0.10 | 25 | 0.3 | 0.23 | 10 |
| LNU655 | 72292.1 | — | — | — | 3.9 | 0.10 | 24 | 0.3 | 0.27 | 8 |
| LNU625 | 70964.4 | 0.7 | 0.30 | 13 | — | — | — | — | — | — |
| LNU625 | 70966.3 | — | — | — | 3.7 | 0.20 | 18 | 0.3 | 0.16 | 10 |
| LNU612 | 71334.3 | — | — | — | 4.0 | 0.07 | 27 | 0.3 | 0.08 | 14 |
| LNU612 | 71335.1 | — | — | — | — | — | — | 0.3 | 0.24 | 8 |
| LNU612 | 71335.4 | — | — | — | 4.1 | 0.05 | 31 | 0.3 | 0.19 | 11 |
| LNU605 | 71352.1 | — | — | — | 3.7 | 0.23 | 17 | — | — | — |
| LNU605 | 71352.2 | — | — | — | 4.4 | 0.01 | 39 | 0.3 | 0.03 | 17 |
| LNU605 | 71356.2 | — | — | — | 3.9 | 0.10 | 23 | 0.3 | 0.25 | 8 |
| LNU597 | 72369.4 | — | — | — | 3.8 | 0.13 | 21 | — | — | — |
| LNU593 | 71846.1 | — | — | — | 3.6 | 0.30 | 15 | — | — | — |
| LNU593 | 71848.5 | — | — | — | 3.9 | 0.12 | 22 | 0.3 | 0.14 | 11 |
| LNU577 | 72121.1 | — | — | — | 3.8 | 0.17 | 20 | 0.3 | 0.12 | 12 |
| LNU572 | 71408.6 | — | — | — | 3.8 | 0.18 | 20 | — | — | — |
| LNU571 | 71839.2 | — | — | — | — | — | — | 0.3 | 0.27 | 8 |
| LNU571 | 71842.3 | — | — | — | 3.6 | 0.28 | 15 | 0.3 | 0.15 | 10 |
| LNU566 | 71837.1 | — | — | — | 3.8 | 0.19 | 20 | 0.3 | 0.24 | 9 |
| LNU556 | 72364.2 | — | — | — | 3.8 | 0.13 | 21 | 0.3 | 0.13 | 11 |
| LNU531 | 70209.4 | — | — | — | 3.7 | 0.22 | 17 | 0.3 | 0.17 | 10 |
| LNU531 | 70210.1 | — | — | — | 3.8 | 0.14 | 21 | 0.3 | 0.24 | 9 |
| LNU531 | 70211.1 | — | — | — | 4.0 | 0.07 | 26 | 0.3 | 0.23 | 9 |
| LNU531 | 70211.3 | — | — | — | 4.2 | 0.02 | 34 | 0.3 | 0.03 | 17 |
| CONT. | — | 0.6 | — | — | 3.2 | — | — | 0.3 | — | — |
| LNU747 | 70616.4 | — | — | — | — | — | — | 0.4 | 0.12 | 10 |

TABLE 90-continued

Genes showing improved rosette growth performance at limiting nitrogen growth conditions

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU697 | 70702.2 | — | — | — | 7.7 | 0.02 | 28 | 0.4 | 0.03 | 16 |
| LNU697 | 70705.2 | — | — | — | 6.8 | 0.28 | 13 | 0.4 | 0.22 | 8 |
| LNU673 | 70394.1 | — | — | — | 7.2 | 0.14 | 19 | 0.4 | 0.27 | 8 |
| LNU673 | 70395.5 | — | — | — | 7.4 | 0.06 | 23 | 0.4 | 0.09 | 12 |
| LNU673 | 70398.2 | — | — | — | 6.9 | 0.30 | 14 | — | — | — |
| LNU669 | 70388.2 | 0.8 | 0.23 | 12 | 7.1 | 0.13 | 18 | — | — | — |
| LNU669 | 70389.2 | 0.8 | 0.27 | 11 | — | — | — | — | — | — |
| LNU653 | 70659.4 | — | — | — | 7.4 | 0.07 | 22 | 0.4 | 0.05 | 14 |
| LNU650 | 70874.3 | — | — | — | 7.0 | 0.21 | 16 | 0.4 | 0.19 | 10 |
| LNU623 | 71007.2 | — | — | — | 6.8 | 0.29 | 13 | — | — | — |
| LNU623 | 71010.3 | — | — | — | 7.5 | 0.04 | 24 | 0.4 | 0.16 | 9 |
| LNU610 | 70781.1 | — | — | — | 7.4 | 0.08 | 22 | — | — | — |
| LNU563 | 70987.3 | — | — | — | 7.7 | 0.03 | 27 | 0.5 | L | 21 |
| LNU563 | 70987.5 | 0.8 | 0.27 | 11 | — | — | — | — | — | — |
| LNU563 | 70990.1 | — | — | — | — | — | — | 0.4 | 0.22 | 8 |
| LNU563 | 70990.2 | — | — | — | — | — | — | 0.4 | 0.29 | 7 |
| LNU547 | 70972.1 | — | — | — | 7.3 | 0.12 | 20 | — | — | — |
| LNU540 | 70984.4 | — | — | — | 8.2 | L | 36 | 0.4 | 0.02 | 16 |
| LNU540 | 70985.2 | — | — | — | 7.0 | 0.18 | 16 | 0.4 | 0.13 | 11 |
| LNU540 | 70986.1 | — | — | — | 6.9 | 0.24 | 14 | 0.4 | 0.08 | 12 |
| LNU528 | 70566.5 | — | — | — | 7.3 | 0.10 | 20 | 0.4 | 0.15 | 10 |
| LNU522 | 70804.4 | — | — | — | 6.8 | 0.29 | 13 | — | — | — |
| CONT. | — | 0.7 | — | — | 6.0 | — | — | 0.4 | — | — |
| LNU716 | 70762.2 | — | — | — | 7.6 | 0.23 | 19 | — | — | — |
| LNU683 | 71294.2 | — | — | — | 7.8 | 0.15 | 23 | — | — | — |
| LNU668 | 71415.1 | — | — | — | 8.3 | 0.07 | 30 | — | — | — |
| LNU658 | 70687.3 | — | — | — | 7.7 | 0.20 | 21 | 0.4 | 0.30 | 14 |
| LNU647 | 70589.8 | — | — | — | 8.0 | 0.12 | 25 | 0.5 | 0.21 | 16 |
| LNU646 | 72148.5 | — | — | — | 7.8 | 0.18 | 22 | 0.4 | 0.27 | 15 |
| LNU644 | 70330.1 | — | — | — | 8.2 | 0.10 | 29 | — | — | — |
| LNU644 | 70332.2 | — | — | — | 7.5 | 0.28 | 18 | — | — | — |
| LNU643 | 70323.1 | — | — | — | — | — | — | 0.5 | 0.21 | 16 |
| LNU643 | 70325.2 | — | — | — | 7.7 | 0.20 | 21 | — | — | — |
| LNU643 | 70325.6 | — | — | — | 8.6 | 0.04 | 34 | 0.4 | 0.27 | 14 |
| LNU643 | 70326.5 | — | — | — | 8.4 | 0.06 | 31 | 0.5 | 0.25 | 15 |
| LNU642 | 70582.3 | — | — | — | 7.6 | 0.22 | 20 | — | — | — |
| LNU642 | 70582.5 | — | — | — | 7.8 | 0.18 | 22 | — | — | — |
| LNU642 | 70583.2 | — | — | — | 7.5 | 0.25 | 18 | — | — | — |
| LNU620 | 70300.2 | — | — | — | 8.6 | 0.04 | 35 | 0.5 | 0.18 | 18 |
| LNU620 | 70302.3 | — | — | — | 8.0 | 0.12 | 25 | — | — | — |
| LNU620 | 70303.4 | — | — | — | 7.8 | 0.16 | 22 | — | — | — |
| LNU606 | 70289.1 | — | — | — | 7.6 | 0.23 | 20 | — | — | — |
| LNU604 | 70280.3 | — | — | — | 7.7 | 0.21 | 20 | — | — | — |
| LNU604 | 70282.1 | 0.7 | 0.28 | 19 | — | — | — | — | — | — |
| LNU596 | 72118.2 | — | — | — | 8.1 | 0.10 | 27 | — | — | — |
| LNU596 | 72120.4 | — | — | — | 7.6 | 0.24 | 19 | — | — | — |
| LNU592 | 70268.1 | — | — | — | 8.3 | 0.07 | 30 | — | — | — |
| LNU592 | 70270.1 | — | — | — | 7.9 | 0.13 | 24 | 0.4 | 0.26 | 15 |
| LNU569 | 72151.2 | — | — | — | 7.6 | 0.24 | 19 | — | — | — |
| LNU569 | 72154.4 | 0.7 | 0.27 | 19 | — | — | — | — | — | — |
| CONT. | — | 0.6 | — | — | 6.4 | — | — | 0.4 | — | — |
| LNU744 | 71485.1 | — | — | — | 6.1 | 0.17 | 21 | — | — | — |
| LNU744 | 71486.3 | — | — | — | 6.7 | 0.05 | 33 | 0.4 | 0.29 | 10 |
| LNU744 | 71487.3 | — | — | — | 6.9 | 0.03 | 37 | 0.4 | 0.15 | 13 |
| LNU738 | 71742.2 | — | — | — | 7.2 | 0.01 | 43 | 0.4 | 0.03 | 20 |
| LNU738 | 71743.1 | — | — | — | 6.0 | 0.22 | 20 | — | — | — |
| LNU738 | 71743.2 | — | — | — | 6.6 | 0.05 | 32 | 0.4 | 0.07 | 18 |
| LNU727 | 71671.2 | — | — | — | 6.3 | 0.13 | 26 | 0.4 | 0.23 | 12 |
| LNU727 | 71671.4 | — | — | — | 7.7 | L | 54 | 0.4 | 0.05 | 19 |
| LNU727 | 71674.1 | 0.7 | 0.13 | 21 | 8.2 | L | 64 | 0.4 | 0.01 | 25 |
| LNU720 | 71754.3 | — | — | — | 7.1 | 0.01 | 41 | 0.4 | 0.06 | 18 |
| LNU720 | 71755.2 | — | — | — | 5.9 | 0.23 | 19 | — | — | — |
| LNU720 | 71756.1 | — | — | — | 6.7 | 0.04 | 33 | 0.4 | 0.26 | 10 |
| LNU707 | 71788.2 | — | — | — | 6.5 | 0.06 | 30 | 0.4 | 0.06 | 18 |
| LNU707 | 71789.3 | — | — | — | 6.9 | 0.02 | 37 | 0.4 | 0.10 | 15 |
| LNU692 | 71482.2 | — | — | — | 6.2 | 0.13 | 24 | 0.4 | 0.25 | 11 |
| LNU692 | 71482.5 | — | — | — | 7.1 | 0.02 | 41 | 0.4 | 0.03 | 21 |
| LNU692 | 71483.2 | — | — | — | 5.9 | 0.28 | 17 | — | — | — |
| LNU692 | 71483.3 | — | — | — | 6.7 | 0.04 | 33 | 0.4 | 0.12 | 14 |
| LNU691 | 71436.2 | — | — | — | 7.0 | 0.04 | 40 | 0.4 | 0.21 | 14 |
| LNU691 | 71436.4 | — | — | — | 6.1 | 0.16 | 22 | — | — | — |

TABLE 90-continued

Genes showing improved rosette growth performance at limiting nitrogen growth conditions

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU691 | 71441.1 | — | — | — | 5.9 | 0.24 | 19 | — | — | — |
| LNU690 | 70694.2 | 0.7 | 0.23 | 16 | — | — | — | — | — | — |
| LNU690 | 70695.3 | — | — | — | 7.0 | 0.02 | 40 | 0.4 | 0.12 | 14 |
| LNU684 | 71635.5 | 0.7 | 0.28 | 16 | 7.8 | L | 55 | 0.5 | L | 30 |
| LNU684 | 71639.3 | — | — | — | 7.6 | L | 52 | 0.4 | 0.02 | 22 |
| LNU684 | 71639.5 | — | — | — | 7.9 | L | 58 | 0.4 | 0.01 | 24 |
| LNU660 | 71065.4 | — | — | — | 5.8 | 0.28 | 16 | — | — | — |
| LNU660 | 71068.2 | — | — | — | 6.4 | 0.09 | 27 | 0.4 | 0.06 | 17 |
| LNU660 | 71069.5 | — | — | — | 5.9 | 0.24 | 18 | — | — | — |
| LNU660 | 71070.1 | — | — | — | 6.3 | 0.11 | 26 | 0.4 | 0.22 | 12 |
| LNU619 | 71358.4 | — | — | — | 7.0 | 0.02 | 40 | 0.4 | 0.16 | 14 |
| LNU619 | 71360.1 | — | — | — | 6.1 | 0.18 | 21 | — | — | — |
| LNU619 | 71363.1 | — | — | — | 7.7 | L | 54 | 0.5 | L | 31 |
| LNU598 | 71777.3 | — | — | — | 6.4 | 0.09 | 28 | 0.4 | 0.27 | 10 |
| LNU598 | 71777.4 | — | — | — | 6.1 | 0.18 | 21 | 0.4 | 0.29 | 10 |
| LNU594 | 71738.4 | — | — | — | 7.4 | L | 47 | 0.4 | 0.07 | 16 |
| LNU594 | 71739.1 | — | — | — | 5.9 | 0.28 | 17 | — | — | — |
| LNU594 | 71739.3 | — | — | — | 7.8 | L | 56 | 0.4 | 0.01 | 23 |
| LNU584 | 71748.2 | — | — | — | 6.8 | 0.03 | 36 | 0.4 | 0.06 | 18 |
| LNU584 | 71748.4 | — | — | — | 6.1 | 0.16 | 22 | — | — | — |
| LNU584 | 71751.1 | 0.7 | 0.21 | 17 | 7.4 | L | 48 | 0.4 | 0.04 | 19 |
| LNU576 | 71662.3 | — | — | — | 7.2 | 0.01 | 44 | 0.4 | 0.03 | 21 |
| LNU576 | 71662.5 | — | — | — | 6.7 | 0.04 | 33 | 0.4 | 0.17 | 13 |
| LNU561 | 71346.8 | 0.7 | 0.25 | 16 | — | — | — | — | — | — |
| LNU561 | 71349.1 | — | — | — | 6.4 | 0.09 | 28 | 0.4 | 0.22 | 12 |
| LNU555 | 71655.3 | — | — | — | 6.9 | 0.03 | 37 | 0.4 | 0.13 | 14 |
| LNU555 | 71655.4 | — | — | — | 6.0 | 0.21 | 20 | — | — | — |
| LNU555 | 71656.5 | — | — | — | 6.3 | 0.12 | 25 | 0.4 | 0.24 | 11 |
| LNU523 | 71604.5 | — | — | — | 6.8 | 0.03 | 35 | 0.4 | 0.20 | 12 |
| LNU523 | 71605.3 | — | — | — | 6.1 | 0.18 | 21 | — | — | — |
| LNU523 | 71605.4 | — | — | — | 6.0 | 0.22 | 19 | — | — | — |
| CONT. | — | 0.6 | — | — | 5.0 | — | — | 0.4 | — | — |

Table 90. "CONT."—Control; "Ave."—Average; "% Incr." = % increment; "p-val."—p-value; L means that p-value is less than 0.01, p < 0.1 was considered as significant.

The genes listed in Tables 91-92 improved plant NUE when grown at standard nitrogen concentration levels. These genes produced larger plants with a larger photosynthetic area and increased biomass (fresh weight, dry weight, leaf number, rosette diameter, rosette area and plot coverage) when grown under standard nitrogen conditions as compared to control plants grown under identical growth conditions.

TABLE 91

Genes showing improved plant biomass production at standard nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU745 | 70911.4 | 215.4 | 0.26 | 8 | 2146.4 | 0.22 | 11 | — | — | — |
| LNU745 | 70912.3 | 222.6 | 0.04 | 11 | 2182.1 | 0.01 | 13 | — | — | — |
| LNU745 | 70914.2 | — | — | — | 2135.7 | 0.04 | 11 | — | — | — |
| LNU745 | 70914.4 | 225.0 | 0.04 | 13 | 2156.2 | 0.06 | 12 | — | — | — |
| LNU724 | 71513.2 | 217.5 | 0.15 | 9 | 2156.2 | 0.03 | 12 | — | — | — |
| LNU724 | 71513.4 | 265.6 | 0.28 | 33 | 2243.8 | L | 16 | — | — | — |
| LNU723 | 71191.3 | 225.7 | 0.03 | 13 | — | — | — | — | — | — |
| LNU722 | 71188.3 | 221.0 | 0.07 | 11 | 2096.4 | 0.12 | 9 | — | — | — |
| LNU722 | 71189.2 | 214.4 | 0.12 | 7 | — | — | — | — | — | — |
| LNU716 | 70760.7 | — | — | — | 2056.2 | 0.27 | 7 | — | — | — |
| LNU716 | 70760.8 | 230.1 | 0.08 | 15 | 2150.9 | 0.03 | 12 | — | — | — |
| LNU716 | 70761.5 | — | — | — | — | — | — | 11.1 | 0.25 | 3 |
| LNU683 | 71294.2 | — | — | — | — | — | — | 11.3 | 0.09 | 4 |
| LNU683 | 71298.1 | 223.8 | 0.10 | 12 | 2125.0 | 0.15 | 10 | — | — | — |
| LNU682 | 71431.3 | 220.0 | 0.15 | 10 | 2137.5 | 0.22 | 11 | — | — | — |
| LNU682 | 71432.4 | 213.3 | 0.14 | 7 | 2140.2 | 0.03 | 11 | — | — | — |
| LNU670 | 71083.1 | 215.0 | 0.20 | 8 | — | — | — | — | — | — |
| LNU670 | 71084.1 | 228.8 | 0.01 | 14 | 2168.8 | 0.03 | 12 | — | — | — |

TABLE 91-continued

Genes showing improved plant biomass production at standard nitrogen growth conditions

| Gene Name | Event # | Dry Weight [mg] Ave. | P-Val. | % Incr. | Fresh Weight [mg] Ave. | P-Val. | % Incr. | Leaf Number Ave. | P-Val. | % Incr. |
|---|---|---|---|---|---|---|---|---|---|---|
| LNU656 | 71384.5 | 243.8 | 0.08 | 22 | — | — | — | — | — | — |
| LNU656 | 71387.2 | — | — | — | 2031.2 | 0.26 | 5 | — | — | — |
| LNU655 | 72292.1 | — | — | — | — | — | — | 11.2 | 0.16 | 4 |
| LNU655 | 72293.2 | — | — | — | 2085.7 | 0.07 | 8 | — | — | — |
| LNU655 | 72293.3 | 214.4 | 0.16 | 7 | 2137.5 | 0.03 | 11 | 12.2 | L | 13 |
| LNU597 | 72367.3 | 211.9 | 0.18 | 6 | — | — | — | — | — | — |
| LNU597 | 72367.6 | 209.4 | 0.28 | 5 | 2043.8 | 0.22 | 6 | — | — | — |
| LNU597 | 72369.3 | 234.6 | 0.10 | 17 | 2242.9 | 0.26 | 16 | — | — | — |
| LNU590 | 70262.2 | 216.1 | 0.09 | 8 | — | — | — | — | — | — |
| LNU590 | 70263.2 | 216.9 | 0.22 | 8 | — | — | — | — | — | — |
| LNU577 | 72121.2 | — | — | — | 2056.2 | 0.27 | 7 | — | — | — |
| LNU577 | 72126.6 | 231.2 | L | 16 | 2175.0 | 0.06 | 13 | — | — | — |
| LNU556 | 72362.2 | 222.1 | 0.13 | 11 | 2128.6 | 0.04 | 10 | — | — | — |
| LNU556 | 72363.2 | 217.5 | 0.07 | 9 | — | — | — | — | — | — |
| LNU556 | 72363.4 | — | — | — | 2020.5 | 0.25 | 5 | — | — | — |
| LNU554 | 70478.1 | 235.1 | L | 18 | 2267.9 | 0.06 | 18 | — | — | — |
| LNU554 | 70481.2 | 262.1 | 0.19 | 31 | 2278.6 | 0.15 | 18 | — | — | — |
| LNU554 | 70482.4 | 243.1 | L | 22 | 2312.5 | L | 20 | — | — | — |
| LNU532 | 70556.4 | 217.5 | 0.23 | 9 | 2081.2 | 0.16 | 8 | — | — | — |
| LNU532 | 70557.1 | 228.1 | 0.08 | 14 | — | — | — | — | — | — |
| CONT. | — | 199.9 | — | — | 1928.3 | — | — | 10.8 | — | — |
| LNU721 | 70613.1 | — | — | — | — | — | — | 10.9 | 0.01 | 9 |
| LNU721 | 70613.4 | 160.6 | L | 18 | 1937.5 | 0.04 | 15 | — | — | — |
| LNU675 | 70401.2 | — | — | — | — | — | — | 11.4 | L | 14 |
| LNU675 | 70402.1 | 144.7 | 0.18 | 6 | — | — | — | 10.8 | 0.16 | 8 |
| LNU675 | 70405.3 | 177.5 | L | 30 | 2106.2 | 0.01 | 25 | — | — | — |
| LNU656 | 71384.2 | 186.2 | 0.08 | 37 | 2206.2 | 0.12 | 31 | 11.0 | 0.01 | 10 |
| LNU656 | 71384.3 | 171.9 | 0.03 | 26 | 2081.2 | L | 24 | 10.4 | 0.27 | 4 |
| LNU656 | 71385.1 | 184.4 | L | 35 | 2225.0 | 0.08 | 33 | 11.4 | 0.09 | 14 |
| LNU641 | 70628.3 | 160.0 | 0.23 | 18 | 1881.2 | 0.07 | 12 | 10.8 | 0.12 | 7 |
| LNU641 | 70632.3 | 168.6 | 0.16 | 24 | — | — | — | — | — | — |
| LNU625 | 70964.4 | 151.9 | 0.13 | 12 | — | — | — | — | — | — |
| LNU625 | 70965.4 | 168.1 | L | 24 | — | — | — | 10.6 | 0.18 | 6 |
| LNU625 | 70966.4 | 153.8 | 0.23 | 13 | — | — | — | — | — | — |
| LNU612 | 71334.3 | 161.2 | 0.10 | 19 | 2087.5 | L | 24 | 10.9 | 0.01 | 9 |
| LNU612 | 71335.1 | — | — | — | — | — | — | 10.4 | 0.23 | 4 |
| LNU612 | 71335.4 | 177.5 | L | 30 | 2131.2 | L | 27 | — | — | — |
| LNU605 | 71352.1 | 147.5 | 0.09 | 8 | — | — | — | — | — | — |
| LNU605 | 71352.2 | 158.0 | 0.23 | 16 | — | — | — | — | — | — |
| LNU605 | 71356.2 | 149.1 | 0.24 | 10 | 1844.6 | 0.21 | 10 | — | — | — |
| LNU600 | 70484.3 | — | — | — | 1806.2 | 0.23 | 8 | — | — | — |
| LNU600 | 70484.5 | 147.5 | 0.10 | 8 | — | — | — | — | — | — |
| LNU600 | 70486.2 | 146.2 | 0.13 | 7 | — | — | — | — | — | — |
| LNU600 | 70488.1 | 173.8 | 0.18 | 28 | 2100.0 | 0.28 | 25 | 11.0 | 0.16 | 10 |
| LNU593 | 71844.3 | 171.9 | 0.06 | 26 | 2018.7 | 0.05 | 20 | — | — | — |
| LNU593 | 71846.1 | 154.1 | 0.21 | 13 | — | — | — | — | — | — |
| LNU593 | 71848.2 | 151.9 | 0.05 | 12 | 1906.2 | 0.28 | 14 | — | — | — |
| LNU593 | 71848.5 | 158.1 | 0.10 | 16 | 1900.0 | 0.16 | 13 | 10.8 | 0.27 | 8 |
| LNU593 | 71849.1 | 172.5 | L | 27 | 2212.5 | L | 32 | 10.7 | 0.05 | 7 |
| LNU587 | 70378.1 | 175.6 | 0.16 | 29 | 1931.2 | 0.04 | 15 | — | — | — |
| LNU587 | 70379.3 | 179.4 | L | 32 | 2193.8 | 0.10 | 31 | — | — | — |
| LNU587 | 70380.5 | 201.2 | 0.17 | 48 | 2293.8 | 0.13 | 37 | 11.6 | L | 15 |
| LNU587 | 70381.1 | 150.6 | 0.15 | 11 | — | — | — | 10.8 | 0.04 | 7 |
| LNU582 | 70256.1 | 185.6 | 0.03 | 36 | 2368.8 | L | 41 | 10.8 | 0.12 | 7 |
| LNU582 | 70258.2 | 164.8 | 0.08 | 21 | — | — | — | — | — | — |
| LNU582 | 70259.3 | 159.4 | 0.26 | 17 | — | — | — | — | — | — |
| LNU572 | 71406.2 | 175.0 | L | 29 | 2112.5 | L | 26 | — | — | — |
| LNU572 | 71408.2 | 152.1 | 0.10 | 12 | — | — | — | — | — | — |
| LNU572 | 71408.6 | 147.5 | 0.20 | 8 | — | — | — | — | — | — |
| LNU571 | 71838.4 | 145.6 | 0.16 | 7 | 1787.5 | 0.29 | 6 | — | — | — |
| LNU571 | 71839.2 | 158.8 | 0.25 | 17 | — | — | — | — | — | — |
| LNU571 | 71842.1 | 170.0 | 0.05 | 25 | 1950.0 | 0.24 | 16 | 10.9 | 0.08 | 9 |
| LNU571 | 71842.3 | 148.1 | 0.16 | 9 | — | — | — | — | — | — |
| LNU566 | 71834.2 | 160.0 | 0.19 | 18 | 1850.0 | 0.13 | 10 | 10.4 | 0.27 | 4 |
| LNU566 | 71834.3 | 188.1 | 0.09 | 38 | 2087.5 | L | 24 | 11.1 | L | 10 |
| LNU566 | 71835.1 | 154.4 | 0.02 | 13 | — | — | — | — | — | — |
| LNU566 | 71837.1 | 145.2 | 0.18 | 7 | 1861.6 | 0.19 | 11 | 10.8 | 0.12 | 7 |
| LNU560 | 70239.1 | 148.1 | 0.08 | 9 | 2006.2 | 0.01 | 20 | — | — | — |
| LNU560 | 70240.5 | 155.4 | 0.27 | 14 | 1828.6 | 0.16 | 9 | — | — | — |
| LNU560 | 70241.2 | — | — | — | 1850.0 | 0.25 | 10 | — | — | — |
| LNU560 | 70241.4 | 180.6 | 0.24 | 33 | 2193.8 | 0.08 | 31 | 10.8 | 0.04 | 7 |
| LNU560 | 70243.3 | 160.0 | 0.01 | 18 | 1900.0 | 0.07 | 13 | 10.4 | 0.17 | 4 |

TABLE 91-continued

Genes showing improved plant biomass production at standard nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU553 | 70370.1 | 180.6 | 0.22 | 33 | 1900.0 | 0.06 | 13 | 11.4 | 0.05 | 14 |
| LNU553 | 70370.2 | 165.0 | 0.04 | 21 | 1943.8 | 0.30 | 16 | — | — | — |
| LNU553 | 70373.1 | 158.1 | L | 16 | 1962.5 | 0.26 | 17 | 11.3 | 0.06 | 13 |
| LNU553 | 70374.2 | 146.2 | 0.19 | 7 | — | — | — | — | — | — |
| LNU530 | 70203.2 | 149.4 | 0.13 | 10 | — | — | — | — | — | — |
| LNU530 | 70203.3 | 157.5 | 0.22 | 16 | — | — | — | — | — | — |
| LNU530 | 70204.1 | 163.1 | 0.01 | 20 | 1987.5 | 0.02 | 18 | 10.5 | 0.12 | 5 |
| LNU530 | 70207.4 | 179.4 | L | 32 | 2287.5 | L | 36 | 11.2 | 0.03 | 12 |
| CONT. | — | 136.1 | — | — | 1678.6 | — | — | 10.0 | — | — |
| LNU720 | 71755.4 | — | — | — | — | — | — | 10.1 | 0.17 | 6 |
| LNU720 | 71756.2 | 216.9 | L | 9 | 2400.0 | 0.14 | 6 | — | — | — |
| LNU661 | 72705.3 | 210.6 | 0.17 | 6 | — | — | — | — | — | — |
| LNU661 | 72705.6 | 208.1 | 0.04 | 4 | — | — | — | — | — | — |
| LNU661 | 72707.2 | 230.0 | L | 15 | — | — | — | — | — | — |
| LNU619 | 71358.1 | — | — | — | — | — | — | 10.0 | 0.06 | 5 |
| LNU618 | 72133.2 | 215.6 | L | 8 | — | — | — | 10.4 | L | 9 |
| LNU618 | 72135.3 | 215.0 | 0.19 | 8 | 2425.0 | 0.15 | 7 | — | — | — |
| LNU618 | 72138.1 | — | — | — | — | — | — | 10.2 | 0.12 | 8 |
| LNU594 | 71740.3 | — | — | — | — | — | — | 10.1 | 0.12 | 6 |
| LNU594 | 71741.2 | — | — | — | — | — | — | 9.9 | 0.21 | 4 |
| LNU584 | 71748.2 | 221.2 | 0.21 | 11 | — | — | — | — | — | — |
| LNU584 | 71748.4 | 206.2 | 0.10 | 3 | — | — | — | — | — | — |
| LNU584 | 71751.1 | 226.9 | L | 14 | — | — | — | — | — | — |
| LNU576 | 71658.1 | — | — | — | — | — | — | 10.5 | 0.26 | 10 |
| LNU576 | 71659.3 | 217.5 | 0.21 | 9 | — | — | — | — | — | — |
| LNU576 | 71662.5 | 220.6 | 0.10 | 11 | — | — | — | — | — | — |
| LNU555 | 71655.2 | — | — | — | — | — | — | 9.9 | 0.14 | 4 |
| LNU555 | 71655.4 | — | — | — | — | — | — | 11.0 | 0.09 | 16 |
| LNU555 | 71656.6 | — | — | — | — | — | — | 10.2 | 0.21 | 7 |
| LNU547 | 70970.2 | 209.4 | 0.20 | 5 | — | — | — | — | — | — |
| LNU540 | 70984.4 | 220.0 | 0.23 | 10 | — | — | — | 10.4 | 0.01 | 9 |
| LNU528 | 70565.1 | 204.4 | 0.24 | 2 | — | — | — | — | — | — |
| LNU527 | 70979.2 | 220.6 | 0.20 | 11 | 2637.5 | 0.18 | 17 | 10.8 | 0.07 | 14 |
| LNU527 | 70980.3 | 214.4 | L | 7 | — | — | — | — | — | — |
| LNU527 | 70980.5 | — | — | — | — | — | — | 9.8 | 0.22 | 3 |
| LNU523 | 71605.4 | — | — | — | — | — | — | 10.0 | 0.24 | 5 |
| CONT. | — | 199.6 | — | — | 2262.0 | — | — | 9.5 | — | — |
| LNU736 | 71235.4 | 152.5 | L | 17 | 2057.1 | 0.22 | 17 | — | — | — |
| LNU701 | 71131.1 | 156.9 | 0.11 | 20 | — | — | — | — | — | — |
| LNU701 | 71133.4 | 159.7 | 0.03 | 23 | — | — | — | — | — | — |
| LNU698 | 70883.1 | 138.8 | 0.27 | 6 | 1881.2 | 0.20 | 7 | — | — | — |
| LNU677 | 71103.4 | 147.4 | 0.25 | 13 | — | — | — | — | — | — |
| LNU677 | 71105.1 | — | — | — | 2031.2 | 0.11 | 16 | — | — | — |
| LNU666 | 71388.2 | 150.1 | 0.29 | 15 | — | — | — | 11.4 | 0.12 | 2 |
| LNU666 | 71389.1 | 144.3 | 0.07 | 11 | — | — | — | — | — | — |
| LNU665 | 71082.4 | — | — | — | 1968.8 | 0.23 | 12 | 11.9 | 0.29 | 6 |
| LNU663 | 71071.3 | 161.2 | L | 24 | 2231.2 | L | 27 | — | — | — |
| LNU617 | 70293.2 | 149.4 | 0.05 | 15 | 2012.5 | 0.22 | 15 | — | — | — |
| LNU617 | 70293.4 | — | — | — | — | — | — | 11.8 | 0.04 | 5 |
| LNU617 | 70295.2 | — | — | — | — | — | — | 11.8 | 0.04 | 5 |
| LNU596 | 72118.2 | 158.8 | 0.22 | 22 | — | — | — | — | — | — |
| LNU596 | 72120.2 | 157.5 | 0.05 | 21 | 2143.8 | 0.08 | 22 | — | — | — |
| LNU575 | 70253.4 | 155.6 | 0.04 | 19 | — | — | — | — | — | — |
| LNU575 | 70254.1 | 150.0 | 0.25 | 15 | — | — | — | — | — | — |
| LNU575 | 70255.1 | 152.5 | 0.25 | 17 | 2081.2 | 0.01 | 19 | — | — | — |
| LNU568 | 70846.3 | 155.0 | 0.18 | 19 | 2181.2 | 0.02 | 24 | — | — | — |
| LNU557 | 71400.4 | 152.5 | L | 17 | — | — | — | — | — | — |
| LNU557 | 71402.2 | 151.9 | L | 17 | — | — | — | — | — | — |
| LNU548 | 70569.4 | 158.2 | 0.24 | 21 | 1995.5 | 0.27 | 14 | — | — | — |
| LNU526 | 70814.3 | 152.5 | 0.08 | 17 | 2068.8 | 0.04 | 18 | 11.6 | 0.04 | 3 |
| LNU526 | 70819.4 | 149.3 | 0.23 | 15 | 1956.2 | 0.08 | 12 | — | — | — |
| CONT. | — | 130.3 | — | — | 1752.4 | — | — | 11.2 | — | — |
| LNU658 | 70683.2 | 85.6 | 0.18 | 15 | — | — | — | — | — | — |
| LNU647 | 70587.2 | 77.5 | 0.29 | 4 | — | — | — | — | — | — |
| LNU647 | 70589.8 | 77.5 | 0.29 | 4 | 1043.8 | 0.26 | 6 | — | — | — |
| LNU644 | 70332.2 | 79.4 | 0.19 | 6 | — | — | — | — | — | — |
| LNU643 | 70322.1 | — | — | — | 1050.0 | 0.24 | 7 | — | — | — |
| LNU643 | 70323.1 | 90.0 | 0.02 | 21 | 1200.0 | 0.28 | 22 | — | — | — |
| LNU643 | 70325.6 | — | — | — | 1056.2 | 0.24 | 7 | — | — | — |
| LNU643 | 70326.5 | — | — | — | 1087.5 | 0.15 | 10 | — | — | — |
| LNU642 | 70582.5 | 91.2 | L | 22 | 1243.8 | 0.13 | 26 | — | — | — |
| LNU642 | 70583.1 | 78.1 | 0.21 | 5 | — | — | — | — | — | — |

TABLE 91-continued

Genes showing improved plant biomass production at standard nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU617 | 70295.2 | 81.6 | 0.30 | 9 | — | — | — | — | — | — |
| LNU606 | 70289.1 | 90.8 | 0.27 | 22 | 1171.4 | 0.17 | 19 | — | — | — |
| LNU606 | 70290.3 | 85.0 | 0.15 | 14 | — | — | — | — | — | — |
| LNU592 | 70268.1 | — | — | — | — | — | — | 10.3 | 0.23 | 7 |
| LNU590 | 70263.3 | — | — | — | 1087.5 | 0.23 | 10 | — | — | — |
| LNU590 | 70267.5 | 86.9 | 0.07 | 16 | — | — | — | — | — | — |
| LNU575 | 70253.3 | 88.1 | L | 18 | 1181.2 | 0.29 | 20 | — | — | — |
| LNU570 | 70577.1 | — | — | — | 1062.5 | 0.17 | 8 | — | — | — |
| LNU558 | 70467.3 | 80.0 | 0.09 | 7 | — | — | — | — | — | — |
| LNU558 | 70470.5 | 85.0 | 0.15 | 14 | 1162.5 | 0.25 | 18 | — | — | — |
| LNU554 | 70481.1 | — | — | — | 1131.2 | 0.02 | 15 | 10.3 | L | 7 |
| LNU554 | 70481.2 | 97.0 | 0.21 | 30 | 1275.0 | 0.23 | 29 | — | — | — |
| LNU554 | 70482.4 | 95.6 | 0.21 | 28 | — | — | — | — | — | — |
| LNU534 | 70501.1 | 81.7 | 0.06 | 9 | — | — | — | — | — | — |
| LNU531 | 70209.4 | 90.6 | 0.11 | 21 | 1250.0 | 0.22 | 27 | — | — | — |
| LNU531 | 70210.1 | 89.4 | L | 20 | 1131.2 | 0.16 | 15 | — | — | — |
| LNU531 | 70211.1 | 81.9 | 0.03 | 10 | 1062.5 | 0.13 | 8 | — | — | — |
| LNU531 | 70211.3 | — | — | — | — | — | — | 10.6 | 0.19 | 10 |
| LNU531 | 70212.2 | 85.6 | L | 15 | 1075.0 | 0.28 | 9 | — | — | — |
| CONT. | — | 74.6 | — | — | 985.7 | — | — | 9.6 | — | — |
| LNU745 | 70911.1 | — | — | — | — | — | — | 9.1 | L | 5 |
| LNU745 | 70912.3 | 289.4 | L | 18 | 3487.5 | 0.06 | 12 | — | — | — |
| LNU745 | 70912.4 | — | — | — | — | — | — | 9.2 | 0.20 | 5 |
| LNU724 | 71510.1 | — | — | — | — | — | — | 9.1 | 0.02 | 4 |
| LNU724 | 71513.2 | 268.8 | 0.11 | 10 | — | — | — | 8.9 | 0.09 | 3 |
| LNU723 | 71191.2 | 303.1 | 0.10 | 24 | — | — | — | — | — | — |
| LNU707 | 71788.5 | — | — | — | — | — | — | 9.0 | 0.20 | 3 |
| LNU707 | 71789.2 | — | — | — | — | — | — | 9.1 | L | 5 |
| LNU707 | 71789.3 | — | — | — | — | — | — | 8.9 | 0.09 | 3 |
| LNU684 | 71637.1 | 275.0 | 0.05 | 12 | 3312.5 | 0.27 | 6 | 9.5 | 0.17 | 9 |
| LNU684 | 71639.5 | — | — | — | — | — | — | 9.1 | 0.02 | 4 |
| LNU660 | 71065.2 | — | — | — | — | — | — | 9.0 | 0.20 | 3 |
| LNU660 | 71069.5 | — | — | — | — | — | — | 9.0 | 0.02 | 3 |
| LNU655 | 72291.4 | — | — | — | — | — | — | 8.9 | 0.09 | 3 |
| LNU655 | 72292.1 | — | — | — | 3367.0 | 0.23 | 8 | — | — | — |
| LNU625 | 70964.2 | 302.8 | 0.17 | 23 | 3332.1 | 0.26 | 7 | — | — | — |
| LNU625 | 70966.3 | 265.0 | 0.18 | 8 | — | — | — | — | — | — |
| LNU612 | 71334.4 | — | — | — | — | — | — | 9.2 | L | 5 |
| LNU612 | 71335.4 | — | — | — | 3400.0 | 0.12 | 9 | 9.1 | 0.02 | 4 |
| LNU612 | 71336.4 | 278.8 | 0.03 | 14 | 3387.5 | 0.18 | 9 | 9.5 | 0.03 | 9 |
| LNU605 | 71352.2 | — | — | — | — | — | — | 9.1 | 0.28 | 4 |
| LNU605 | 71356.2 | 261.2 | 0.22 | 6 | 3425.0 | 0.11 | 10 | — | — | — |
| LNU605 | 71357.2 | — | — | — | 3381.2 | 0.23 | 9 | — | — | — |
| LNU597 | 72369.3 | 260.0 | 0.27 | 6 | — | — | — | — | — | — |
| LNU593 | 71848.2 | — | — | — | — | — | — | 9.7 | 0.18 | 11 |
| LNU572 | 71406.2 | 279.6 | 0.03 | 14 | 3396.4 | 0.28 | 9 | — | — | — |
| LNU572 | 71407.1 | — | — | — | — | — | — | 8.9 | 0.11 | 2 |
| LNU571 | 71838.4 | — | — | — | — | — | — | 9.3 | L | 7 |
| LNU571 | 71839.2 | — | — | — | 3331.2 | 0.30 | 7 | 9.3 | L | 7 |
| LNU571 | 71842.1 | 283.2 | 0.23 | 15 | 3394.6 | 0.13 | 9 | — | — | — |
| LNU566 | 71837.1 | 282.5 | 0.14 | 15 | 3406.2 | 0.14 | 9 | 9.5 | 0.17 | 9 |
| LNU556 | 72364.2 | 276.2 | 0.04 | 13 | 3518.8 | 0.05 | 13 | 8.9 | 0.09 | 3 |
| LNU531 | 70209.4 | — | — | — | — | — | — | 9.0 | 0.20 | 3 |
| LNU531 | 70211.1 | — | — | — | — | — | — | 9.4 | 0.20 | 8 |
| LNU531 | 70211.3 | — | — | — | 3331.2 | 0.22 | 7 | 9.1 | 0.11 | 5 |
| CONT. | — | 245.4 | — | — | 3112.5 | — | — | 8.7 | — | — |
| LNU747 | 70618.1 | — | — | — | — | — | — | 10.2 | 0.15 | 5 |
| LNU697 | 70700.3 | — | — | — | 962.5 | 0.26 | 6 | — | — | — |
| LNU697 | 70702.4 | — | — | — | 985.4 | 0.07 | 8 | — | — | — |
| LNU673 | 70394.1 | 95.6 | 0.25 | 22 | — | — | — | 10.4 | 0.29 | 7 |
| LNU673 | 70395.1 | 87.5 | 0.18 | 11 | 1093.8 | 0.02 | 20 | — | — | — |
| LNU673 | 70398.2 | 84.4 | 0.15 | 7 | — | — | — | — | — | — |
| LNU669 | 70393.2 | 93.1 | L | 18 | — | — | — | — | — | — |
| LNU653 | 70659.2 | — | — | — | 1031.2 | 0.02 | 13 | — | — | — |
| LNU651 | 70666.1 | 84.4 | 0.27 | 7 | — | — | — | — | — | — |
| LNU651 | 70666.6 | 88.1 | 0.03 | 12 | — | — | — | 10.4 | 0.08 | 8 |
| LNU651 | 70668.1 | 91.2 | L | 16 | 1056.2 | L | 16 | — | — | — |
| LNU650 | 70878.2 | — | — | — | — | — | — | 9.9 | 0.10 | 3 |
| LNU650 | 70879.2 | 91.9 | 0.27 | 17 | — | — | — | — | — | — |
| LNU630 | 70864.2 | 93.8 | 0.26 | 19 | — | — | — | — | — | — |
| LNU630 | 70867.3 | — | — | — | — | — | — | 10.0 | 0.04 | 3 |
| LNU623 | 71007.2 | 101.2 | L | 29 | — | — | — | 10.2 | L | 5 |

TABLE 91-continued

Genes showing improved plant biomass production at standard nitrogen growth conditions

| Gene Name | Event # | Dry Weight [mg] Ave. | P-Val. | % Incr. | Fresh Weight [mg] Ave. | P-Val. | % Incr. | Leaf Number Ave. | P-Val. | % Incr. |
|---|---|---|---|---|---|---|---|---|---|---|
| LNU623 | 71007.4 | 90.0 | 0.15 | 15 | 1092.9 | 0.15 | 20 | 10.5 | 0.01 | 8 |
| LNU614 | 70726.6 | — | — | — | — | — | — | 10.1 | 0.03 | 4 |
| LNU610 | 70782.2 | — | — | — | 1156.2 | 0.16 | 27 | 10.2 | 0.22 | 6 |
| LNU610 | 70783.3 | — | — | — | — | — | — | 10.1 | 0.03 | 4 |
| LNU563 | 70987.3 | 97.9 | L | 25 | 1091.1 | 0.02 | 20 | 10.2 | L | 6 |
| LNU563 | 70987.5 | — | — | — | 1137.5 | 0.20 | 25 | 9.9 | 0.16 | 2 |
| LNU563 | 70990.1 | 84.4 | 0.15 | 7 | — | — | — | — | — | — |
| LNU547 | 70970.2 | 90.0 | 0.12 | 15 | — | — | — | — | — | — |
| LNU547 | 70971.4 | 91.2 | L | 16 | 1086.6 | L | 20 | — | — | — |
| LNU547 | 70972.1 | — | — | — | — | — | — | 10.2 | 0.04 | 6 |
| LNU540 | 70984.4 | 103.5 | L | 32 | 1065.2 | L | 17 | — | — | — |
| LNU540 | 70984.7 | 83.8 | 0.15 | 7 | — | — | — | — | — | — |
| LNU540 | 70986.1 | 86.9 | 0.25 | 11 | 1006.3 | 0.03 | 11 | 10.2 | 0.22 | 6 |
| LNU528 | 70565.2 | 95.6 | 0.25 | 22 | — | — | — | — | — | — |
| LNU528 | 70566.8 | 84.4 | 0.10 | 7 | 987.5 | 0.12 | 9 | — | — | — |
| LNU527 | 70977.2 | — | — | — | — | — | — | 10.5 | 0.13 | 8 |
| LNU527 | 70978.4 | — | — | — | — | — | — | 10.6 | L | 10 |
| LNU527 | 70980.5 | 101.2 | 0.07 | 29 | 1125.0 | 0.02 | 24 | 10.5 | 0.25 | 8 |
| CONT. | — | 78.6 | — | — | 908.9 | — | — | 9.7 | — | — |
| LNU716 | 70760.4 | 128.1 | 0.19 | 11 | 1856.2 | 0.23 | 6 | — | — | — |
| LNU716 | 70760.8 | 146.9 | 0.13 | 27 | 2225.0 | 0.02 | 27 | — | — | — |
| LNU716 | 70762.2 | 136.2 | L | 18 | 1918.8 | 0.12 | 10 | — | — | — |
| LNU683 | 71298.2 | — | — | — | — | — | — | 10.4 | 0.17 | 4 |
| LNU682 | 71432.5 | — | — | — | — | — | — | 10.4 | 0.26 | 4 |
| LNU670 | 71088.7 | — | — | — | 1912.5 | 0.25 | 10 | — | — | — |
| LNU668 | 71415.1 | 129.4 | 0.03 | 12 | 1900.0 | 0.13 | 9 | 10.8 | 0.06 | 8 |
| LNU668 | 71415.5 | — | — | — | 1975.0 | 0.03 | 13 | 10.9 | 0.02 | 8 |
| LNU658 | 70683.2 | 141.2 | 0.10 | 22 | — | — | — | — | — | — |
| LNU658 | 70684.3 | 130.0 | 0.06 | 13 | — | — | — | — | — | — |
| LNU647 | 70587.2 | 122.5 | 0.19 | 6 | — | — | — | — | — | — |
| LNU647 | 70589.6 | 125.0 | 0.09 | 8 | 1925.0 | 0.05 | 10 | — | — | — |
| LNU647 | 70589.8 | — | — | — | 1925.0 | 0.05 | 10 | — | — | — |
| LNU646 | 72148.5 | 125.0 | 0.09 | 8 | — | — | — | — | — | — |
| LNU646 | 72150.4 | 130.6 | 0.02 | 13 | 1950.0 | 0.04 | 12 | — | — | — |
| LNU644 | 70329.2 | 129.4 | 0.05 | 12 | 1862.5 | 0.19 | 7 | — | — | — |
| LNU643 | 70323.1 | 141.2 | 0.03 | 22 | 2137.5 | 0.01 | 22 | 10.8 | 0.02 | 8 |
| LNU643 | 70325.2 | 124.4 | 0.24 | 8 | 1906.2 | 0.07 | 9 | — | — | — |
| LNU643 | 70325.6 | 136.9 | 0.29 | 19 | 1925.0 | 0.23 | 10 | — | — | — |
| LNU620 | 70299.2 | 131.2 | 0.10 | 14 | 1956.2 | 0.24 | 12 | — | — | — |
| LNU620 | 70300.2 | 136.2 | 0.02 | 18 | — | — | — | — | — | — |
| LNU620 | 70302.3 | — | — | — | 1837.5 | 0.25 | 5 | — | — | — |
| LNU620 | 70303.4 | — | — | — | — | — | — | 10.6 | 0.08 | 6 |
| LNU606 | 70289.1 | 135.6 | 0.08 | 18 | 1947.3 | 0.20 | 12 | 10.4 | 0.23 | 3 |
| LNU606 | 70289.2 | — | — | — | 1868.8 | 0.14 | 7 | 10.4 | 0.26 | 4 |
| LNU606 | 70290.2 | — | — | — | 1875.0 | 0.30 | 7 | 10.4 | 0.27 | 3 |
| LNU606 | 70290.3 | 134.4 | L | 17 | 2006.2 | 0.01 | 15 | — | — | — |
| LNU604 | 70280.3 | 132.5 | 0.08 | 15 | 1993.8 | 0.02 | 14 | 10.6 | 0.08 | 5 |
| LNU604 | 70284.1 | — | — | — | 1900.0 | 0.08 | 9 | — | — | — |
| LNU604 | 70285.2 | 132.5 | 0.02 | 15 | 2050.0 | 0.09 | 17 | 10.6 | 0.08 | 5 |
| LNU596 | 72118.2 | 142.5 | 0.10 | 24 | 1906.2 | 0.07 | 9 | — | — | — |
| LNU596 | 72119.1 | — | — | — | 1850.0 | 0.21 | 6 | — | — | — |
| LNU596 | 72120.2 | 125.6 | 0.09 | 9 | 1837.5 | 0.30 | 5 | — | — | — |
| LNU596 | 72120.4 | 122.5 | 0.20 | 6 | — | — | — | — | — | — |
| LNU592 | 70268.1 | — | — | — | — | — | — | 11.0 | L | 10 |
| LNU592 | 70270.1 | 140.6 | L | 22 | 2062.5 | 0.08 | 18 | 10.5 | 0.12 | 5 |
| LNU592 | 70272.2 | 131.2 | 0.02 | 14 | 1887.5 | 0.16 | 8 | — | — | — |
| LNU569 | 72152.3 | — | — | — | 1987.5 | 0.04 | 14 | — | — | — |
| CONT. | — | 115.3 | — | — | 1745.9 | — | — | 10.0 | — | — |
| LNU744 | 71485.1 | 155.6 | L | 24 | 1956.2 | L | 22 | 9.7 | 0.01 | 6 |
| LNU744 | 71485.5 | 136.9 | 0.14 | 9 | — | — | — | — | — | — |
| LNU744 | 71486.3 | — | — | — | 1800.0 | 0.26 | 12 | — | — | — |
| LNU744 | 71487.3 | 137.5 | 0.03 | 10 | 1689.3 | 0.20 | 6 | — | — | — |
| LNU738 | 71742.2 | 167.5 | 0.14 | 34 | 1968.8 | 0.22 | 23 | 9.4 | 0.28 | 3 |
| LNU738 | 71742.4 | 130.0 | 0.24 | 4 | — | — | — | — | — | — |
| LNU738 | 71743.2 | 137.9 | 0.01 | 10 | 1834.8 | 0.15 | 15 | 9.7 | 0.11 | 6 |
| LNU738 | 71745.3 | 135.0 | 0.24 | 8 | 1700.0 | 0.05 | 6 | — | — | — |
| LNU727 | 71671.4 | 136.9 | 0.23 | 9 | 1756.2 | 0.14 | 10 | — | — | — |
| LNU727 | 71674.1 | 158.8 | 0.02 | 27 | 1912.5 | 0.12 | 20 | — | — | — |
| LNU727 | 71674.5 | 132.8 | 0.10 | 6 | 1744.6 | 0.03 | 9 | 9.4 | 0.12 | 3 |
| LNU727 | 71675.4 | 139.4 | L | 11 | — | — | — | — | — | — |
| LNU720 | 71754.3 | 143.8 | 0.08 | 15 | 1843.8 | 0.11 | 15 | — | — | — |
| LNU720 | 71756.1 | 139.4 | 0.10 | 11 | 1768.8 | L | 11 | — | — | — |

TABLE 91-continued

Genes showing improved plant biomass production at standard nitrogen growth conditions

| Gene Name | Event # | Dry Weight [mg] Ave. | P-Val. | % Incr. | Fresh Weight [mg] Ave. | P-Val. | % Incr. | Leaf Number Ave. | P-Val. | % Incr. |
|---|---|---|---|---|---|---|---|---|---|---|
| LNU707 | 71788.2 | 142.5 | 0.21 | 14 | 1906.2 | L | 19 | — | — | — |
| LNU707 | 71788.5 | 135.0 | 0.24 | 8 | — | — | — | — | — | — |
| LNU707 | 71789.3 | 150.6 | L | 20 | 1868.8 | 0.13 | 17 | 9.9 | 0.05 | 9 |
| LNU692 | 71483.3 | 140.0 | 0.26 | 12 | 1743.8 | 0.29 | 9 | — | — | — |
| LNU691 | 71439.2 | 133.1 | 0.10 | 6 | — | — | — | — | — | — |
| LNU691 | 71441.2 | 141.2 | 0.05 | 13 | 1818.8 | L | 14 | — | — | — |
| LNU684 | 71635.5 | 163.1 | 0.09 | 30 | 1893.8 | 0.04 | 18 | — | — | — |
| LNU684 | 71639.3 | 148.1 | L | 18 | 1987.5 | L | 24 | — | — | — |
| LNU684 | 71639.5 | — | — | — | — | — | — | 9.8 | 0.17 | 7 |
| LNU660 | 71065.4 | 142.5 | 0.04 | 14 | 1775.0 | L | 11 | — | — | — |
| LNU660 | 71069.5 | 141.2 | 0.01 | 13 | 1750.0 | 0.12 | 9 | — | — | — |
| LNU660 | 71070.1 | 140.6 | 0.15 | 12 | — | — | — | — | — | — |
| LNU619 | 71358.4 | 137.5 | 0.03 | 10 | 1800.0 | L | 12 | — | — | — |
| LNU598 | 71777.3 | 156.2 | L | 25 | 1931.2 | 0.01 | 21 | 9.6 | 0.18 | 5 |
| LNU594 | 71738.4 | — | — | — | — | — | — | 9.8 | 0.07 | 8 |
| LNU594 | 71739.3 | 169.4 | L | 35 | 2100.0 | 0.04 | 31 | — | — | — |
| LNU584 | 71748.2 | 146.1 | 0.29 | 17 | 1903.6 | 0.03 | 19 | 9.6 | 0.18 | 5 |
| LNU584 | 71751.1 | 146.2 | 0.06 | 17 | 1900.0 | 0.20 | 19 | 9.9 | 0.29 | 9 |
| LNU576 | 71659.3 | 135.8 | 0.08 | 8 | 1743.8 | 0.09 | 9 | — | — | — |
| LNU576 | 71662.5 | 153.1 | 0.20 | 22 | 1881.2 | L | 18 | 9.9 | 0.26 | 8 |
| LNU561 | 71346.8 | 143.1 | L | 14 | — | — | — | 10.2 | 0.29 | 12 |
| LNU561 | 71349.1 | 133.8 | 0.29 | 7 | — | — | — | — | — | — |
| LNU555 | 71655.3 | 150.6 | 0.11 | 20 | 1925.0 | 0.15 | 20 | 9.4 | 0.12 | 3 |
| LNU555 | 71655.4 | — | — | — | — | — | — | 9.4 | 0.28 | 3 |
| LNU555 | 71656.5 | 140.6 | 0.27 | 12 | 1743.8 | 0.23 | 9 | — | — | — |
| LNU523 | 71604.5 | 148.8 | 0.05 | 19 | 1843.8 | L | 15 | — | — | — |
| LNU523 | 71605.6 | — | — | — | — | — | — | 9.8 | L | 8 |
| CONT. | — | 125.2 | — | — | 1600.0 | — | — | 9.1 | — | — |

Table 91. "CONT."—Control "Ave."—Average; "% Incr." = % increment; "p-val."—p-value; L means that p-value is less than 0.01, p < 0.1 was considered as significant.

TABLE 92

Genes showing improved plant biomass production at standard nitrogen growth conditions

| Gene Name | Event # | Plot Coverage [cm²] Ave. | P-Val. | % Incr. | Rosette Area [cm²] Ave. | P-Val. | % Incr. | Rosette Diameter [cm] Ave. | P-Val. | % Incr. |
|---|---|---|---|---|---|---|---|---|---|---|
| LNU745 | 70911.4 | 66.0 | 0.20 | 24 | 8.2 | 0.23 | 22 | — | — | — |
| LNU724 | 71510.1 | 63.7 | 0.02 | 20 | 8.0 | 0.03 | 18 | 4.9 | 0.23 | 8 |
| LNU724 | 71513.2 | 64.0 | 0.08 | 21 | 8.0 | 0.10 | 18 | 4.8 | 0.13 | 7 |
| LNU722 | 71185.3 | 62.9 | 0.15 | 19 | 7.9 | 0.18 | 16 | — | — | — |
| LNU722 | 71188.2 | 58.0 | 0.25 | 9 | — | — | — | — | — | — |
| LNU716 | 70760.7 | 57.4 | 0.24 | 8 | — | — | — | — | — | — |
| LNU716 | 70760.8 | 58.1 | 0.19 | 9 | 7.3 | 0.25 | 7 | — | — | — |
| LNU716 | 70761.5 | 60.5 | 0.07 | 14 | 7.6 | 0.08 | 12 | 4.7 | 0.23 | 5 |
| LNU683 | 71294.2 | 73.1 | 0.02 | 38 | 9.1 | 0.02 | 35 | 5.2 | L | 15 |
| LNU683 | 71298.1 | 64.0 | 0.02 | 21 | 8.0 | 0.03 | 18 | 4.7 | 0.26 | 4 |
| LNU656 | 71384.5 | 57.9 | 0.21 | 9 | 7.2 | 0.28 | 7 | — | — | — |
| LNU656 | 71385.1 | 64.5 | 0.28 | 21 | — | — | — | — | — | — |
| LNU655 | 72292.1 | 65.1 | 0.12 | 23 | 8.1 | 0.14 | 20 | 5.0 | 0.18 | 11 |
| LNU577 | 72121.2 | 62.2 | 0.06 | 17 | 7.8 | 0.08 | 15 | 4.8 | 0.28 | 6 |
| LNU554 | 70478.1 | 61.8 | 0.24 | 16 | 7.7 | 0.28 | 14 | — | — | — |
| LNU554 | 70481.2 | 58.8 | 0.14 | 11 | 7.3 | 0.19 | 9 | 4.8 | 0.17 | 6 |
| LNU532 | 70556.4 | 60.9 | 0.10 | 15 | 7.6 | 0.13 | 13 | — | — | — |
| CONT. | — | 53.1 | — | — | 6.8 | — | — | 4.5 | — | — |
| LNU721 | 70613.1 | 72.0 | 0.06 | 14 | 9.0 | 0.06 | 14 | 5.0 | 0.08 | 6 |
| LNU721 | 70613.4 | 73.8 | 0.04 | 16 | 9.2 | 0.04 | 16 | 5.1 | 0.03 | 9 |
| LNU721 | 70614.3 | 73.5 | 0.22 | 16 | 9.2 | 0.22 | 16 | 5.0 | 0.22 | 6 |
| LNU675 | 70402.1 | 68.0 | 0.26 | 7 | 8.5 | 0.26 | 7 | — | — | — |
| LNU675 | 70405.3 | — | — | — | — | — | — | 5.3 | 0.27 | 11 |
| LNU656 | 71384.2 | 105.1 | 0.18 | 66 | 13.1 | 0.18 | 66 | 6.0 | 0.12 | 27 |
| LNU656 | 71384.3 | 76.4 | 0.05 | 21 | 9.5 | 0.05 | 21 | 5.2 | 0.04 | 9 |
| LNU656 | 71385.1 | 94.8 | L | 50 | 11.8 | L | 50 | 5.9 | L | 26 |
| LNU641 | 70628.3 | 81.2 | 0.01 | 28 | 10.2 | 0.01 | 28 | 5.3 | L | 13 |
| LNU625 | 70965.4 | 77.8 | 0.06 | 23 | 9.7 | 0.06 | 23 | 5.2 | 0.12 | 11 |

TABLE 92-continued

Genes showing improved plant biomass production at standard nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU612 | 71334.3 | 75.1 | 0.02 | 18 | 9.4 | 0.02 | 18 | 5.1 | 0.09 | 7 |
| LNU612 | 71335.1 | 72.4 | 0.17 | 14 | 9.1 | 0.17 | 14 | 5.2 | 0.16 | 10 |
| LNU600 | 70484.5 | 73.3 | 0.15 | 16 | 9.2 | 0.15 | 16 | 5.0 | 0.15 | 6 |
| LNU600 | 70486.2 | 68.5 | 0.30 | 8 | 8.6 | 0.30 | 8 | — | — | — |
| LNU600 | 70486.4 | 74.2 | 0.03 | 17 | 9.3 | 0.03 | 17 | 5.3 | 0.10 | 11 |
| LNU600 | 70488.1 | 92.9 | 0.01 | 47 | 11.6 | 0.01 | 47 | 5.7 | L | 21 |
| LNU593 | 71844.3 | 79.3 | 0.05 | 25 | 9.9 | 0.05 | 25 | 5.2 | 0.14 | 11 |
| LNU593 | 71848.2 | 75.9 | 0.21 | 20 | 9.5 | 0.21 | 20 | 5.1 | 0.08 | 7 |
| LNU593 | 71848.5 | 82.7 | 0.26 | 31 | 10.3 | 0.26 | 31 | 5.5 | 0.10 | 16 |
| LNU593 | 71849.1 | 82.4 | L | 30 | 10.3 | L | 30 | 5.4 | L | 14 |
| LNU587 | 70378.1 | 80.8 | 0.19 | 28 | 10.1 | 0.19 | 28 | 5.4 | 0.09 | 14 |
| LNU587 | 70379.3 | 84.4 | 0.14 | 33 | 10.6 | 0.14 | 33 | 5.5 | 0.03 | 15 |
| LNU587 | 70380.5 | 102.6 | 0.21 | 62 | 12.8 | 0.21 | 62 | 5.9 | 0.20 | 25 |
| LNU587 | 70381.1 | 76.8 | 0.01 | 21 | 9.6 | 0.01 | 21 | 5.1 | 0.03 | 9 |
| LNU582 | 70256.1 | 89.1 | L | 41 | 11.1 | L | 41 | 5.6 | L | 19 |
| LNU572 | 71406.2 | 81.0 | L | 28 | 10.1 | L | 28 | 5.3 | L | 13 |
| LNU571 | 71839.2 | — | — | — | — | — | — | 5.1 | 0.26 | 7 |
| LNU571 | 71842.1 | 90.7 | 0.10 | 43 | 11.3 | 0.10 | 43 | 5.6 | 0.22 | 18 |
| LNU566 | 71834.2 | 70.5 | 0.10 | 11 | 8.8 | 0.10 | 11 | 5.0 | 0.13 | 6 |
| LNU566 | 71834.3 | 86.8 | L | 37 | 10.9 | L | 37 | 5.4 | L | 14 |
| LNU560 | 70241.4 | 85.8 | 0.19 | 36 | 10.7 | 0.19 | 36 | 5.4 | 0.20 | 13 |
| LNU560 | 70243.3 | 89.1 | L | 41 | 11.1 | L | 41 | 5.5 | L | 17 |
| LNU553 | 70370.1 | 89.1 | 0.07 | 41 | 11.1 | 0.07 | 41 | 5.6 | L | 18 |
| LNU553 | 70370.2 | 75.3 | 0.18 | 19 | 9.4 | 0.18 | 19 | 5.2 | 0.18 | 9 |
| LNU553 | 70373.1 | 81.3 | L | 28 | 10.2 | L | 28 | 5.4 | L | 13 |
| LNU530 | 70203.2 | 74.7 | 0.02 | 18 | 9.3 | 0.02 | 18 | 5.1 | 0.07 | 8 |
| LNU530 | 70203.3 | — | — | — | — | — | — | 5.2 | 0.23 | 10 |
| LNU530 | 70207.4 | 91.6 | 0.05 | 45 | 11.5 | 0.05 | 45 | 5.6 | 0.05 | 19 |
| CONT. | — | 63.3 | — | — | 7.9 | — | — | 4.7 | — | — |
| LNU738 | 71743.2 | 52.9 | 0.18 | 10 | 6.6 | 0.17 | 9 | 4.6 | 0.05 | 6 |
| LNU738 | 71745.3 | — | — | — | — | — | — | 4.5 | 0.16 | 4 |
| LNU720 | 71755.4 | 54.6 | 0.10 | 14 | 6.8 | 0.10 | 12 | 4.7 | L | 9 |
| LNU720 | 71756.2 | 64.1 | 0.09 | 33 | 8.0 | 0.11 | 32 | 5.0 | 0.09 | 16 |
| LNU661 | 72705.6 | 53.9 | 0.21 | 12 | 6.7 | 0.24 | 11 | — | — | — |
| LNU661 | 72707.2 | 59.6 | 0.13 | 24 | 7.4 | 0.15 | 22 | 4.7 | 0.15 | 10 |
| LNU618 | 72133.2 | 64.6 | L | 34 | 8.1 | 0.01 | 33 | 5.0 | 0.04 | 16 |
| LNU618 | 72135.3 | 57.5 | 0.09 | 20 | 7.2 | 0.11 | 18 | 4.7 | 0.01 | 9 |
| LNU618 | 72138.1 | 59.8 | 0.12 | 24 | 7.5 | 0.15 | 23 | 4.7 | 0.25 | 11 |
| LNU594 | 71739.1 | 55.8 | 0.05 | 16 | 7.0 | 0.03 | 15 | 4.6 | 0.02 | 8 |
| LNU594 | 71740.3 | 53.4 | 0.25 | 11 | 6.7 | 0.28 | 10 | 4.6 | 0.07 | 8 |
| LNU594 | 71741.2 | 53.7 | 0.16 | 12 | 6.7 | 0.16 | 10 | 4.5 | 0.10 | 5 |
| LNU584 | 71748.2 | 53.8 | 0.12 | 12 | 6.7 | 0.10 | 10 | 4.5 | 0.18 | 4 |
| LNU584 | 71748.4 | 52.8 | 0.19 | 10 | 6.6 | 0.18 | 8 | — | — | — |
| LNU576 | 71658.1 | 57.4 | 0.02 | 20 | 7.2 | 0.02 | 18 | 4.7 | 0.10 | 10 |
| LNU576 | 71659.3 | 57.8 | 0.03 | 20 | 7.2 | 0.02 | 19 | 4.7 | 0.01 | 10 |
| LNU576 | 71662.3 | 62.7 | 0.19 | 30 | 7.8 | 0.22 | 29 | 4.9 | 0.26 | 13 |
| LNU576 | 71662.5 | 59.2 | 0.18 | 23 | 7.4 | 0.21 | 22 | 4.8 | 0.01 | 11 |
| LNU559 | 70835.1 | 53.4 | 0.14 | 11 | 6.7 | 0.12 | 10 | 4.5 | 0.17 | 4 |
| LNU555 | 71655.2 | 54.7 | 0.25 | 14 | 6.8 | 0.28 | 12 | — | — | — |
| LNU555 | 71655.4 | 67.0 | 0.02 | 39 | 8.4 | 0.03 | 38 | 5.1 | L | 19 |
| LNU555 | 71656.5 | 57.9 | 0.20 | 20 | 7.2 | 0.23 | 19 | — | — | — |
| LNU547 | 70971.1 | 54.9 | 0.11 | 14 | 6.9 | 0.10 | 13 | 4.5 | 0.08 | 6 |
| LNU540 | 70984.4 | 58.1 | 0.02 | 21 | 7.3 | 0.01 | 19 | 4.8 | 0.08 | 11 |
| LNU540 | 70985.2 | — | — | — | — | — | — | 4.4 | 0.25 | 3 |
| LNU527 | 70980.3 | 54.5 | 0.16 | 13 | 6.8 | 0.17 | 12 | 4.6 | 0.02 | 8 |
| LNU523 | 71605.4 | 56.0 | 0.05 | 16 | 7.0 | 0.03 | 15 | 4.8 | L | 12 |
| CONT. | — | 48.1 | — | — | 6.1 | — | — | 4.3 | — | — |
| LNU736 | 71235.4 | 100.5 | 0.29 | 17 | 12.6 | 0.29 | 17 | — | — | — |
| LNU698 | 70883.1 | — | — | — | — | — | — | 6.0 | 0.08 | 5 |
| LNU698 | 70883.3 | 96.8 | 0.28 | 13 | 12.1 | 0.28 | 13 | 6.2 | 0.30 | 9 |
| LNU677 | 71105.1 | 95.0 | 0.03 | 11 | 11.9 | 0.03 | 11 | 6.1 | 0.09 | 7 |
| LNU666 | 71388.2 | 106.1 | 0.02 | 24 | 13.3 | 0.02 | 24 | 6.5 | L | 15 |
| LNU665 | 71082.4 | 100.1 | 0.16 | 17 | 12.5 | 0.16 | 17 | 6.0 | 0.07 | 6 |
| LNU663 | 71071.3 | 109.8 | L | 28 | 13.7 | L | 28 | 6.5 | L | 15 |
| LNU663 | 71071.6 | 98.6 | 0.29 | 15 | 12.3 | 0.29 | 15 | — | — | — |
| LNU663 | 71072.5 | 93.5 | 0.10 | 9 | 11.7 | 0.10 | 9 | 6.0 | 0.05 | 6 |
| LNU617 | 70293.2 | 97.2 | 0.03 | 14 | 12.2 | 0.03 | 14 | 6.0 | 0.06 | 6 |
| LNU617 | 70293.6 | 103.5 | 0.25 | 21 | 12.9 | 0.25 | 21 | 6.4 | 0.15 | 13 |
| LNU596 | 72120.2 | 111.9 | 0.02 | 31 | 14.0 | 0.02 | 31 | 6.7 | 0.07 | 19 |
| LNU575 | 70254.1 | 100.5 | 0.08 | 17 | 12.6 | 0.08 | 17 | — | — | — |
| LNU575 | 70255.1 | 99.6 | L | 16 | 12.5 | L | 16 | 6.3 | 0.17 | 12 |

TABLE 92-continued

Genes showing improved plant biomass production at standard nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU568 | 70846.3 | 107.5 | L | 26 | 13.4 | L | 26 | 6.5 | L | 15 |
| LNU526 | 70814.3 | 98.6 | 0.24 | 15 | 12.3 | 0.24 | 15 | 6.3 | 0.08 | 11 |
| LNU526 | 70819.2 | — | — | — | — | — | — | 6.3 | 0.12 | 11 |
| CONT. | — | 85.6 | — | — | 10.7 | — | — | 5.7 | — | — |
| LNU658 | 70683.2 | 55.7 | 0.17 | 7 | 7.0 | 0.17 | 7 | 4.7 | 0.29 | 3 |
| LNU642 | 70582.5 | 62.4 | 0.03 | 20 | 7.8 | 0.03 | 20 | 4.8 | 0.04 | 6 |
| LNU590 | 70263.3 | 59.1 | 0.03 | 14 | 7.4 | 0.03 | 14 | 4.9 | 0.02 | 7 |
| LNU575 | 70253.3 | 60.6 | 0.22 | 17 | 7.6 | 0.22 | 17 | 4.9 | 0.08 | 8 |
| LNU558 | 70470.5 | 60.2 | L | 16 | 7.5 | L | 16 | 4.9 | 0.02 | 7 |
| LNU554 | 70481.1 | 63.5 | L | 22 | 7.9 | L | 22 | 4.9 | 0.04 | 8 |
| LNU531 | 70209.4 | 66.1 | 0.21 | 27 | 8.3 | 0.21 | 27 | 5.0 | 0.23 | 10 |
| LNU531 | 70211.3 | 69.9 | 0.30 | 34 | 8.7 | 0.30 | 34 | — | — | — |
| CONT. | — | 52.0 | — | — | 6.5 | — | — | 4.6 | — | — |
| LNU745 | 70914.2 | 37.6 | 0.02 | 13 | 4.7 | 0.02 | 13 | 3.7 | 0.04 | 7 |
| LNU724 | 71510.1 | 36.8 | 0.27 | 11 | 4.6 | 0.27 | 11 | 3.7 | 0.20 | 6 |
| LNU724 | 71513.2 | 41.2 | L | 24 | 5.1 | L | 24 | 3.8 | L | 10 |
| LNU707 | 71789.2 | 39.4 | L | 19 | 4.9 | L | 19 | 3.8 | 0.02 | 8 |
| LNU684 | 71637.1 | 40.4 | 0.16 | 22 | 5.1 | 0.16 | 22 | 3.8 | 0.22 | 10 |
| LNU684 | 71639.5 | 36.1 | 0.08 | 9 | 4.5 | 0.08 | 9 | — | — | — |
| LNU625 | 70966.3 | 35.4 | 0.16 | 7 | 4.4 | 0.16 | 7 | — | — | — |
| LNU612 | 71335.4 | 43.3 | L | 30 | 5.4 | L | 30 | 4.0 | L | 16 |
| LNU612 | 71336.4 | 41.1 | L | 24 | 5.1 | L | 24 | 3.9 | L | 12 |
| LNU605 | 71352.2 | 37.7 | 0.23 | 13 | 4.7 | 0.23 | 13 | — | — | — |
| LNU597 | 72369.3 | 36.6 | 0.15 | 10 | 4.6 | 0.15 | 10 | 3.7 | 0.16 | 7 |
| LNU597 | 72369.4 | 38.5 | 0.02 | 16 | 4.8 | 0.02 | 16 | 3.7 | 0.06 | 6 |
| LNU571 | 71839.2 | 35.4 | 0.17 | 6 | 4.4 | 0.17 | 6 | 3.7 | 0.11 | 5 |
| LNU571 | 71842.1 | 38.1 | 0.27 | 15 | 4.8 | 0.27 | 15 | — | — | — |
| LNU566 | 71837.1 | 41.9 | 0.23 | 26 | 5.2 | 0.23 | 26 | 3.9 | 0.12 | 13 |
| LNU556 | 72364.2 | — | — | — | — | — | — | 3.8 | 0.21 | 8 |
| LNU531 | 70209.4 | 38.7 | 0.17 | 16 | 4.8 | 0.17 | 16 | 3.7 | 0.14 | 8 |
| LNU531 | 70211.3 | 39.7 | L | 19 | 5.0 | L | 19 | 3.8 | 0.02 | 8 |
| CONT. | — | 33.2 | — | — | 4.2 | — | — | 3.5 | — | — |
| LNU747 | 70616.2 | 54.1 | 0.30 | 5 | 6.8 | 0.30 | 5 | 4.6 | 0.14 | 4 |
| LNU747 | 70618.1 | 60.8 | 0.25 | 18 | 7.6 | 0.25 | 18 | 4.8 | 0.07 | 10 |
| LNU697 | 70700.3 | 54.4 | 0.18 | 6 | 6.8 | 0.18 | 6 | 4.5 | 0.25 | 3 |
| LNU697 | 70705.2 | 55.2 | 0.10 | 7 | 6.9 | 0.10 | 7 | 4.6 | 0.15 | 5 |
| LNU673 | 70394.1 | 68.6 | 0.21 | 33 | 8.6 | 0.21 | 33 | 5.0 | 0.27 | 14 |
| LNU673 | 70395.1 | 58.3 | 0.01 | 13 | 7.3 | 0.01 | 13 | 4.7 | 0.03 | 6 |
| LNU673 | 70395.5 | 55.1 | 0.12 | 7 | 6.9 | 0.12 | 7 | 4.6 | 0.29 | 4 |
| LNU673 | 70398.2 | 56.6 | 0.20 | 10 | 7.1 | 0.20 | 10 | — | — | — |
| LNU669 | 70393.2 | 56.3 | 0.21 | 10 | 7.0 | 0.21 | 10 | — | — | — |
| LNU653 | 70659.2 | 57.7 | 0.21 | 12 | 7.2 | 0.21 | 12 | 4.8 | 0.02 | 8 |
| LNU651 | 70664.2 | 57.4 | 0.11 | 12 | 7.2 | 0.11 | 12 | 4.7 | 0.26 | 8 |
| LNU651 | 70666.6 | 62.4 | 0.06 | 21 | 7.8 | 0.06 | 21 | 5.1 | L | 15 |
| LNU651 | 70668.1 | 66.0 | 0.12 | 28 | 8.2 | 0.12 | 28 | 5.0 | 0.02 | 13 |
| LNU630 | 70864.2 | 57.6 | 0.11 | 12 | 7.2 | 0.11 | 12 | 4.6 | 0.29 | 6 |
| LNU626 | 70858.4 | — | — | — | — | — | — | 4.6 | 0.14 | 4 |
| LNU626 | 70861.4 | 54.7 | 0.15 | 6 | 6.8 | 0.15 | 6 | 4.7 | 0.02 | 7 |
| LNU623 | 71007.4 | 60.5 | 0.05 | 18 | 7.6 | 0.05 | 18 | 4.7 | L | 9 |
| LNU614 | 70724.1 | 59.3 | 0.03 | 15 | 7.4 | 0.03 | 15 | 4.7 | 0.20 | 8 |
| LNU610 | 70782.2 | 64.1 | L | 25 | 8.0 | L | 25 | 5.0 | 0.10 | 14 |
| LNU610 | 70782.5 | 54.2 | 0.28 | 6 | 6.8 | 0.28 | 6 | 4.6 | 0.07 | 5 |
| LNU610 | 70783.3 | 55.7 | 0.07 | 8 | 7.0 | 0.07 | 8 | 4.6 | 0.09 | 5 |
| LNU563 | 70987.3 | 62.3 | L | 21 | 7.8 | L | 21 | 4.9 | 0.03 | 12 |
| LNU563 | 70987.5 | 64.8 | 0.29 | 26 | 8.1 | 0.29 | 26 | — | — | — |
| LNU547 | 70970.2 | 57.7 | 0.02 | 12 | 7.2 | 0.02 | 12 | 4.7 | 0.02 | 6 |
| LNU547 | 70971.1 | 55.7 | 0.29 | 8 | 7.0 | 0.29 | 8 | — | — | — |
| LNU547 | 70971.4 | 62.3 | 0.20 | 21 | 7.8 | 0.20 | 21 | 5.0 | 0.09 | 14 |
| LNU547 | 70972.4 | 60.7 | 0.20 | 18 | 7.6 | 0.20 | 18 | 4.8 | 0.22 | 8 |
| LNU540 | 70984.7 | 56.4 | 0.19 | 10 | 7.1 | 0.19 | 10 | 4.7 | 0.05 | 7 |
| LNU540 | 70986.1 | 61.0 | 0.03 | 19 | 7.6 | 0.03 | 19 | 4.7 | L | 8 |
| LNU528 | 70566.8 | 60.6 | 0.03 | 18 | 7.6 | 0.03 | 18 | 4.8 | 0.11 | 8 |
| LNU527 | 70978.4 | — | — | — | — | — | — | 4.9 | 0.27 | 10 |
| LNU527 | 70980.3 | 72.8 | 0.04 | 42 | 9.1 | 0.04 | 42 | 5.3 | 0.04 | 19 |
| LNU527 | 70980.5 | 65.2 | 0.02 | 27 | 8.2 | 0.02 | 27 | 5.1 | 0.02 | 16 |
| CONT. | — | 51.4 | — | — | 6.4 | — | — | 4.4 | — | — |
| LNU722 | 71189.5 | 67.7 | 0.14 | 10 | 8.5 | 0.14 | 10 | — | — | — |
| LNU716 | 70760.4 | 68.0 | 0.09 | 11 | 8.5 | 0.09 | 11 | 5.1 | 0.11 | 5 |
| LNU716 | 70760.8 | 77.7 | 0.05 | 26 | 9.7 | 0.05 | 26 | 5.6 | L | 15 |
| LNU716 | 70762.2 | 68.6 | 0.19 | 12 | 8.6 | 0.19 | 12 | 5.3 | 0.17 | 8 |
| LNU668 | 71415.1 | 66.4 | 0.18 | 8 | 8.3 | 0.18 | 8 | — | — | — |

TABLE 92-continued

Genes showing improved plant biomass production at standard nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU668 | 71415.5 | 65.1 | 0.30 | 6 | 8.1 | 0.30 | 6 | 5.1 | 0.18 | 4 |
| LNU647 | 70587.2 | — | — | — | — | — | — | 5.3 | 0.18 | 9 |
| LNU647 | 70589.6 | 67.7 | 0.22 | 10 | 8.5 | 0.22 | 10 | 5.3 | 0.22 | 7 |
| LNU647 | 70589.8 | 69.3 | 0.05 | 13 | 8.7 | 0.05 | 13 | 5.4 | L | 11 |
| LNU646 | 72150.4 | — | — | — | — | — | — | 5.1 | 0.09 | 5 |
| LNU644 | 70329.2 | 65.8 | 0.26 | 7 | 8.2 | 0.26 | 7 | — | — | — |
| LNU644 | 70331.1 | — | — | — | — | — | — | 5.1 | 0.16 | 5 |
| LNU643 | 70323.1 | 79.6 | 0.12 | 30 | 9.9 | 0.12 | 30 | 5.6 | 0.07 | 15 |
| LNU643 | 70325.2 | 71.1 | 0.02 | 16 | 8.9 | 0.02 | 16 | 5.4 | L | 11 |
| LNU643 | 70325.6 | — | — | — | — | — | — | 5.3 | 0.18 | 9 |
| LNU643 | 70326.5 | 67.5 | 0.23 | 10 | 8.4 | 0.23 | 10 | — | — | — |
| LNU620 | 70299.2 | 68.0 | 0.23 | 11 | 8.5 | 0.23 | 11 | 5.1 | 0.11 | 4 |
| LNU620 | 70302.3 | 66.1 | 0.20 | 8 | 8.3 | 0.20 | 8 | 5.2 | 0.20 | 5 |
| LNU620 | 70303.4 | 71.6 | 0.16 | 17 | 9.0 | 0.16 | 17 | — | — | — |
| LNU606 | 70289.1 | 70.2 | 0.08 | 14 | 8.8 | 0.08 | 14 | 5.2 | 0.03 | 7 |
| LNU606 | 70289.2 | 66.0 | 0.21 | 7 | 8.2 | 0.21 | 7 | — | — | — |
| LNU606 | 70290.2 | 72.6 | 0.01 | 18 | 9.1 | 0.01 | 18 | 5.3 | 0.02 | 8 |
| LNU606 | 70290.3 | 72.0 | 0.06 | 17 | 9.0 | 0.06 | 17 | 5.3 | 0.05 | 9 |
| LNU604 | 70280.3 | 73.1 | 0.01 | 19 | 9.1 | 0.01 | 19 | 5.3 | 0.06 | 7 |
| LNU604 | 70284.1 | 69.1 | 0.08 | 13 | 8.6 | 0.08 | 13 | 5.2 | 0.07 | 6 |
| LNU604 | 70285.2 | 79.5 | 0.08 | 29 | 9.9 | 0.08 | 29 | 5.6 | 0.01 | 14 |
| LNU596 | 72118.2 | — | — | — | — | — | — | 5.2 | 0.03 | 7 |
| LNU596 | 72120.2 | 66.4 | 0.21 | 8 | 8.3 | 0.21 | 8 | 5.2 | 0.07 | 6 |
| LNU592 | 70268.1 | 81.4 | 0.04 | 33 | 10.2 | 0.04 | 33 | 5.6 | 0.16 | 15 |
| LNU592 | 70270.1 | 75.3 | 0.16 | 23 | 9.4 | 0.16 | 23 | 5.5 | L | 12 |
| LNU592 | 70272.2 | 69.3 | 0.13 | 13 | 8.7 | 0.13 | 13 | 5.3 | 0.02 | 8 |
| LNU569 | 72151.3 | 65.8 | 0.23 | 7 | 8.2 | 0.23 | 7 | 5.1 | 0.26 | 4 |
| LNU569 | 72152.3 | 70.1 | 0.24 | 14 | 8.8 | 0.24 | 14 | 5.4 | 0.06 | 10 |
| CONT. | — | 61.4 | — | — | 7.7 | — | — | 4.9 | — | — |
| LNU744 | 71485.1 | 62.5 | L | 37 | 7.8 | L | 37 | 4.9 | L | 15 |
| LNU744 | 71487.3 | 52.5 | 0.02 | 15 | 6.6 | 0.02 | 15 | 4.5 | 0.07 | 6 |
| LNU738 | 71742.2 | 52.9 | 0.02 | 16 | 6.6 | 0.02 | 16 | 4.7 | 0.01 | 10 |
| LNU738 | 71745.3 | 51.2 | 0.05 | 12 | 6.4 | 0.05 | 12 | 4.5 | 0.11 | 5 |
| LNU727 | 71671.4 | 55.0 | 0.01 | 20 | 6.9 | 0.01 | 20 | 4.8 | 0.02 | 11 |
| LNU720 | 71756.1 | 59.5 | L | 30 | 7.4 | L | 30 | 4.9 | L | 13 |
| LNU707 | 71788.2 | 61.2 | 0.07 | 34 | 7.6 | 0.07 | 34 | 5.0 | 0.07 | 16 |
| LNU707 | 71789.3 | 62.4 | L | 36 | 7.8 | L | 36 | 4.9 | L | 15 |
| LNU692 | 71483.3 | 51.5 | 0.18 | 12 | 6.4 | 0.18 | 12 | 4.6 | 0.05 | 8 |
| LNU691 | 71436.4 | 51.6 | 0.28 | 13 | 6.4 | 0.28 | 13 | — | — | — |
| LNU691 | 71439.2 | — | — | — | — | — | — | 4.6 | 0.06 | 7 |
| LNU691 | 71441.1 | 56.2 | L | 23 | 7.0 | L | 23 | 4.6 | 0.09 | 7 |
| LNU684 | 71635.5 | — | — | — | — | — | — | 4.9 | 0.30 | 13 |
| LNU684 | 71639.3 | 61.1 | L | 33 | 7.6 | L | 33 | 5.0 | 0.01 | 15 |
| LNU660 | 71065.4 | 55.0 | 0.03 | 20 | 6.9 | 0.03 | 20 | 4.7 | 0.02 | 10 |
| LNU660 | 71069.5 | — | — | — | — | — | — | 4.5 | 0.25 | 4 |
| LNU619 | 71358.4 | 57.1 | L | 25 | 7.1 | L | 25 | 4.8 | L | 11 |
| LNU598 | 71777.3 | 59.9 | 0.15 | 31 | 7.5 | 0.15 | 31 | 4.8 | 0.15 | 13 |
| LNU594 | 71739.3 | 67.6 | 0.15 | 48 | 8.5 | 0.15 | 48 | 5.1 | 0.04 | 19 |
| LNU584 | 71748.2 | 53.6 | 0.01 | 17 | 6.7 | 0.01 | 17 | 4.6 | 0.03 | 8 |
| LNU584 | 71751.1 | 60.3 | 0.13 | 32 | 7.5 | 0.13 | 32 | 4.8 | 0.07 | 13 |
| LNU576 | 71659.3 | — | — | — | 6.1 | 0.25 | 7 | — | — | — |
| LNU576 | 71662.5 | 57.8 | 0.07 | 26 | 7.2 | 0.07 | 26 | 4.8 | 0.01 | 11 |
| LNU555 | 71655.3 | 59.7 | L | 30 | 7.5 | L | 30 | 4.9 | L | 14 |
| LNU523 | 71605.4 | 49.0 | 0.23 | 7 | 6.1 | 0.23 | 7 | — | — | — |
| CONT. | — | 45.8 | — | — | 5.7 | — | — | 4.3 | — | — |

Table 92: "CONT."—Control; "Ave."—Average; "% Incr." = % increment; "p-val."—p-value; L means that p-value is less than 0.01, p < 0.1 was considered as significant.

The genes listed in Table 93 improved plant NUE when grown at standard nitrogen concentration levels. These genes produced faster developing plants when grown under limiting nitrogen growth conditions, compared to control plants, grown under identical growth conditions, as measured by growth rate of leaf number, rosette diameter and plot coverage.

TABLE 93

Genes showing improved rosette growth performance at standard nitrogen growth conditions

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU745 | 70911.4 | — | — | — | 7.8 | 0.16 | 24 | — | — | — |
| LNU724 | 71510.1 | — | — | — | 7.6 | 0.18 | 22 | — | — | — |
| LNU724 | 71513.2 | — | — | — | 7.7 | 0.17 | 23 | — | — | — |
| LNU722 | 71185.3 | — | — | — | 7.6 | 0.22 | 20 | — | — | — |
| LNU683 | 71294.2 | — | — | — | 8.7 | 0.02 | 39 | 0.4 | 0.23 | 17 |
| LNU683 | 71298.1 | — | — | — | 7.6 | 0.21 | 21 | — | — | — |
| LNU682 | 71431.3 | — | — | — | 7.9 | 0.15 | 25 | — | — | — |
| LNU656 | 71385.1 | — | — | — | 7.7 | 0.20 | 22 | — | — | — |
| LNU655 | 72292.1 | — | — | — | 7.8 | 0.16 | 24 | — | — | — |
| LNU655 | 72293.3 | 0.8 | 0.06 | 28 | 8.1 | 0.10 | 29 | — | — | — |
| LNU613 | 71621.3 | — | — | — | 7.5 | 0.27 | 19 | — | — | — |
| LNU577 | 72121.2 | — | — | — | 7.4 | 0.29 | 18 | — | — | — |
| CONT. | — | 0.7 | — | — | 6.3 | — | — | 0.4 | — | — |
| LNU721 | 70613.4 | — | — | — | 9.3 | 0.23 | 17 | — | — | — |
| LNU721 | 70614.3 | — | — | — | 9.2 | 0.26 | 16 | — | — | — |
| LNU675 | 70401.2 | — | — | — | 10.1 | 0.09 | 27 | — | — | — |
| LNU675 | 70402.1 | 0.7 | 0.22 | 18 | — | — | — | — | — | — |
| LNU675 | 70405.3 | — | — | — | 10.1 | 0.08 | 28 | — | — | — |
| LNU656 | 71384.2 | — | — | — | 13.1 | L | 66 | 0.5 | 0.03 | 26 |
| LNU656 | 71384.3 | — | — | — | 9.6 | 0.16 | 21 | — | — | — |
| LNU656 | 71385.1 | — | — | — | 12.1 | L | 52 | 0.5 | 0.01 | 29 |
| LNU641 | 70628.3 | — | — | — | 10.0 | 0.07 | 26 | — | — | — |
| LNU625 | 70965.4 | 0.7 | 0.23 | 18 | 9.8 | 0.11 | 23 | 0.5 | 0.26 | 13 |
| LNU612 | 71334.3 | — | — | — | 9.5 | 0.19 | 19 | — | — | — |
| LNU612 | 71335.4 | — | — | — | 9.5 | 0.21 | 19 | 0.5 | 0.26 | 13 |
| LNU600 | 70486.4 | — | — | — | 9.2 | 0.27 | 15 | — | — | — |
| LNU600 | 70488.1 | — | — | — | 11.7 | L | 47 | 0.5 | 0.09 | 19 |
| LNU593 | 71844.3 | — | — | — | 9.9 | 0.09 | 25 | 0.5 | 0.21 | 14 |
| LNU593 | 71848.2 | — | — | — | 9.4 | 0.21 | 18 | — | — | — |
| LNU593 | 71848.5 | — | — | — | 10.4 | 0.04 | 31 | 0.5 | 0.14 | 17 |
| LNU593 | 71849.1 | 0.8 | 0.09 | 25 | 10.4 | 0.04 | 31 | 0.5 | 0.10 | 18 |
| LNU587 | 70378.1 | — | — | — | 10.2 | 0.06 | 28 | 0.5 | 0.18 | 15 |
| LNU587 | 70379.3 | — | — | — | 10.6 | 0.03 | 33 | 0.5 | 0.09 | 19 |
| LNU587 | 70380.5 | — | — | — | 12.8 | L | 61 | 0.5 | 0.04 | 26 |
| LNU587 | 70381.1 | — | — | — | 9.5 | 0.16 | 20 | — | — | — |
| LNU582 | 70256.1 | — | — | — | 11.2 | L | 41 | 0.5 | 0.05 | 22 |
| LNU572 | 71406.2 | — | — | — | 10.1 | 0.06 | 27 | 0.5 | 0.22 | 14 |
| LNU571 | 71842.1 | — | — | — | 11.3 | L | 42 | 0.5 | 0.17 | 16 |
| LNU566 | 71834.2 | 0.7 | 0.22 | 17 | — | — | — | — | — | — |
| LNU566 | 71834.3 | 0.8 | 0.18 | 20 | 10.9 | 0.01 | 38 | 0.5 | 0.19 | 14 |
| LNU566 | 71835.1 | 0.7 | 0.23 | 17 | — | — | — | — | — | — |
| LNU560 | 70241.4 | — | — | — | 10.8 | 0.02 | 36 | 0.5 | 0.20 | 15 |
| LNU560 | 70243.3 | — | — | — | 11.1 | 0.01 | 40 | 0.5 | 0.13 | 17 |
| LNU553 | 70370.1 | 0.8 | 0.17 | 21 | 11.1 | 0.01 | 40 | 0.5 | 0.12 | 17 |
| LNU553 | 70370.2 | — | — | — | 9.4 | 0.20 | 19 | — | — | — |
| LNU553 | 70373.1 | 0.8 | 0.13 | 22 | 10.1 | 0.07 | 27 | 0.5 | 0.29 | 12 |
| LNU530 | 70203.2 | — | — | — | 9.3 | 0.22 | 18 | — | — | — |
| LNU530 | 70203.3 | — | — | — | 9.2 | 0.28 | 16 | — | — | — |
| LNU530 | 70207.4 | 0.7 | 0.30 | 15 | 11.4 | L | 44 | 0.5 | 0.07 | 22 |
| CONT. | — | 0.6 | — | — | 7.9 | — | — | 0.4 | — | — |
| LNU720 | 71756.2 | — | — | — | 7.7 | 0.04 | 32 | 0.4 | 0.12 | 14 |
| LNU661 | 72707.2 | — | — | — | 7.3 | 0.09 | 25 | 0.4 | 0.28 | 10 |
| LNU618 | 72133.2 | — | — | — | 7.8 | 0.03 | 33 | 0.4 | 0.05 | 18 |
| LNU618 | 72135.3 | — | — | — | 7.0 | 0.18 | 19 | — | — | — |
| LNU618 | 72138.1 | — | — | — | 7.2 | 0.11 | 24 | — | — | — |
| LNU598 | 71775.2 | — | — | — | 7.4 | 0.10 | 26 | — | — | — |
| LNU594 | 71739.1 | — | — | — | 6.8 | 0.26 | 16 | — | — | — |
| LNU576 | 71658.1 | — | — | — | 6.8 | 0.25 | 16 | — | — | — |
| LNU576 | 71659.3 | — | — | — | 7.0 | 0.18 | 20 | 0.4 | 0.21 | 11 |
| LNU576 | 71662.3 | — | — | — | 7.6 | 0.05 | 30 | 0.4 | 0.24 | 11 |
| LNU576 | 71662.5 | — | — | — | 7.1 | 0.16 | 21 | 0.4 | 0.23 | 11 |
| LNU559 | 70834.1 | 0.7 | 0.23 | 15 | — | — | — | — | — | — |
| LNU555 | 71655.4 | — | — | — | 8.0 | 0.02 | 36 | 0.4 | 0.08 | 15 |
| LNU555 | 71656.5 | — | — | — | 7.0 | 0.19 | 19 | — | — | — |
| LNU555 | 71656.6 | — | — | — | 6.8 | 0.27 | 17 | — | — | — |
| LNU540 | 70984.4 | — | — | — | 7.0 | 0.19 | 19 | — | — | — |
| LNU527 | 70979.2 | 0.7 | 0.18 | 19 | 7.1 | 0.16 | 21 | — | — | — |
| LNU527 | 70980.3 | — | — | — | — | — | — | 0.4 | 0.29 | 9 |
| LNU523 | 71605.4 | — | — | — | — | — | — | 0.4 | 0.18 | 12 |
| LNU523 | 71607.4 | 0.7 | 0.26 | 16 | — | — | — | — | — | — |
| CONT. | — | 0.6 | — | — | 5.9 | — | — | 0.4 | — | — |

TABLE 93-continued

Genes showing improved rosette growth performance at standard nitrogen growth conditions

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU736 | 71235.4 | — | — | — | 11.4 | 0.22 | 18 | 0.5 | 0.17 | 13 |
| LNU701 | 71133.5 | — | — | — | 12.5 | 0.08 | 29 | 0.5 | 0.22 | 14 |
| LNU677 | 71105.1 | — | — | — | — | — | — | 0.5 | 0.21 | 12 |
| LNU666 | 71388.2 | — | — | — | 12.0 | 0.10 | 23 | 0.6 | 0.10 | 15 |
| LNU665 | 71077.1 | — | — | — | — | — | — | 0.5 | 0.28 | 11 |
| LNU665 | 71082.4 | 0.8 | 0.20 | 12 | 11.3 | 0.23 | 17 | — | — | — |
| LNU663 | 71071.3 | — | — | — | 12.5 | 0.04 | 29 | 0.6 | 0.05 | 17 |
| LNU663 | 71071.6 | — | — | — | 11.1 | 0.29 | 15 | — | — | — |
| LNU663 | 71072.5 | — | — | — | — | — | — | 0.5 | 0.30 | 9 |
| LNU617 | 70293.6 | — | — | — | 11.8 | 0.12 | 22 | 0.6 | 0.12 | 15 |
| LNU596 | 72118.2 | — | — | — | 11.8 | 0.13 | 22 | 0.5 | 0.20 | 13 |
| LNU596 | 72120.2 | — | — | — | 12.7 | 0.03 | 31 | 0.6 | 0.03 | 20 |
| LNU575 | 70254.1 | — | — | — | 11.4 | 0.21 | 17 | — | — | — |
| LNU575 | 70255.1 | — | — | — | 11.3 | 0.24 | 16 | 0.5 | 0.16 | 13 |
| LNU568 | 70846.3 | — | — | — | 12.2 | 0.07 | 26 | 0.5 | 0.13 | 14 |
| LNU562 | 70244.3 | — | — | — | 11.4 | 0.22 | 18 | — | — | — |
| LNU548 | 70570.2 | — | — | — | — | — | — | 0.5 | 0.28 | 11 |
| LNU548 | 70570.5 | — | — | — | — | — | — | 0.5 | 0.25 | 11 |
| LNU526 | 70814.3 | — | — | — | 11.2 | 0.26 | 16 | 0.6 | 0.08 | 17 |
| LNU526 | 70819.2 | — | — | — | — | — | — | 0.6 | 0.06 | 18 |
| CONT. | — | 0.7 | — | — | 9.7 | — | — | 0.5 | — | — |
| LNU643 | 70323.1 | — | — | — | 8.6 | 0.11 | 25 | 0.5 | 0.13 | 12 |
| LNU642 | 70582.5 | — | — | — | 8.4 | 0.15 | 22 | — | — | — |
| LNU604 | 70285.2 | — | — | — | 8.5 | 0.15 | 24 | 0.5 | 0.27 | 11 |
| LNU592 | 70270.1 | 0.8 | 0.29 | 16 | — | — | — | — | — | — |
| LNU575 | 70253.3 | — | — | — | 8.0 | 0.25 | 17 | — | — | — |
| LNU558 | 70470.5 | — | — | — | 8.0 | 0.27 | 16 | — | — | — |
| LNU554 | 70481.1 | — | — | — | 8.5 | 0.12 | 23 | — | — | — |
| LNU554 | 70482.4 | — | — | — | 8.2 | 0.23 | 19 | — | — | — |
| LNU531 | 70209.4 | — | — | — | 8.8 | 0.07 | 29 | 0.5 | 0.20 | 10 |
| LNU531 | 70211.3 | — | — | — | 9.3 | 0.03 | 36 | 0.5 | 0.07 | 15 |
| CONT. | — | 0.7 | — | — | 6.9 | — | — | 0.4 | — | — |
| LNU724 | 71513.2 | — | — | — | 5.3 | 0.11 | 24 | — | — | — |
| LNU707 | 71789.2 | — | — | — | 5.1 | 0.21 | 18 | — | — | — |
| LNU684 | 71637.1 | — | — | — | 5.3 | 0.13 | 23 | 0.4 | 0.21 | 13 |
| LNU612 | 71335.4 | 0.7 | 0.29 | 19 | 5.7 | 0.04 | 31 | 0.4 | 0.11 | 16 |
| LNU612 | 71336.4 | 0.7 | 0.18 | 21 | 5.4 | 0.09 | 25 | 0.4 | 0.24 | 11 |
| LNU605 | 71357.2 | — | — | — | — | — | — | 0.4 | 0.29 | 11 |
| LNU597 | 72369.4 | — | — | — | 5.0 | 0.26 | 16 | — | — | — |
| LNU593 | 71848.2 | 0.7 | 0.10 | 25 | — | — | — | — | — | — |
| LNU572 | 71407.1 | — | — | — | — | — | — | 0.4 | 0.22 | 13 |
| LNU571 | 71839.2 | 0.7 | 0.20 | 19 | — | — | — | — | — | — |
| LNU566 | 71837.1 | 0.7 | 0.18 | 22 | 5.5 | 0.09 | 26 | 0.4 | 0.12 | 15 |
| LNU556 | 72364.2 | — | — | — | 5.0 | 0.29 | 15 | — | — | — |
| LNU531 | 70209.4 | — | — | — | 5.0 | 0.25 | 17 | — | — | — |
| LNU531 | 70211.1 | 0.6 | 0.29 | 16 | — | — | — | — | — | — |
| LNU531 | 70211.3 | — | — | — | 5.2 | 0.17 | 20 | — | — | — |
| CONT. | — | 0.6 | — | — | 4.3 | — | — | 0.3 | — | — |
| LNU747 | 70616.2 | — | — | — | — | — | — | 0.4 | 0.30 | 8 |
| LNU747 | 70618.1 | — | — | — | 7.6 | 0.16 | 18 | 0.4 | 0.14 | 11 |
| LNU697 | 70702.2 | — | — | — | 8.5 | 0.03 | 33 | 0.5 | 0.11 | 14 |
| LNU673 | 70394.1 | — | — | — | 8.6 | 0.02 | 34 | 0.5 | 0.04 | 16 |
| LNU673 | 70395.1 | — | — | — | 7.4 | 0.21 | 15 | 0.4 | 0.25 | 8 |
| LNU673 | 70398.4 | — | — | — | 7.7 | 0.13 | 20 | 0.4 | 0.15 | 11 |
| LNU669 | 70388.2 | — | — | — | 7.4 | 0.24 | 15 | 0.4 | 0.22 | 10 |
| LNU653 | 70659.2 | — | — | — | 7.2 | 0.30 | 13 | 0.4 | 0.16 | 10 |
| LNU651 | 70664.2 | — | — | — | — | — | — | 0.4 | 0.20 | 10 |
| LNU651 | 70666.6 | — | — | — | 7.8 | 0.09 | 22 | 0.5 | 0.02 | 18 |
| LNU651 | 70668.1 | — | — | — | 8.3 | 0.03 | 28 | 0.5 | 0.04 | 16 |
| LNU626 | 70859.4 | 0.8 | 0.30 | 8 | — | — | — | — | — | — |
| LNU626 | 70861.4 | — | — | — | — | — | — | 0.4 | 0.22 | 9 |
| LNU623 | 71007.2 | — | — | — | 7.4 | 0.23 | 15 | — | — | — |
| LNU623 | 71007.4 | — | — | — | 7.5 | 0.18 | 16 | — | — | — |
| LNU614 | 70724.1 | — | — | — | 7.4 | 0.21 | 16 | — | — | — |
| LNU614 | 70726.3 | 0.8 | 0.29 | 8 | — | — | — | — | — | — |
| LNU610 | 70782.2 | — | — | — | 8.0 | 0.05 | 25 | 0.5 | 0.04 | 16 |
| LNU563 | 70987.3 | — | — | — | 7.8 | 0.09 | 21 | 0.5 | 0.12 | 12 |
| LNU563 | 70987.5 | — | — | — | 8.1 | 0.06 | 26 | 0.5 | 0.06 | 17 |
| LNU547 | 70971.1 | — | — | — | — | — | — | 0.5 | 0.04 | 17 |
| LNU547 | 70971.4 | — | — | — | 7.8 | 0.11 | 21 | 0.5 | 0.10 | 12 |
| LNU547 | 70972.1 | — | — | — | 7.5 | 0.23 | 16 | 0.4 | 0.19 | 11 |

TABLE 93-continued

Genes showing improved rosette growth performance at standard nitrogen growth conditions

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU547 | 70972.4 | — | — | — | 7.6 | 0.15 | 18 | 0.4 | 0.23 | 8 |
| LNU540 | 70984.7 | — | — | — | — | — | — | 0.4 | 0.25 | 9 |
| LNU540 | 70986.1 | — | — | — | 7.5 | 0.19 | 16 | — | — | — |
| LNU528 | 70565.2 | — | — | — | 8.3 | 0.05 | 29 | 0.5 | 0.08 | 15 |
| LNU528 | 70566.8 | — | — | — | 7.7 | 0.12 | 19 | 0.4 | 0.20 | 9 |
| LNU527 | 70977.2 | — | — | — | 7.6 | 0.20 | 18 | — | — | — |
| LNU527 | 70978.4 | — | — | — | 8.1 | 0.07 | 25 | 0.4 | 0.19 | 11 |
| LNU527 | 70980.3 | — | — | — | 9.2 | L | 43 | 0.5 | L | 24 |
| LNU527 | 70980.5 | — | — | — | 8.1 | 0.04 | 27 | 0.5 | 0.04 | 16 |
| CONT. | — | 0.7 | — | — | 6.4 | — | — | 0.4 | — | — |
| LNU716 | 70760.8 | — | — | — | 9.8 | 0.11 | 25 | 0.5 | 0.11 | 14 |
| LNU658 | 70687.3 | — | — | — | — | — | — | 0.5 | 0.08 | 15 |
| LNU647 | 70589.8 | — | — | — | — | — | — | 0.5 | 0.07 | 17 |
| LNU643 | 70323.1 | — | — | — | 10.1 | 0.07 | 29 | 0.5 | 0.05 | 18 |
| LNU643 | 70325.6 | — | — | — | — | — | — | 0.5 | 0.27 | 10 |
| LNU643 | 70326.5 | 0.8 | 0.17 | 23 | — | — | — | — | — | — |
| LNU606 | 70290.2 | — | — | — | 9.2 | 0.23 | 18 | — | — | — |
| LNU606 | 70290.3 | — | — | — | 9.3 | 0.20 | 19 | 0.5 | 0.13 | 14 |
| LNU604 | 70280.3 | — | — | — | 9.4 | 0.19 | 20 | — | — | — |
| LNU604 | 70285.2 | — | — | — | 10.2 | 0.06 | 30 | 0.5 | 0.15 | 13 |
| LNU592 | 70268.1 | — | — | — | 10.4 | 0.04 | 32 | 0.5 | 0.08 | 16 |
| LNU592 | 70270.1 | — | — | — | 9.5 | 0.17 | 21 | 0.5 | 0.11 | 15 |
| LNU569 | 72152.3 | — | — | — | — | — | — | 0.5 | 0.16 | 13 |
| CONT. | — | 0.7 | — | — | 7.8 | — | — | 0.4 | — | — |
| LNU744 | 71485.1 | — | — | — | 8.3 | 0.02 | 39 | 0.5 | 0.08 | 18 |
| LNU727 | 71671.4 | — | — | — | 7.1 | 0.22 | 18 | — | — | — |
| LNU727 | 71674.1 | — | — | — | 7.5 | 0.14 | 25 | — | — | — |
| LNU720 | 71754.3 | — | — | — | 7.6 | 0.11 | 27 | — | — | — |
| LNU720 | 71756.1 | — | — | — | 7.7 | 0.06 | 29 | — | — | — |
| LNU707 | 71788.2 | — | — | — | 8.1 | 0.03 | 35 | 0.5 | 0.05 | 22 |
| LNU707 | 71789.3 | — | — | — | 8.2 | 0.02 | 37 | 0.5 | 0.11 | 17 |
| LNU691 | 71441.1 | — | — | — | 7.4 | 0.13 | 23 | — | — | — |
| LNU691 | 71441.2 | — | — | — | 7.0 | 0.29 | 17 | 0.5 | 0.16 | 16 |
| LNU684 | 71635.5 | — | — | — | 7.4 | 0.13 | 24 | 0.5 | 0.27 | 12 |
| LNU684 | 71639.3 | — | — | — | 8.0 | 0.04 | 33 | 0.5 | 0.16 | 15 |
| LNU684 | 71639.5 | 0.7 | 0.27 | 17 | 7.3 | 0.18 | 21 | — | — | — |
| LNU660 | 71065.4 | — | — | — | 7.2 | 0.17 | 21 | — | — | — |
| LNU660 | 71068.2 | 0.7 | 0.23 | 21 | — | — | — | — | — | — |
| LNU660 | 71069.5 | 0.7 | 0.30 | 16 | — | — | — | — | — | — |
| LNU660 | 71070.1 | — | — | — | 7.5 | 0.16 | 25 | — | — | — |
| LNU619 | 71358.4 | — | — | — | 7.5 | 0.09 | 26 | 0.5 | 0.16 | 15 |
| LNU598 | 71777.3 | — | — | — | 7.9 | 0.05 | 31 | 0.5 | 0.19 | 14 |
| LNU594 | 71738.4 | — | — | — | 7.9 | 0.07 | 31 | — | — | — |
| LNU594 | 71739.3 | 0.7 | 0.24 | 18 | 9.0 | L | 49 | 0.5 | 0.05 | 22 |
| LNU584 | 71748.2 | — | — | — | 7.0 | 0.27 | 17 | — | — | — |
| LNU584 | 71751.1 | 0.7 | 0.16 | 22 | 8.0 | 0.04 | 34 | 0.5 | 0.17 | 14 |
| LNU576 | 71662.5 | — | — | — | 7.5 | 0.09 | 26 | — | — | — |
| LNU561 | 71346.6 | 0.7 | 0.27 | 19 | — | — | — | — | — | — |
| LNU561 | 71346.8 | 0.7 | 0.17 | 23 | — | — | — | — | — | — |
| LNU555 | 71655.3 | — | — | — | 7.8 | 0.05 | 31 | 0.5 | 0.14 | 16 |
| LNU523 | 71605.6 | 0.7 | 0.12 | 24 | — | — | — | — | — | — |
| CONT. | — | 0.6 | — | — | 6.0 | — | — | 0.4 | — | — |

Table 93. "CONT."—Control; "Ave."—Average; "% Incr." = % increment; "p-val."—p-value; L means that p-value is less than 0.01, p < 0.1 was considered as significant.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (6762 sequences)

SEQ ID NO: 1 - DNA, 1919 bp, Arabidopsis thaliana
atcttcctctttttccttctactaaaacacacattttccttagaaaaataaaccaagtccaagaaaatggacccatggtcatggatatgtgagcttccagaagatcctgagttcagcgagtctgattcacacgcagtgtttcagctcgctggcgatttgacacgttcgatcaaacttagagccgaacggactttgggttctgaccaagaatctcactctctcacctttacagttgtagcagagggttttaacctccttaagtcgtcgaccatttgggtctccaacacatgtcccttgtcgtcggagaaaccgttcctccctcttgttctccagcttcttcaagaactaatcacccgttcccctaccacacacgacggcgcgtgcacaaagtttgaacaacttgaaatcaaaccaagtccagttagctgggtcatggactctcactcacctgaatccttctcatcagtctttaatctaatcctcctcacacgcctcttctggttgtgtgtgtttgacgcgccaagcgaagtaggctctttcttcttccaacacttactaggtccacacgtgaacgcgcttacatgtcaacatgcacctgtcttacggacgtttctcgtctctctcggtgtagacgccgagctttgtattgtacgagctgcttcgtatgccttatccaaatggatgatctctaaagagataggacttgggaatcttggtttgaaacagttcagtagcagcctcatgccacgtcattcgttggggttttcgtatgccacagaagctcatggtctttggatcttgaaaggttatttcccaatcttgtcaatgaacgtcacaaataatagctctaacgaggttcacaacaagatcgtcaagtttccattcgtagagcctaaagaagctgtcctacgttacgctttgtcgcatcaacaagctgaaatactagtacagtttgaatactccgttaagttctatgagaactacataaaagtaaacgcacgtgtagacaacatacgcatccacgtctcgaagctagggtttcacaaaggaggagttggcgtggagaatcagatagcggattgttactccgaggagaggtacttcccatcacgggtacgggtctggctcgggccagaactcgggtccagccacgtatcggggctaagtctaggaaggtcaacgaagaacgaggagagagatatcgaggtgactagagtgctaaagggaaatttcggaaaaggtaaagtggctccgagagtcaaggcaagagcaagaatggcaacaaagaggaaggttaaagattggagaatagagcaggaaagcgaaggaaacgctgccgtttttgatgcggtgttgtacgatagagagagcggtcaagaagtgacaaccgttaagccgaagccaaaccaagagggtttaaagaatgtgtttacgaagagtggggggatggtgtttggaagggatgagtatggagatgaagttgggtggagagttgggagagagatggaaggaagtgtgttgaagtggagactgggtggcaaaatttggctaacttattggccaaacaagttgaacactttgttttatgagactagatgtgtagagtggtgtgatgaggttgatttgccgttgcttcctacttcttagagtcgcaaataagaaaaaatatataggtacataaaataattggatataggtcataaattggtatatgtgtttgtaaatatttactcttgaggtatctcaaatattgttttcgtataattgtcatttgcatacgcacacctatagctttatctgaaataaatagctaaccattttgtatgtgtttggcaaaaatctattgttgttcagcactagaaagtcaattagctttgtaaggaccaaatcttctttataacacttgctttaattttttg

SEQ ID NO: 2 - DNA, 911 bp, Arabidopsis thaliana
attctcttaacattccattactcttatccttttaccctcatcatcctccactatttacagttttgccactctgactttatgctagcttcttccggtgactggcgataacacgagagagccttcgccttctccaagcttcatactcttccgacgataaagattagaagacatgaagaacggtaaccggaaaacaacgccggaaacagagaagtctcaccggagaaagttatcagagaaagcgatgtcgtttcacggcagaggaacaacgccgttatcaaatccaggcgagcttcgaagaccgaaaacgttaccggagttattctccaccggtcaaagcatcaccgtaccggagacggtttcacttccgccacgtttgacgaaacttttacttaacgtgacggtacaaggaagtttaggagccgtacaaattataatctcgccggaatccaccgtgagtgatttaatcgacgccgccgttcgtcagtacgttaaagaagctcgccggccatttttaccggaatctgaaccgtcacgatttgatcttcattactcgcagtttagtcttgagagtattgtaagagacgagaagttgatatcgctagggtcgagaaactttttcttatgtggtcggaaagagaccggagggtttatcggctgtggtttatcgtcggaatcttgttctaaggaagcagagaaagtggctaaaactggttttcattggctcaaatttatgggcttctagaagtttttatcattttgaattattgctttttcaaattagttccattctttagaaaaaggatataaaaaacatctgtgtatattatttctatgtagaaatgaaaatcattaattagtggtgtataatgtattttaatcaattatataccaagatgattatatgaagttct

SEQ ID NO: 3 - DNA, 1803 bp, Arabidopsis thaliana
ttattcaaaatattttcaccaactaaaaaaagatacatcgaaacaaatctctctaatcatatctaagttataacttttctttataaacaataaacaatagctttgatttgaagcaagaggagcaacaatggagatcaccactatcatattcctcatcatatcctctctcaccttctccatcttccttaaactcatcttcttcttctcaactcacaaactcccaccgggaccacctcgttttccggtcatcggaaacatcatctggcttaagaaaaacaacttctccgatttccaaggcgttctccgtgacttagcctcccgtcacggaccaatcataacactccacgtaggctccaaaccttccatctgggtcacagacagatcactcgctcaccaagcccttgtccaaaacggtgccgttttctccgaccgttctctcgctctccctaccaccaaagtcatcaccagcaaccaacacgacatccactcctccgtctatggctctctctggagaaccctccgccgcaacctcacctccgaaatcctccagccctcgcgcgtgaaagcacacgcgccgtcgaggaaatggtctctcgagattctcgtggatctgttcgagacagagcagagagagaaaggacatatctccgacgctttagatcatttacgtcacgctatgttttatttgttggctctgatgtgtttcggagagaaactgagaaaagaagagatcagagagatcgaagaagctcagtaccaaatgctcataagctacaccaagttcagcgtcctcaacatcttcccaagcgtaaccaagttcttgctccggcgaaaatggaaagagtttttagaactaaggaaatctcaagagagcgttatacttcgatacgtgaacgcaagaagcaaagaaaccaccggagatgttctctgttacgtcgatacgctgctgaatcttgagatcccgacggaggagaaagaaggagggaagaagaggaaactgagtgactcggagatcgtgagtctgtgttcggagtttcttaacgcagctacggatccaacggcgacgtcgatgcagtggatcatggcgatcatggtgaagtatccagagatacagaggaaagtatacgaggaaatgaagactgtgttcgccggagaagaagaagaaagagaagagatcagagaagaggatttggggaagttgagttacctcaaagctgtgatcttggagtgtctaagaagacaccctcctggtcattacttgtcttaccataaggtcacacacgacaccgttttgggtggatttctcattccgcgccaaggtactataaactttatggtaggagaaatgggccgggacccaaaaatatgggaagatcctctaacgttcaagccagaaagatttctagagaacggagaagcatgtgattttgatatgacgggaactcgcgagattaaaatgatgccgtttggagcgggacgacggatgtgtcccggctacgcgctttcgttgcttcacctggaatattatgtggccaatttggtttggaaattcgagtggaaatgtgtggaaggtgaagaagttgatctatccgagaagcaacagttcatcacaatggtcatgaaaaaccctttcaaagcaaatatttatccaaggagaaagtgatatttgcttttgtcatattatcaaaaaggcccattgggcttatttgtcgtatgtatattaaaaactttgtctcatatgtattaaaacaatttgggcctttaatgggtttcaatataaagatgtcaacacttttagttttc

SEQ ID NO: 4 - DNA, 941 bp, Arabidopsis thaliana
gaacaaaaaatttcatttccgtcggtgtttgtttttatatttaggaaaaaaaaagagaagcgaatgtttcccctgggattacgcaaatatcaaagattattataggaaaatctggttgaggaaagctgactaaccaccacataaaaagccacgtggcacatgcacttcccctagaaatacgaaactttaataagaagcatccagcaaaaccgaaatcttggttcaccaccgtctccagatcaaagaaaacagagaaacatctgtttttttgtttagtttgatctgttgagagatgacgagcggtggcgacgataaaaacagatctgtggtgacagatcatcaacatcaacaacagcctcctcctccgtttcaaggcgtctctaactatccaccgcagcagcagcctcccgccaccggttatcctcagcctgctcagccctacgcccaaggttatgttgttaatggagtaagaccaacagaacacggtcgttgttgcggtatcggcattggctgggtattattcatccttggtttcttcttcgctttgccctggtacatcggtttcttccttctattattctctaggaacccgcgtgagagaccaggatatatagcttgcgcagttggggctgtttttgctaccattatcgtcatctttggaaccgtaagaggatcaggggtgtggtcatgaaggtgaagatgtcaacaatctgaatccgttgagattttgtttcagaagaagatcgatccataatgtttgtttacataatgtgtattgtctctagattacaaaacagtactgtatatgtttctttgaaaagttcttcttctgaaaacatactagtgtttgcattttcaaagaattttttttatataaaaaatttgcatttgtttagatgatacgaattcaaatgaatctgattataagctcatttagtaaa

SEQ ID NO: 5 - DNA, 1050 bp, Arabidopsis thaliana
gagtgaagaagaagaagatatttgttgctgatggcgggtacttgcacttcgataaggcctcgtctcattggctcttcttcaattgttgagctttcaaggttgattaatcgagctggagttcctttctctgtacgattctctacaagaaccagagccctccacggtggtggtttaaccgcacctacctctcgtgaggaaggtccttcttgtatcttcgttggacctattgattctgctcgcaaagaaactctagaagctctttatcgccaagctaaggatgcgtattacaatggcaagcctttgatagttgatgacatgtttgacagagttgagctaaagcttcggtggtatggttcaaaatctgttgtcaagtatcctcggtgtagtctactaagacagtcaacatatgctgatgcagaggatgatgcatcgcaagttctcctgttagctaccgtatggattatgattttcttatttggtagttcggcatgtgttttacccacgatatatggcgtcggcctggtttatggaggagatccgtttgactcagggcttgtctatagcagtcagttgtcatcttctgtgcctattttgtcaaagtttaatggcatcctcctctccgtgctagggcctgcttttggatatccgattgcatcttctgcagtaagagtacttaaagggttatggagaaatgacttaacggctctaaaaggagactgcccgaattgcggggaagaggttttcgcatttgtgagatccgatcaatcgaaccgatcagctcacaaagccgactgtcatgtctgtgagtgcaccttggagttccgtaccaaagtagaggtagataaatctgcctcacgattggggagaaaatgggtttacggtaggatataccttgtttcacggccaaggagagatcggcgttcaaagtttacataattctaacaaaagaagaaagatttttttgggatggtttctactcaattgtgtattgtaaaaatgatactatagaaagcttttgtaacattcaaaagattcataaaaattgttact

SEQ ID NO: 6 - DNA, 1123 bp, Arabidopsis thaliana
agcctgtcaacagacatctttataattaattattgagaaaagagaaaaacagaggaaaaaaagatggagagaagcttgaagaagacgaagaacaattataacaactccataaagagcaatcttatgaaagatgatgaattgtttcatgtgattcacaaagttccctgtggagacactccttatgtcagagccaaacatgctcagttgatagagaagaacccggagatggcaatagtgtggttttggaaagccatcaacactggagacagagtagacagtgccctcaaggacatggctgttgtaatgaaacaacttgaccgttctgaagaagctattgaagctatcaaatctttccgtcctcgttgttccaagaattcccaagattcccttgacaatgtcctcatcgacttatacaagaaatgtgggagaatggaggagcaagttgagttgttgaagaggaaattaaggcagatctatcaaggagaagctttcaatggtaaacctaccaaaaccgctcgctcccacggaaaaaagtttcaagtgactgttcaacaagaaatctcaagattactgggtaacttggggtgggcatatatgcaacaagccaagtacttatcggccgaagcggtatacagaaaagcccagatggttgagccagatgctaacaaatcgtgcaaccttgcgatgtgccttatcaaacaaggcaggtttgaggagggaagattggttcttgacgatgttctcgagtatagggttttgggtgcggatgattgtagaacaaggcaacgggccgaagagcttctgagtgaattagagtcttcgctgccacggatgcgagatgctgagatggaggatgtcttgggaaatatcttagacgatgactttgttcttgggcttgaagagatgacatccactagttttaaatctaagagactcccaatcttcgaacagatctcgtcttttagaaatacattagtttgctagttaattcattctgtgttttcttgtgtatcatcatcatagctttgctgctttatagttttgatgagttgtaaatatatgtttctctttagtaactttgtacatacaacaaataatgggaacaacttcatttaagctccaa

SEQ ID NO: 7 - DNA, 3335 bp, Hordeum vulgare
cgccgaaaccctagcctcatctcgccaccgcacgcctcctccacaggacccttctcggagcccgcggatggacgactcggagaacaacgcgccgtcgaccccgggctcgccgggtttcagcaccgaccggctgccgcccaacaccaccaccagccgcggcgccaccgacccgtcctcctactcggacgacgatggcgaggcggaggtcgaccccaatgtgctccccgaggacgacggcgccaccgttatccgcgacgaggaggaagacgacggggaagacctcttcaacgacgactacctcaatgattaccggagaatggatgagcaggatcactatgagtccgttgggttagatgactccatagaggatgagaggaacctggatgagatcatggctgatcgaagggctgcagaagcggaacttcatgcaagggatgtgaggactggtgcaacgtctgatcgaaaattgcctcgtatgcttcatgatcaggatacagatgaggatatgaacttcaggcgtcctaaaaggcacagggctaattttagacaaccaactggaggaccaagaacacccagaagtgatgatgatggtgatggtctcactcctagttcacctggaagatctcagccatattctggtggtgatgtgcctatgactgatcagactgatgatgatggatatgaggatgaatttgatgaagaagatgagatgaacatgtaccgtgtgcaaggaacacttagagagtgggtcacaagagatgaagttcggcgcttcattgcaaagaaatttaaagaatttcttcttacatatgtaaaccctaagaatgaacaaggggagtttgaatatgtccgactaattaatgagatggttttagctaacaagtgtagtttagagatagactacaagcaatttatttatatacatccaaacattgccatctggttggccgatgcaccacaatctgtgctggaagttatggaggaagtgggcaaaaatgttgtttttgatctccacaagaattacagaaacatccatcagaaaatatatgtgcgaataaccaaccttcctgtctatgatcaaatacgcaatatcaggcaaattcatctgaacacaatgattcgaattgggggtgttgttacacgaaggtcaggtgtgttccctcagctgcagcaggtcaagtatgactgcagcaaatgtggaactgtcctgggtcctttcttccagaactcctacactgaagtaagggttgggtcttgccctgaatgccagtccaaaggtccatttactgtcaacattgagcaaactatatacaggaactatcagaaactcactcttcaggaaagcccagggattgttcctgctggcaggcttcccaggtacaaggaagtaatacttctgaatgatctgattgactgtgctcgtccaggagaggaaattgaggttacagggatatacaccaacaattttgacttgtctttaaatacaaagaatggcttcccagtttttgccacagtggtggaggcaaactatgtttcaaagaagcaggacctgttctctgcatacaaattaacagatgaggacaaggcagagattgagaagttgtcaaaggatcctcgtatcagtgaaaggattgtcaaatcaattgcgccatccatttatggtcatgaagatatcaagactgccattgcactagcaatgtttggggggcaagaaaagaatgtgaaaggaaagcatcgcctaagaggtgatattaattgtctcctcttaggtgacccaggcactgcgaaatcccaatttctcaagtatgttgagaaaacaggacacagggctgtatacacaactgggaaaggagcttccgctgttggactcacggcagcagttcacaaggatccagtaacacgggagtggacacttgagggaggtgcactggttcttgctgataggggcatatgccttattgatgaatttgataagatgaatgatcaagatagggtaagtattcatgaagccatggagcaacaaagtatcagcatatcaaaggcaggaattgtcacatcccttcaagctcgatgcagtgttattgctgcagcaaacccagttggaggaagatatgattcttcgaagacattcactcaaaacgttgaactaacagatccaattatttcgcgttttgatgtcctttgtgttgttaaggatattgttgacccatttacggatgaaatgcttgcaaggtttgttgtagatagccatgccagatctcagccgaagggtgctaatcttgaagatagagttgcagctgatgaggaggacgatccattgactgttgcccgaaatgctgacccagatatcctttctcaagacatgctgaagaagtatattacatatgctaagttaaatgtgttccccaaaatacatgatgctgacctggacaagattagtcatgtctatgctgaacttcgccgtgaatcatctcatggccaaggagtccctattgcagtaaggcacattgaatcgatcattcgaatgtctgaggcacatgcaaagatgcatctgagaagctatgtgtctcaggaagatgtcgacatggccattcgggtgctgcttgactcgttcatctcaacccagaaatttggtgtccagaaagcacttcagaagaatttccggaaatacatgacgtacaagaaggattacaatgaactgcttctgctccttctgcgcaccctggtcaaggaagcgctgcactttgaagagattgtgtcgggatcaaccacacgcctgactcatgtcgaggttaaagtggatgacctgaagaacaaggcccaagaatatgagatctacgatctgaggcccttcttctccagctctcacttcaacgacaacagctttgtcctggatgaagggcgtgggatcatcaagcatccagtagcagcataacaactcaatcaacctcagctacctctttgttcaagagcgaggtgaccagctagaaatgtccacttgtagtgtaagttggcaaaatgactgctcgtgtctgttttacgggaattctggtgttggtgtactgtttgctatctgaaacccttgtgcctccagtggcatttagagatgtttgtaccttcttgatgtcataattcagtgttatatgcacctgacgccatctttctatgagttggtgaattatgtttttttacttttgggacaatcattattggttggcaatactcctatctgttggttaaacagaatatgaatgactttaattaaattccttattacacattgttgtcccgcccgaaaaaaaacgagaaataaaaatgttgtaaaaattacttgg

SEQ ID NO: 8 - DNA, 1214 bp, Hordeum vulgare
caaagatctcccaagggccaaggcgaggagccaacaaacgcaaggccaccgccgccgtagtcgccgttctgcgatcgggtccgccgcagtcgccgttctgcgatcgggtccaccgccgccaccccgagagatgacgaaggcgttttacgcggtggggctttggatccgggagaccggtcaggccctcgaccgcctcggctgtcgcctccaggggaactacttcttccacgagcagatttcaaggcatcgcacacttatgaacatctttgacaaagcccctcatgttcacaaagaggcatttgtcgctccaagtgcatcccttattggtgatgttgaagttgggccagggtcttcaatttggtacggatgcgtcttacgaggtgatgcaaataacgttcaagttggatctgggaccaatatacaggataattccgttgtgcatgtggcaaaatctaatttaagtgggaaagtctttccaaccatcattggagacaatgttacagtaggacacagtgctgtattacaaggatgcactgttgaggatgaagcttttgttggtatgggagcaaccctgttagatggtgttgttgtggaaaagcatgggatggttgctgctggagcccttgtaagacagaacacaaggatcccttgtggagaggtatggggtggaaacccagcaaaatttctgaggaagctcacagatgaagagatcggttttattggggaatcgtctgccaactattccaacttagccagggcacatgctgttgagagtgctaagcccatggaaaagattgattttgagaaagttttgcgcaagaaatttgctcaccaggtcttgcttagtgtcactcaagaggttcctccagagctgcccccccccagtcctactcctgcccaataagcttttcttataaccatcttcagtttggattcttatatctctatctgtccagtgagtttggcagtttatgttgtaattttgggtcgagcaatgttctaaaaagctgactatctacttcagtttctgtattccatggaactaacagaactatttcacacaaattcactggcatgttttgcgtgcataatttactctagctgaaattgcgagatgcactggaggcagcacatgaactgttggcttgtagttaaatgattaatgaataaaaagaatgatgacagaaaatactgaaagataaattttattgttg

SEQ ID NO: 9 - DNA, 1473 bp, Hordeum vulgare
atcagaagctcagaactaccacgactcggggacggggtccggtgctcttcgtctgatcaatctcgtccgcgtttcttgtacattggggccaaagatggcaaggtcagccatgtccgggctagtgctcctgcttctatgtgcgacctgcagattggcgctaggaatcaccgatgggctgctggcgaacggcaacttcgagcgcgggccgcagccgtcgcagctgcgcgggacgcaggtggtgggcgcgtcgtcgatcccgtcgtggcggacgtcggggttcgtggagtacatcccgtcggggcaaaagcagggggacatggtgctggtcgtccccgagggcgcctacgccgtgcgcctgggcaacgaggcgtccatcgcgcagcgtctccgcggcgcggtccccggtgcgcgctacagcctcaccttcagcgcggcgaggacgtgcgcgcaggcggagcggcttaacgtgtccgcgtccggccagtcgggtgtgctggtcatgcagaccatgtacagcagcaacggctgggactcctactcctgggcctgggacgccagcgccgacgaggtcgaggttgtcgtccacaaccccggcgtcaccgaggaccccgcctgcggccccctcatcgactccgtcgccatcaagaccctcaccccgcctcgccgcaccaacaagaacctggtgaagaatggtgatttcgaggaggggccatacatcatccccgggacaaagtggggggtgctgatcccgtcgcggacggtggacgagcactcgccgctgccggggtggatggtggagtcgctcaaggccgtcaagtacatcgacagcgaccacttcgcggtgccgcgggggcgtcgggccgtggagctgctggccgggagggagagcgccatcgcgcaggtgatccgcaccgtgccggggaagcagtacgcgctgtccttcagcgtgggcgacgccagcaacacatgccgcggctcgctcatggtggaggcctacgccggcagggagtcggccaaggtgccgtacgagtcggcggggcagggcggcgccgccaagcgtgccgtgctcccgttccgcgccacgtcgcctcgcacgcgcgtcgtcttcttcagctcattctacaacaccaggaccgacgacatgagctcgctctgcgggccggtgatcgacgacgtcgcagtcgtcagcgtgcgcgcgcggcacccaaagcgcgcctagaaggctgagctagctggccatacagtgtgctgggtgcacggcgttgttgttgctgctgctgctgcatccgtgttaattaggcagctgttcactgcttgggcgctcaaactgctcattgagcttgaatgtgcacgaaggaattcgtcaggaacttggaagacgttaactgcacatgtgcgttcatacttgactgccactgccagatcccacttcgcaccctatgcgcgcatactagtcgtactttgtgcttgctt

SEQ ID NO: 10 - DNA, 1595 bp, Hordeum vulgare
gcagtcaccgacactctcctagctcaggccaagctcctcagccatggcggccatcacggcggctttcctcctcctcctcgccgccacagtcgccgcggccgccgacctctccgtctaccacaacgtccaccctccgtccgcctccccgctcgagtccatcatctcgctcgcccgcgacgacgacgcgcgcctcctcttcctctcctccaaggccgcctccaccggcgtcacctccgcgccagtggcctccgggcagaccccgccctcctacgtggtgcgcgccgggctcggctcgccggcccagcccgtcctcctggccctcgacaccagcgccgacgccacctgggcgcactgctccccgtgcggcacctgccccaccaacagcctcttcgtcccggccaactcctcctcctacgcgcccctcccctgctcctcctccatgtgctccatcctccagggccagccctgcccggaccgggacccctacgacagcgcggcgccgctgccgtcgtgcgccttctcgaagccgttcgccgacgcctccttccaggcggagctggccagcgactggctgcatctgggcaaggactccatccccaactacgcgttcgggtgcgtgggctcggtgagcgggccgacgtccaacctgccgaagcaggggctgctgggcctgggccggggccccatggccctgctgtcccaggtcggcaacatgtacaacggcgtcttctcctactgcctcccgagctacaagtcgtactacttctccggctcgctccggctgggcaccgccggccagccccgggcggcgaggtacacgccgatgctcaagaacccccaccgctcgtcgctctactacgtgaacgtgacggggctgagcgtggggcggtccccggtgaaggtgccggcgggatcgttcgcgttcgaccccagcacgggcgccggcacggtggtcgactccggcacggtcatcacacggtggacggcgcccgtctacgcggcgctgcgggaggagttcaggcgccacgtcgcggcgccgagcgggtacacgtcgctgggcgcgttcgacacgtgcttcaacacggacgaggtggcggccgggggcgcgccggccgtgacgatccacatggacggcggcgtcgacctggcgctgcccatggagaacacgctgatccacagcagcgcgacgccgctggcgtgcctggccatggccgaggcgccgcagaacgtcaactccgtcgtcaacgtcgtcgccaacctgcagcagcagaacctccggatcgtcttcgacgtcgccaactcgcgcgtcggcttcgcccgggagtcctgcaactagtttcctttcccaccggacgactttccttcacgcgttcgcgcagttagtcgagacattagccatgcatttgggtgtacgtacgtacgtacgtatgattgttaatctccggcttaattttcagtgtgtgcaataaggaatgtggcatcaaagtttgtcacgggtgcgtgcgcgagtgtcattagaactagagaattaccacgtactgcactagccgtaactatttacagtactatttactggagtgatgtctggttcattt

SEQ ID NO: 11 - DNA, 1701 bp, Hordeum vulgare
aacgccatcttgtgtgacgccatcgccgagagagcagaagccactccagttaagatggctccgctgatcaccgccgacgtcgtggtggaggctgcgccggccccgtccatggccgtgctaaaccaactggtttgcgcgagcgcgccaacgccgaccatcgccgtggtctccaagcatctggttctgccggagggcgctcagccggttggagacctcaagctgtccgtctccgacatgcccatgctctcgtgccactacattcagaagggcctcttcttcacgcccgcgggcatgccgactgcccgcctcgtcaagtcgctcttgctgtcgctgtcccgcgcgctcggggtgtttccggcgctcgcgggacggctcgtcacgctccccgacgaccgcatcgtcatccggtgcgacgacgcggccgtcgagttctaccatgcggtggcgcccgctctgtcgctcgccgacttcctcgtgcccgacgccgacgtgcctaccaggctgacgaaagatctgtttcccatggaccgcgtcgtcagctacgaaggccaccgccgcccgctcacatcgtttcaggtcaccgtgctcggcgacggcgctgtctttgtcggcctcgtcgccaaccacgccgtcgtggacggcacctcattttggcacttcttcaacacgtgggctgggctgtgccgcggcgagccagtccagccaccggacttcagccgcaacttctttggcggctccacggccgtcctccgcttttccggacgcgacggccctgcagtgacgttcgacgccgccgctcccctccgcgaacgagtcatccacttcagcgctgcggcaattcgcgacctgaaggcggcggccaaccgctgcagaaagaccaacgaggatgacgaggttaacggcaagctcgagcacgatctgaaggtccaggggggtggcggacagatctcctctttccagtcgatgtgcgcgcatatgtggagggccgtgacgcgggcgcggctgcagttgactgccgatgcgacgacaacgttccgcatggcggtgaactgccggcaccgcctgcgcccgaagatctccccggtctacttcggcaacgccatccagagcgtggcgacgacggcgacggtggccgagctggcttcgcacgaccttgggtgggcggcggccaggctgcacgcgaccgtggtggcgcacgaggacggcgccatccggcaggccgcggcggactgggaggcggcgccccggtgcttcccgctggggaaccccgacggcgcggcgctcaccatggggagctcgccacggttcccgatgtacgacggcaacgacttcggttggggcagggcggtggccgtgcggagtggccgagcaaacaagttcgacggcaagatgtcggcgttccccggtcaagccggggatggcagtgtggacgtggaggtgtgcctcgccccggacaccatgggccgcctcctctccgacgacgaattcctgcagttcgtgtcacatgcaccttgatggggtgcaccgcatctggctgtcttgtatgttgtcctacggtaccagcgcataggatgtgacatggctaccactgatcggtgtggtcgccggacatgtcacatgtgtgtaacacatgttgctgcgcagcagatatgtactggatttgtataattgcaaggtactatcaagaaagctcctggtcct

SEQ ID NO: 12 - DNA, 1326 bp, Hordeum vulgare
gtgttgcagcagcagcagcatccaccggcagccacgcctcctcgtcctcgccgcctgcgcgtcgcccacgccgctgcagctgctactgctttagccgtctccgacttccgttccgaggcgatcgccggccggatgggtgatctgggcgtacgggttgtgggcagaggctgcaccgcgcccatggagccgcgcaaggagatggcgccgccgccgccgatggagcagcaccatcctcccctgttcatggatttctctcgtcgagatggagtcgcagatggcggcaacgtgcggaagcggccgcgcgaggccgtggcgccgccggcacggctcttctccctgcaggcgtcgcagggttccccggggcacaaggtgatacacctggcgcagctgcaccgacggccggcggcgacgggcctgcggctcgacttcgacgagggaggctcggagcacgtggcgtgcacgtcgtcgtcgccgtcctccgttctccccggcgagctcgccgctcagtgcgggcagtacagtaacgagatcgaccgactgctccaggaacacgcggagagactccggcttgcgctggccgacacgaggcgtcggcagaaccgctcgctgctgggcgccgcggaggcgctggccgcgcggcgggtcagggagatgggggcggagaccttcaaggcggcacggcgcggcgtcgagctggaggagcagctggcgcggctgagggcggaggccgcgtcgtggcaagccaaggcaatgtccgaccagtccacggcggccgcgctccacgcgcagttgcagcaggcggcggccacagcgcaggcgaggagcggcaaggccgccttggacgacgacggcgcggcgggcgcggcggacgacgccgagtctggcttcgtcgacccggacagggtggtggaggtcatcgcgccgccgccggcggccaggccgtgccgcgcgtgccggctgcggccggcgtccacggtgctgctcccgtgcaggcacctctgcgtgtgcgacgcgtgcgaccccggcgtgccggccgcactcgccggcacggcctccgccgcggcctgccccgcgtgccgctgccccgtcaccggcaccgtgcaagtcttcttcgcgtgagacgggtccgccgccgctggatcatgaaactggggccatggagaaagctgtagatcagatcaagacagggtgcataattccttcctctctttgccctcccgtgctagtgggctgatccttccatccatgatcgcttcacctcttttgctagtgatgctgtaaatcattactgctgatttgaatcttgcgtgacagtttttactgcta

SEQ ID NO: 13 - DNA, 2702 bp, Hordeum vulgare
ctagtggatccaaagccggtctgcgcccaccgtcgcctttaacttccccctcctccgttaccgtctccccccttcccacctcccccacccgctgttcatcgacattcaacaggaattcgatttgatttcgatttgattgcgactctgctacgccgcgttccacccggggtggctgttcttcgattttagtagggttgcggagcccttggatttcgtgtagggaagcctcctcccccggccgtgtgatggacgcgagggagatgtgaagcctggccgttaactgatgctcgtggagagattcggaggagaggagcgcgcggtgaggaggcggtggaggcggaagcgccgaagagttggccaccagcgcagccacggacgacgcgcagccgccgggggacgaggcctggaacagggctgctccgccgccgctgacgcccgccgcctccatgggggagtcgctgctcaccgcgctctccatggacaccgccacggcccaccacccgcaccagggcccctccaccttcctctccatggacactgcctcccacgacgagttcgacctcttcctcccgccgccaggccccttccagcgctgcctccatgccgccgcagccgccccccctgacatcaacctccccctcgccgctgacccgtcgcctccccctccggctatgcagaccaccaccctccatgaatccaacgtcgacatgctggatgttggcctcggctgcccgcagctctatgactcggactcgcctgctgctgctgccgcagccacctcggccccggtgtccaccacaacaactgtccatgtgtctcacaccaagagctccggttccagcgccgcgcgcaagtgcgtgaagcggaacgatagcatctggggtgcatggttcttcttcacccactacttcaagccggtcatgtcggctgataagtccagcaagaccaaggcacccactgctgctgggaatggtaatagcgccacactggatgctttcctggtgcagcacgacatggagaacatgtacatgtgggtgtttaaggatcggccggagaatgccctggggaagatgcagctgaggagcttcatgaatggtcactcgcgccttggggagccacagtttcctttcagcgcagacaaagggtttgtgcgctcacaccggatgcagcgtaagcactaccggggtttgtcaaacccgcagtgccttcatggtattgagatcgtgcggacaccgaacttagtgggtgttcctgaggccgatatgaagaggtggtttgagctcactgggagggatgccaatttctcggttcccactgaggcagatgattttgaatcatggaggaatctgccgaccacggaatttgagcttgagaggcctgcaactgctgctccagcaaagagcacctcacatggccatcacaagaaggtgctcaatggttctggccttaacctgtcaacacatgcatcaaagcatggttctggggatggtttggacatctcaggcgtgtgcaacaaacgtaggaaagattcctccccctctgccatggaagaggattgcagcaattcaaattcagacaaggttcaggacatggatgtgagccacacttttgagccatcatggaataatgacttcaccggtgtgatgcgtcatgcttctgggccagtaactgctgcaaaaacaatatatgaagatagcaagggctacttgattatcattagcctgccatttgctgatatacagaaggtgaaggttacctggaagaacactcttacgaatggtgtcgttaagatatcatgcactagtgtcggacggatgccatttttgaagcgacatgaccggaccttcaagctgacggatccttcacctgagcattgtccaccaggagagttcatccgggaagttccattgcctacccggatcccagaagatgctactctggaagcatactgtgatgaatcaggaacaggcctagagattattgtccctaaacaccgtgctggacctgaagaacatgaagtccatgtgtccctgaggcctccctcgtcatggtgccaatgaaaacatgttgaaggtgtgtgatagatgttcatgtagtagttagagtgtccattattgtcagctgctcttgattgatcctttgctgtctaaccctctagtatgcggggagacaaggtgtggatgttaccatacaacaaatgcagctcagttttgctaattgtgacggagcaggccctagtcgatcgaagcattctgctagttggaagttggcagctgtggaattgtagggacatgctacaggccacaaggaacatatctggattactggtccgccctatgtttcggtatcgttgctggggaatacattgtgtattatcttttgctttttttgtggaagttttctttgtatgaaaggtttgtagccagcctgctcaatatgcttccatctgtgcaatactctggtgagcggtctgtttaggcatttatagtcggtttctgttggttggtgagaaatctgctttgtgggcattcttggaaatttcatccaaggaaggagttcatgccagtgtttgtaggatttgtccatgttttgtgggtactatattgttttattagcatttgaacgctttccagaaattgctggaaggcgagtgcaattgtttgatggagtaccagtgtaaacaatctgtcatcaatatagat

SEQ ID NO: 14 - DNA, 933 bp, Hordeum vulgare
ccttctcgtccacaccccgcttaaaaccctcgcaagcacccgctccacggcggcggcggcggcggcaaccaccacacagagaggagctcccaccagcgacgtcgcagctcacaaatggacagcggaagcgagtccgacggcgcccctgaggagctcactgccgtccagggtgtcgagaaacatgaagaaatcagcaaagtagagaaggacagtgctgtcagagcaacccaggaggagaaagaccggaggaaacgctgggcccaacgcaaaacatcctcaaacccgaaaaaaaagaaacctctgaaagtagaagataaagatacagaagtggatgaggagacacgtgctatgcccgggacactccccaagagcgtaattgaaatgcttgcagcacgtgagaagcaaaccttcacatcggattctgaggaagaaaatgtaagccaaaaggtccagaagaagaagaaaagattgaaaactacaattactggacctgaaacaattctgctgaaagatgttcgatcaacggagcacataaaaaaagccctcgaatttctgaatcacaggaaaaaccaggtgccaagatccaatgcagttttgaagaatcgtagtgccatgcgtctctttaataaacctaatttcacggcttgagtggtagactgaggcagtttctgaattctgtgtcgaggctcgtttggaagactattatggttgacaggttgagatatcaattgtttttatgtgttgaacaaacatatatgcttgtgatttgcagtgtcgtatgggggtgatgatgtataatgttcatcctcgttagacacctgtgatgtgtgagctgaatgcgcataatgttaacacttctccatggtccggcattactgtgaagcatgtgctttctgtgtttgccaattcatattcctttggaaatgagatttt

SEQ ID NO: 15 - DNA, 1859 bp, Hordeum vulgare
gacggcgcgcgccagacaggcagacagacagacagagagggaagaggaggccgaggcgcgacccaccccaagcaagccctaggcgacgcgacgacggccgccgcggcgaaggcgtgcccggattcggggctcatccgctcggcccggccatgtccaccaagagggttctttgcaagttcttcatgcatggtgcttgcttgaaaggagagtattgtgagttctcccatgactggagtgaccaatcaaataatgtttgcacgttttaccagagaggctcatgctcttatggtagccgttgcagatatgaccatgtcaaagtttctcgtaacaacccagtgcctccactaccatcatcaagtgccgcaacacgtaacccagttcgcccgccaccatcgtcaagtactgcaacacatgttgcatctacatctctacaacttctaagttctggacgtcctcttcacccgggacaccaaacaaactcaagcaaccaaaggcaacagatatctatggataagctgtcactttctgaaagtaagcctgcatggaggaatgaggtccaacctgacagtgtatcagaggatgggattgactggtcatccattcaaactgcgcaaaaccaaacttccatgaaacttgctgatatgccaatttgttcttttgctgctgctggtaactgcccgtatggtgaagagtgccctcacatgcatggggatttgtgtgcgttctgtgggaaaatgtgcttgcatccttatcgtcctgatgagaggcaggagcatatcaagctatgtgaaaagaaccacaagcggcttgaggctttgaagcgcagtcaagaaatagaatgcagtgtctgcttggaccgtgtgctctcaaagcctactgctgctgaaaggaaatttggactattatctgagtgtgatcatcccttctgtatttcatgcataagaaattggcgtggcaactctcctacatctggtatggatgtgaactcagcactgagagcttgcccaatatgccgcaaactttcgtactatgtcattccaagtgttctttggtacttctcgaaagaggaaaagttggagatcactgaaaactacaaagcaaagctcaagtcaatagattgcaagtacttcgatttcggaacgggcacttgccccttcgggacaagctgtttctacaagcatgcttacagagatggccgtttggaagaagtcgtactgcgacatcttgattgtgatgatggaagtacacttattgctaagaacattaggttgtcagacttcctcggtcggttgcatctctagggaccagcggctgcatatatatcgaatgcatcattctgggatttcgatgtctaccaaatatttgcagtattctgaagacatcagtttaaaatcgaggcatcttcgaaaactgctgcttttctccaatttattggtggttgctttgtcgccaaacatacaaagaaaattcaaagttcgctgctggacacctggatgaccttgtagtgctattgaccagtggaacaatgggaaagaagttatgccgcgagtatgcttgaaaagtgaaaaaaaaaaaaattagaactgctgaaacgcctttccgtatgcactttgtgttgcttcctgggtggtcaccagtgattcggtagaacgttacctggccattgtgcgaacgaccggtgtgtaatactcggccgtaatactcatttccaaaccgccatttccctgacgaggaaggctaccgcaccaacaactggtgaactgagaccgtttggttgtataacgtgtacgctggaggaaaaatggaaaagaattcaaagaatacgcttcatacttgatgatgttatgaagtttgattgg

SEQ ID NO: 16 - DNA, 1388 bp, Hordeum vulgare
ctccacctccctccaccacccagaccccaccctccgtcgcgccggcgatcccggcctcctctccccggctccgcgatgtatcctctggagatggaaggcagctcgaacccaaaggcgtccaacaagcccaagtattccaagtttacacagcaggagcttccagcatgcaagccactactgacacctggaattgtcattgctgcctttgcgctcatcggcgccctgtttgttcccatcgggcttgcgtctctgcatgcgtcacgacaggttgtcgaactggtgcatagatatgatgctggttgtgtgcccgtggatgacaaggttgggttcatccagaactccaggactgacaagacatgcactataacaatgaatgtgccaaaatacatgaagagcccaatccacgtctattacctgattgacggcttctatcaaaaccatcgaaggtatgtgagaagtcgaagtgacaaacaactgcggtataagagcgctgtacatttgatatcggattgtgtgcctgaaggtaagaccgctgatggtgctccaattgttccatgtggccttgttgcttggagtttgttcaacgacacatatacagttcgggtcaatggggtggttgctcaagtgaacaaaaaggacatagcttggaagagtgacaagaacaataaattcagcaataatatctatcccagtaacttccagaagggaagtcttataggtggtgctaagcttaatgagagcataccgttaagtgagcaagaagatctcattgtttggatgagaaccgctgcgctcccaactttcaggaagctgtatggaagaattgagaaagatatcaatgcaaatgataatgtaacagtggttatacagaacaactataacacatatagttttggaggatcaaaagcgttggtcctttctactgcatcttggattggaggaaaaaacaatttcattggtattgcatatctgactattggtggtctgtgcctttctcttgctatgggcttcttagttctctacatgattaaacaaaggacctttggagatcccacgaacctgtcatggaatagatgaatagagttaactattagactggagtatcctttctgagaataaaagggcattcaatgggtaaattcttccaattggatctatgggtgtttgttcttattgccattcaatgcgcttggcatggctcataggcatgaccatcttgttaactttggagccgtaatagcatcatacatacatgaacagaatgtattgtaatcggttgactaaaccttacctggccttagctgaccatactgagagtcgtttctgaattcctattatgaattataaaccaactaattgtgcttatggtaaaaaaaaaaaaaaaatac

SEQ ID NO: 17 - DNA, 953 bp, Hordeum vulgare
accatacgcccacactcactacttgcctcgtactgtgtcctataccacagctccgaaaagactgccaaggggctccgtcgtccatggacgtgccgaccgctggtgaagccgccgctgtgccgcagcgcacggcgtgggagtgggagggccgggcggtgtcgccggtgccggcggcgacggcggacgaggcgtgggcgctgctgtcggacttcctggcgttccacaagtggcacccgcgcgtggcggtgtgccgcctggcgtcctccggcgcggcggcggcggcggcggcggcggcgcccgggtgcgtccggtactgcgagggcaccccgcccgccgacgggacgcccgccgactgggcgcacgagacgctcctcgagcacgaccaggcccgccgcttcttccgctacgagatgaacgacaacaacatgggcttcggcgccttcttcgccgtgttccgcgtcgtccccgccgcggccggcgggtgcgagctgcggtgggagttcgagtgcgagcccgtgcggggcacgcccaaggaggcgctcgaggcgcggctgcaggccgggctcgacggcatggccgcacgcgtgcacgggcacctcatatccgcgcgcggtgccgtcgccgccgccgggactgcggggctggaggccgccgatgagctcaagctggacaactccatcgcggcctgatcgagctccgagcactcgatgtgcatgccaggcccggttccacctctgtgcgcacgtaccggcgacgtatgtttggttgtgatggtctcgttcctttctcgcggtactacgttgtcggatgatattttatctttgttctgttctgggcctttgttggtttgccgttatgtatgtgcgcgtacgtaccgtttactacagtgcggcagtagtacccctatatacagctgtaccgggaataactgtatgatattactcgtaatatat

SEQ ID NO: 18 - DNA, 1376 bp, Hordeum vulgare
cggcacgaggcatagctactcactgatcccactggacggttcgctactggcaacattcacgcctgcgcttccgtcccgtgacttgcctggccctgcctctgcggctgcgagcttcggtccgccatggcgcaaacctcatcgattccccgcgtcagcctcggcacccaaggactggaggtgtctaagctggggttcgggtgcatgggcctcacaggctcgtacaactcccccgtcgaggacgacgccggcgtcgccgtcgtcacgcacgccttccgccgcggcgtcaccttcttcgacacctccgacgtctacgggccccacactaacgagatcctcctcggcaaggcgctgaagcagctgccgcgggagaaggtgcaggtggccaccaagttcgggatccagcgggacgcccagggcaagagcaccatctgcggccgcccggagtacgtccgcgcctgctgcgaggccagcctccaccgcctcggcgtcgaccacatcgacctctactaccagcaccgcatcgacaccaccatccccatcgaggacacgattggtgagctcaagaagcttgtggaggaggggaaggtcaagtacattgggttatcggaggcgagccccgacaccatcaggcgtgctcacgctgtgcaccccatctctgctgtgcagatggagtggtctctgtgggcacgcgacatcgagcccgagattgtgcctctctgcagagaactagggattgcaattgttccctacagcccgattgcccgtgggtttttcggtggaaggggagtgacacaacaagtgtctgctgaatctagtctgaaaggccatccacgtttttctgctgaaaacctggagaagaacaagcaactttatctgaaaatggaagaactggccaagaagcaccattgcagccctgctcagctagctttagcctgggttctgcatcaaggggatgatgtggttccgataccagggacaactaagatcaagaatctagactccaacattgactccttaaaggtgaagctcacagaagatgacctcaaagagattagcaatgagatacgcgaagaagatgtggccggtggaaggcaatatacttcatttgcgaaattcacctggaattatgcagatacgccgaagaagtgaaactaaaaaagattgtggagacagtgatatgtgcgagcaaaacatgccatgatatctgctactgtgatgaatggtgctccctgtatcttcatcttgtgaattgtcccgtgaataagaacaattgcactgtctccacgtgccgtgtaaatttatgtgttcttgtgtaacagaagactgagactgcactagctatgtctatggctctctagtcttacgggctttccgtg

SEQ ID NO: 19 - DNA, 757 bp, Hordeum vulgare
gttggctggaggcggcggcagggcgaatctcttcagtatgagataaaccaacgcttatcaccatccctttcccccactctccagcctccacccttccgacgaaacccccgcccctctccccaagccaaagccctagccaacgggctagcgagctagccaggacctccctccgtagatctctgctctccgggcgtgctcgcggcgccgatccggcgatgacgaccaaggcgaagctcggggagctaatgtgggagcaccggctgcgcgcggcggcggcggtggcgttcctcgccgtcgccgtggtgtcgatctccgccgtcgggcccaggctcggcgccgtggtctccttcttctggccgctgctcgtctccacgggcttcttcctcgtggccatcaccgtgctgctccggatctcgccgccgcccggcggcgccgacgagtccggcaaggagatcatcgacttcgtcgccggatgccgccccgagcacctcctcccggaggcgtccgccaccgtggaggtgccgccggagccggagatctgaagagccgagcaggaggtacgcgcgcgcggccgcgagatgaccttgttcgctgggggagaggcgtgggggtaacctgtatgggcctaccgggcgccgggcgttccccggcgtgcggtggtgcagccgcggctagcgtaggatcctcccgtctccgtctccgtctccgtggtgtggtgtgtacaatagtagtaccattcaataaagatgttataaat

SEQ ID NO: 20 - DNA, 1916 bp, Hordeum vulgare
gagggagggaaggagtacaagagaggagagagaggaggcggggggcgaggcgaggcgaggagaggagaggagaggggcagcggcagagggctgcagcaggggcagaagcattagaaggggcagttgtaaccaagtggcagcagtagatagagccatctatctatctctctctctacagatcgcggctaggagatcagcgagcgcgctccctttccggatcaatctcgtccgagaagatagcaggccgtacgggagcagcaagcaaggggggaggaggggaggccatgatgctggagggcaaatcctgcctcgtctcgcgctccctgcccagctactgcgagccggagtccgagtgggcgttcctcgcccgcgaggtctccgtcatcagcggcggcaagcgccccgcgccggaagacttcggcgcggaagacatggaggaggcggacggcggcggcggcggcagcagcgggaagcgcagcaagtcgccttccccgcagccgcacacgccggatatcaccgagagccacggctccagccgccacgcctcctcaggcggcggaggtggggagcagcaaggctctggggccaatcttattggtgagattggtcgcgacctctccatcaactgcctcctccggctctccaggtcggactatggctccgtggccttcctcaacagggacttcaactccctggtgcgcaacggggagatctaccgcctgcggcggcagaatggcatcgccgaacattgggtctacttctcctgcaatgtcctggagtgggacgcctatgacccctacagagagcgctggatccaggtgcccaagatgccaccggatgaatgcttcatgtgctccgacaaggagtccctggccgtgggcaccgagctgcttgtctttgggatggcacacattgtgttcagatatagcatcctgaccaattcgtggacaagggctgatcccatgaactctcctcggtgcttgttcggatcaacaagcgttggtgagaaggcctatgtcgctggaggcaccgatgcttctggaaagatactgagctctgcagagatgtatgactctgtgacacacacttggacaccccttcccagcatgaatagggctaggaagatgtgttctggtgtgttcttggatggcaagttctatgtgatcggtggtgttaccaacaacaaccaggtcctgacatgtggtgaggaatatgacttgaatcgggggtcatggagggttattgagaacatgtctgagggcctcaatggagtcactggtgctcctccactcattgcagttgtcaacaatcagctctatgcagctgattacagtgagaaggatgtcaagaagtatgacaagctgaataataagtggatcgctcttgggaagttgcccgaacggtctgtgtcgatgaatggatggggccttgctttccgagcctgtggtgaccggctgattgtcattggaggcccaaggacttctattggtggcatcattgagcttaattcatgggttccggatgagcaaccgccggtgtggaatttggttgccacacggcaatccgggaacttcgtgtataactgcgccgtgatgggttgctgagtccactgaataaagattggatgcagtggatatttatgaaggatgatagtatgcacaaaggcggcctgttcaattgctccagccctgattcttcgtagcgatttatgccttctgcccggtttcagactttaactggacatctgctgagcggcagcactcatgtaacccttgagttctaatacttctgttttccttgctaatccatttctacatttgcaatttggatcaacagctcgtgatttcaaagatacgagactatgcaaaaacagtgttatattaataatctagaaacaacttccagaatgcctatca

SEQ ID NO: 21 - DNA, 1971 bp, Hordeum vulgare
aagagcaagagtgcgtccatataagcccatatgttgcactgcctggtgacctcccatctgcatcttcttcttccaatccaagccaagccatggattccctctactgcttcgtgcagctcctctccctcctttgcttcttcgtcttctactaccgccatctccagtccaagaaaataagcaaggcggagccgaccgaatggccgatactgggccatcttttcggcatggtcgccaacctctcccacttccatgactgggccaccggcatcctcaccggcacgcgctacaacttcgaagcgcgcgcggggatcaccggcgtccgcttcttcgtcacctgcgaccccgccaacgtgcgccacatcttcacctccaacttcctcaactaccccaagggccaggacttcgccgacatcttcgacgtcttcggcgacggcatcttcaacgccgacggcgactcctggcaccgccagcgtgccaagtcccagctcatcatggccggccctcgcttccgcgccttctccgcgcgctacacccgcgacaaggtggagacaagcctcctgcctttcctcgcgcacgccgccgacgccgggaccccctgcgacctgcacgatgtcttcctccgcctcaccttcgacatgacctgcaacctcgtcttcggcgtcgaccccgggtgcctgcaggtcggcctccccgtggtgcccttcgcgcgcgccatggacgacgtgctggagacgctcttcctccgccacatcatctcccccgcgtgctggaagctcatgtaccgctacgaggtcggcacggagaggaagatggccgcgggtcgccggaccatcgaccggttcgccgccgacaccatcgccaaacgcagggccgaccacaagctccgcgacgagggcgtcaccgactcgtccgacatgctctcgtccttcatctgcaacggtgacgccagcgagtacagcgatgagttcttgcgtgacaccacggtgaacctcctgctcgccggccgggacaccaccggcgcggcgctgtcctggttcttctacctgctctccaagaacccgcgcgtcgagcagaagatcctggacgagctggcgcccatcgcttcccggaagaagcagctggccggcgacgacgggaacggcatggtggtgttggacgtgagcgagctgagcggcatggtgtacctgcacgcggcgctgtgcgagtgcctgaggctgtacccgtccgtgcccttcgagcacaaggcggcggtggccgacgacgtgctcccgagcgggcacgagatgaaggccggcgacaagatactcatcttctcctactgcatggcgaggatggagggcgtgtggggcaaggactgcatggagttcaggccggagaggtgggtgaacgccgacgggaagctgaggtacgagccgtcctacaagttcatctccttcaacgccggcccgaggacctgcctcggcaaggagatggcgttcgtgcagatgaagaccgccgccgccgccgtgctctggaacttcgccgtcgaggccgtgccaggacacgtcgttgagcccaagctgtccatcattctccacatgaagaacgggctcgccgtcaccgtcaagaggaggaacgtcgcggccgtgcatggctagctagtacgtgcctgcacttctcggccgcaaggtatacggggcgtacgtacgtagctacacgtagcggacacgtacatacatgtacgtacgtactagtatatgtatgcaagagtggcatgtgtgcttagtaatatactgctaccagaataagaaaataagaagaatagacgtgtgtagtatagtgtgcgttgtgacatactcctatatgtgtgtaagctgtgtgtgtgtgccctaattagaaagaaaatggacgcgtatgggcaccagcgtggatgcatgatcgatctatacaggttggcttgacgcttttgcacgctaaaaaaaaaaaaaaaaa

SEQ ID NO: 22 - DNA, 4191 bp, Hordeum vulgare
gttcctgtgccggctgcggggaggattcgtgcggggcttgattcggcgacgctgctcgccatggccgggatcgacgacggcggggccgccgcgcagctggtgcagaagctggcaatctgtggagttccagaagagcagcagcatcaagaaggcttgctcgtgtatttggaggagcacaatgataagattcctcagatcacggcggccatcttgtcagcaggcacggatttaatggagtccggcaactcatcgaaggataaagatgacagtagcagcagcagcaatgcatacagtgagagtatgttgtggttgcagtggatgatgttcggcagaaatcccgatgcaatgcttcatgacatggagcttagctccgaggatgaccgcgctgtttgcggcactgtatgggggcagaattgccttgcttaccgctgccggacctgcgagagtgactccacatgcgcaatttgcgttccatgcttccagaatggcaatcacaaggatcatgattactccatcatggaaacaggcggtggatgttgtgattgtggggatgctactgcttggaagcctgaagggttctgctcgaggcacaagggggccgaacaaattaagcctcttaccaaggagcttgcgagttccgtagggcctgtgttggacgagctcttgctgttctggaaggagagtatatgtgtgcctcgtgaaaagtcagatgattgcaagaagagggttgcccgagagttgacgatttctattgctgacatgctgcttcgcttctgcgcgtgtagtgaaagccttctaagttttgtgtcccaaaggatccatgagtgccctggtctactggatgcattgatgagggcagaaatgttactggacaagaaagttgtggaaaaattgcatgagttgctgttgaagcttatcgctgaaccggcttttaagtatgagtttgctaaagttttcatacagtactaccctgttgcattttctgaagttattgaagggggcaatgactatgtgctggaggagtatctgctgatacagaacttttctgtccaaatatttaccgtgcctatgctgactacaatgcttgtgcgcgatcacaatttgttgggtattcttcttgaatgtttgacagctctgtttctttcttgcgttggtgaggatggtcatttacagaccagcaaatgggtaaatctgtatgatgcttctattagattgttggaagatgcacgctatgtcctgagacatgaggaggtttctatgtatgttgcttctgagagacctgatctaacaaggtcatggattaagctgttgtcacttgtgcaaggaatggatcctcagaagagagtgacgagtattcatgttgaagatgagaatgagaatctatatgcgccttccacgctaggacattattttgggatcattcacaatcttttgatgaagggagcattttcttctcctgggcaacaagaatcaactgattttactgtatgctccattgcgacaaaaggcatcgaaagtgctgagaaccagcggcttgcaaaagttggcaggatctcccaggagaactcggtatgcaatttaagtaccagaaagagtttttcgagcagtaaattaccatcacctgctgcctgtttaattcgtcagtgcttggaagctattgatagctggctggaacctggtccgctgaggagaaagtcgttgtccgttgatgctatcaggggtggatccgataaacatattggtgagatgggcatgaaggtaaatgaaggatcccaactagacgatgttgcagattattatgaagtaattgatcctcctattcaagaacccgacaacatggtaatgataggtaaaggggggatgcctcacgttggtaacgtcacaggcaagggaaagatgcaagaaactagcagtgtaccggatgtacaattgcactctgaaaatttcattgctgttgctctgaccgatggcagccttttatatgctcacccagattcaagaactgatgaactaggaatactcaacatgacaagctggccacgtgttgtctttgatgtcacttcacaagaaacgtcttttcatattcctttacaccgtatgctttcattactattgcgtgaagcaatgaagaaatgtttcggagaggatgccaaaacagaggaatgttcagttgtgcagtccaatgagttcttctctcaggtacttggaggttgtgagccttgtgggtttgcttcagttgtgatggagcatccattaagattgagagtattttgcgcacaagtgcgtgctggaatgtggcgtaagaacggagatgcagctgtacttagtgctgagtggtaccgctctgtgcaatggcttgaacagggcttggagtcggatttgttcctgcttcaatgctgtggtgcattatcttctccagagttctttgtgaggaccattcaagaaagatttggtttgtcagattatacatctatggatctcacggaacagaatgagtatgaatcagttcttatacaagaaatgctaacttttcttgtgcaactagtcaaagaacgcagattttgtgggcgtcccacagcagacaacttgaagagagaattgatttataagttggccgttagagatgccactcatagccagattgtgaagtcccttccccgtgacctttcgtcaagtgaacaacttcaaattgttctagattcactcgcagtttattctgatccatctggaaagaaaaagggcaagtatgtgcttcgcgaagcattctggaaggaattggacttatatcacccgcgctggagttcgatggaattagagattgctaaagagagatattaccgttgttgcaaagtttctgctcttggcgctcaactacctcaatggactcatgtttttagccctctgcgcagtatttctaaaattgccacctccaaagctgtccttcaaattgttcatgctgttctcttctatgctgtttacaccgacacatcatcggtatcacgtgcccctgacaatgttctcgtgactgctctgcacctgctttcgttggcacttgacatatgtgaatcagagagtcaaatgtctgcggaccagtatgggatggacttagtgcagcatgatgatgaatcatgggttgttctgtcatctgatgcagtagaggcttttcccatattgacctattctacagaactagtctccccagagtctgacaaactaaagaaggaaagcatgataaccttgcttgtttcactaatgcacaaggaaaagaatgacagcaccttttctggatgcaatattccatctctagttgaaagtttgttgaagagatttgccaagttaagtaagcagtgcatgtctgcagtaagacaaatggcaccacaagtactcccatccattcctgagcatgccagcgccaaacagaatttaggatctccagattcgacgggaaacagccaatgcaaagctacaatcatggcaaaaatgggagcagagcagtcaaaacttgctgaaagtatgaagtcgtcaggaaatgaagggcctgatgttccaacatttgagccagatgcacctagatcaactgccatcgagatgcgaccattttgctctctttgccaggattcggattccaaaagtccactctgctgtttgattcgccttcaggctgctctggaaactatgatggcagagactgctgaggatggtcagaccccaagatcagttgcagagttcgcttccaacatactctcccatgtcggttccacaggctcgttgaagtcgccagctgttgaagttcttgaggataaactcagggcggaaagacggggtgcggccgcgctccgagaagaaatcgacgccttgaagaagcaggcagaaaaggccgacgcggtcatcgccaaaacccaagaagagatggaggaagtcaggaagaagcaagccgagacagaccaggttcttcagcttctcctgcgcaggtctcagggtaaccccggttcttagtctctgttgaaactgtggttctactggagtatgtcgaacttgtttgagtttgttgttgtgtgaaaaacttcgtatcttgtgtatatgttaaataaaatgcgagttaaatgttgtatttatgtggcatattcagtattagtatattgtattgggctatgcaatgcatgatgcttctgattgccatttggccggtag

SEQ ID NO: 23 - DNA, 622 bp, Hordeum vulgare
gccgtcttctctgaccccgagaccaaaacgcaccggcgtcggagcggctgcacgagggcggggcccaacgccggcgagcggtggcggcagcgtgctcgccaccatggacgagcaggagtttcggcgcatgctcgatctctaccccgtcgttcggtcccgcgactactgcaaggatgaattggaatcatcaagcaaaggcaccacacagcaagagcaagctcaggagataaaaggaaccaaaaagaaggctgcagaagatctattcctgcggaaattgaagatggctgctgagaaaaaggttggagcaacaaaggcagaactattctgcaagacattcgaagaagctcatgagaaacttgtttacaaagaattggatctggatgctgctcaaaggttcctgagtgcctacaagagttgatgatgaactgttgctagatgcctaaaagatttgatttttattcatctgaaactgctgaaggtgtgatgacgttaagatttctgatatttcctttgtggttctcatcttctgcgaatccatgtagacagccctggtcaatcagctacattattcagaatctgatgttgtgttatccttaacatagaccaaagaagaaaatgtatt

SEQ ID NO: 24 - DNA, 2077 bp, Hordeum vulgare
gaccggcaccaccaccaccaccacgctacctacgcggcccacgcccacgcacgcaccggcgaacaatccgagctggctcttttggccataggcacagcggatcattacccaatcacggatctctagcctcgccaccgcccgctgctccgctctgctcataatccccctcgcctcgccaccgtccgccgctgccgctgtttcttgtgctgccgccgcgtccaggaggaggaggaggagatgaaggagatgatggtggggtcggtggcgccggtgggcggggtcgggaggtggggggcggcgccgccgcaggagctgctggagcggatgaaggactacggccaggagggcgccttcgcgctctgggacgagctctcgcccgaggaccgcgacctcctcgtccgggacatcgagagtctagatctttcaaggattgaccggatcattcgacgctctatgggatcacaaggctatgtggcgcccgccgagcccgtgccggaatccagcgtctcgagggtggaggagaggtctcccgaggacaaagaacggtggtggaagaagggtttgagagccatctccgaggggaggctggccgttgtccttttggctggtggtcaggggactcggcttggtagctcagatcccaaggggtgtttcagtattggacttccatctggaaaatcacttttccaactccaagcggaacgcattttgtgtattcaaaagttggctgctcagtccagtgatagtccaagaaatactttaccaatccactggtacataatgaccagccccttcaccgatgatgtcacacgcaaattctttgaaagccgtaaatattttggcttagaagctgaccaggtgacctttttccaacaaggcacccttccatgtgtttctgacgatggcagatttattatggagacgccatacaaggtagccaaggcacctgatggaaatggaggagtttatgctgctctgaagtctaagaagttgcttgatgatatgtcttcacggggtgtgaagtatgtagattgctacggagttgataacgtattggttcgtgttgcagatccaacgttcctagggtactttatagaaaagggtgtatcttctgctgcaaaggttgttaggaaggcttatccacaagagaatgttggagtatttgttcaaagaggtcgtggtggacctctttccgtggtcgagtatagtgaaatggatgcggctatgactactgaaattaatcaatcaacaggacgccttcgttattgttggagcaatgtatgcttgcatatgttcagtttggaatttctgaatcaagtcgcaaacagccttgaaaaggacagcgtgtatcatcttgcacagaagaagataccttcgattcatgggtatacaatgggcctgaagcttgagcagttcatattcgatgcattcaattactccccgtccacgacactttttgaggtgctacgtgaagaggaatttgctccagtgaagaacgcgaatggctcagcctacgacacccccgatagcgccaaactgatgctgctccgactccacagcagatgggtagtcgctgctggcggcttcctgacccattctgtgcccttgtacatgacaggcgtcgaggtttctccgctcagctcctacgccggagaaaacctggaggcgatctgccgcggacggacattccacgctcccagcgagatctcgttctaggcgcatcggttcatcatagcggcaggaagaagcagtgttgcacagggatcgcaaggccgaacggatgcctcacagtttgggatggtggtttgggacattggtgtattgagctgagctctttgagctatcggcattagggttttcaggtactggccagactgttgtatcttttgtgagtaattggcccagattctgaatgcgtcttgtcttttgccatttgtaactcttttggctgttgctgccccctttagatgagcaccttcaattgtactaatttggtgccccatttatccgcgcttacgtttggacacccaatttccccccacatatgtgctatatagggatgcaactttgaaagagc

SEQ ID NO: 25 - DNA, 880 bp, Hordeum vulgare
cgcgaaggtttctttaatcccgtgaagaaacacacaagaagggaggagaggcagcacgcaatcagccagcccagccagccgctcgccctcgccgccgcccaattgacccgatcgaggagcctcccaggcccagcgaaggggcagaggcagccatggccaccgccaacctgtccagcgtggtggtggcggtcgacggcagcgaggagagcatgaaggcgctgcgctgggcgctcgacagcctgcgcctccgccccgacggcgcgctcgtcgtgctccacgtccagccgccgcccggcatcgccgcgggcctcaaccccggccccatccccttcggcggccccagtgtggcggaggtgccggcgttcacgcaggccatcgagtcgcaccagcggcggatcacggaggcgatcctggagcacgcgctcaagatttgctccgacaagaatgtggaggtgaagacgcaggtggtggtgggggatcccaaggagaagatctgcgaggtgacggccgaactcaaggccgatctgctcgtcatggggtgccgtgcttttggccctgtcaagaggatgttcttgggcagcgtgagcaactactgcatcaacagcgtcggctgccccgtcgtcgtgatcaagggcacctgacccatcctccaccaacaaacattcgttgttgcgttccgcatcatgttttctgaggttgccaccgtgttgttgtgtccactcctgtgcaaattcactgcacacttccaacactatctatggtctattggtttatatgttatcattgacgttgtttgctagtgcttggttggatgaggccgaagaactgctcaggtctgtacattccgtgcgtggagattgccaaattggttggttgtggg

SEQ ID NO: 26 - DNA, 1029 bp, Hordeum vulgare
ggcgaggcccgcgtggaagcagccggccgatgcccccaatggcagcgtccctccgctccccgccgcccgtgcccgccgccgccgccgccttccgccgctcccgcgccgccgtcgtcgtctgcgcctcctcctcttcctcctcgtcctcctcctccccctcgaccgtgtcgtccgctcccaaggcgcgcttcgtcgcccgccgctccgagtccacctccgtccagcagctcgcccgccccctcgcggagtacatgggcctgccggcgagccagtactcggtgctggacgcggagcgcatcgagcgcgtcgacgagtccaccttccgatgctacgtctaccgcttccgcttcttcgcgctcgaggtctgccccgtcctcctcgtccgcgtcgacgaggagcccaacggctgctgcatccgcctcctctcctgcaagctggaggggtcgccccttgtggaggcgcagaatgacaaattctccgcttccatggtgaatagggttttctgcaacaacaattcagatgactcgacgcttcaacagcttacatcggatgctacaatcgaggttgcaattgacattccctttccgtttcaagcactaccagttgaagctattgaatcaagtggcaggcaagtgcttgagcagttactccgagtcatgcttccacgatttctgaagcagcttgataaggactaccaagcttgggcttcgggcgattcttcacggaaaccgcttggcaccggcgaaatatgaagctgacccgtatattcataggcgtaatgatagtgttttcttgtttgatctagttaatgtgctcgcacatgatccacttcctcatgatagtctgtccttggaaactctcgtggttgtatattgtcatcccacagtcatttggtcgatccatgcgttttttcttcgttcaaaaggaggttcaaacccctagcctccgcaccattgtgatgcacacaacttgtgatccaaacgcttctttgttgtgcgtgtctttctcttattggcaccgcttgttgct

SEQ ID NO: 27 - DNA, 1556 bp, Hordeum vulgare
aagattcggatgcagatgggggtcatgtctccgacgaagctgaggatgcagttgctcgggatgggatcctcccacggctacggaggcgcccagcaagtcgccgccgtccaggctcgacgtcgacgaccaccccaagaacagcctcctgccccagtagcccgaccaaggctcctcctcagagtaccccaaggaccgctccgactcttcttcgtcccgctcgcgctccagcggaagccacggcaggtccgctgcccactctaccaacggcggcagcttctagttccgcatggaggagcgggcggcagtggccgggctcgggccattcttccggcagcaggtgccgtccaagtggaacgacgccgagaagtggatcgccgggaggcaccacgtcgtgcactccaatcccatcttctccaggaaggccgcggcctccgtgcacggccacaccggcgtcggcggaggctgcgtgcgcgtcgtgccggagtctgcgccgccgccgccgccttcggacgccaagaagacacccgcgctaaccgagctgtcccggtcgccttctccgtcctcgccgtcgtcgctctcgtcggtgaccgggccggccagcaagcagcgccgcgacaccaagctccgcacccaggtccaggtgggcgctccgtcgtcgtcggtgtcgatgagggacgtcggcacggagatgacgccgatcgccagccaggagcagtcgaggagcggcaccccggccggcgccgccacgccgtccttcagcccgctctgctcggtgccggcctcgccgtccgcgtcggagcgtgagctgcagatcaggacgcgccgcgagatcgccgcgctcgggctgcagctgggcaagatgagcatcgcgtcctgggccagcaaggaggatcgcttccgcacctcgccggagaagagcgccggcgaagaagaccgagccaagaaggcggagttcgaagctcgggccgcggcatgggcagagtccaagaagtgcaagctcgcatcaagatatcagaggaaggaggtgaggattcaggagtgggagaactgtcagaaatcgaaattcgaagccaagatgaggcatgcagaggtgcaggccgaccaaatgaaggcgcgggcaaagaacagcctgaccaagaggctgtccacgttgagctacaaggtggaggggaagcaggcgagggtcgaagcgaggcggaaccggcgggcagtccggctggcccgtcaggtgcagcgcatccggaagaccggccgcgtgccgtcccggttccggtgctgcagctggttcctcagttgaaaatgaaacaaaattcagatggcctctcaagtgcagcctgactgaagaagcagcatgaaggtctgaatgcaaaagcctccgggacgagatgtacatgaaattatttgaatcaatgtgctgtaggtgttgctttgctctgtagtctgtacaatctgaatgtctgtgacctgagctacagtagcatgttgccgttgttaacatgagctaatgctaatggcctgctgactaatgtactgagaaattgagatcatctttattg

SEQ ID NO: 28 - DNA, 2300 bp, Hordeum vulgare
catcttggcatttccgcggctccgccaatataaccctcgtccccttcattttctctctccaaccactccgccccgccccgcctccctgtcgtgtcctgtgcgcccgtcgcgacaaccatctgactaagcagcagcccatggcgccggcggtggggatcaagcggaccgccgcggcgcagacggtcacggtgcaggcgccgccgccgcccgacgcgcggctggtgcgcgaggccgtgcggacctccacgatcgccggggccgtcgcccccgcggccctggaggcgcccgcgcccgcgctcgagggcttcctgtgcctcgaggaggtggaggggaggcggtggaagtacgtggtggatgcggcccccgggaaggcgaaggcgaaggcgaagggcaggggccggggcgggtccgccgtccccctgggggcctccgtccgggccgtgccgctccagtccccgcttccgcccgccgaggaaataatggcatttgtaagatcgtatgttgtgcctgaagggtttccagacagtgttactccttcatatgtcccgtacatgacctggagagctctcaagcatttctttggtggagcaatgggggtgttcacaacaagaaccttgctgagctccgttggagtctctcaaagcaaggtaaccccaggtgccattgctatcaactggatcctcaaggatggtgctggacgtgttggaaaaatgctttttgcacgacaaggaaagaagtttgacaatgacctaaagcagctccgcttttctagtgatctcttgctggagataggcgctgggatagagttagctactgcggcattccctcaatttttcctgcctatggcttgcgttgcaaatgttgtaaagaatgtcgctgctgttacatcgacctcaactcgcactccaatctacaaggcctatgcaagaggagaaaatattggagacgtgactgctaaaggcgaatccgtggggaacattgcagatctgctgggaacgggtttgagcatatttatcacgaaacggaacccatcgttggtgacttcatttgcacttctgtcatgtggatatctcctgagttcatatcatgaggtgaggtccgttgtgctgaataccctaaacagggcaagatttactgttgcagtggattcctttattaggacagggtatgttccctcgttgaaggaaggaaactcacaggagacaatatttattcacccttggcggcatgagccagtttcaataggatcgcgatttggagaagcgtttcaagaacctgtttcgtttgttgccacaaggcctttgtttgaggatgagcgatacatggtaacatataacccaacgaaggataaagtatatgctttgctcaaggaccaagcaaagccagatgacattctcaaagctgctttccatgcccatgtgttgctgcatttcatcaatgtatcacatgaacggaagagaatgagctccaatcgatcagatcactacgggaacccgcacccacggaacatggatttcctggcacacatcgcagaatcttgcaaaattgtatcgtcatcttatggaacattcaggaagaaagcaaaagaacagggttggataatgtcggaatcgcttcttaaccctggaaaggctcggttatgcgtcacgagaccgcagtgacttcactatttccgtgtaccatcgacgggatgataccatctctagctgtcaggctaactttttcgacgaagacgggacatgatgctgatgagtttgttagtagctgaactaacctgtgttggagcccggcctaggtgtgaatcagcgagcctatcatctcgtgcaacccccatctcgtgcaacccctaactgctgtaacaactacagctgccgaaatctggggacaccaagaagctgcaacttgttatcaaagaaataacgcgggaggaggtatgcccgcgccgagccatgagaagactgagggcgacctccaactgttaactgcatgggagtaggttccgtagagggacgtatatttaagtttgctggtagtagtgtcgctatgataggacttgctaactgtatgtagcctgttcgtgtgtggtgttcgtcggctgcggagtcgttttcgaggtctaggaagagctgtttcctttttttttttgctgacctgctgtgcttcgggatatggtgttcgtcatgcacctttgtagggccgcttgttgtaagttgcagttttccggatggagagcgttttcatgtcgatgcttgtacatactagtacctgcttgttgtaataatcggaagcgtttcgctgtt

SEQ ID NO: 29 - DNA, 1407 bp, Hordeum vulgare
cctccctccctccgtctctcgattcttccaaagggttccgttccccatcgccggtttccatttctgttggaggtttgcgatctgggggagatcgaatcctcgcctgcggcgggtctgccgttcgagttcatggccacctcgggcgatcagtcgggcggctgcgggtcggcggcggtgaagggttcaaagctgcggtaccctctgcggtccgcgggccgggtcaagctggagccgccggcggcggcggatgcccctcttagcggctctgcttcgcgaagggccaaaccatctttagatgtcaccaagagctgtgctctcgatctttctgccgtgaaggataaatcagctaaacctccgcggaggcactcaataccaacaaagccaggtgttagtccgaggcctactcctactggaactattactccagtgtcaggggttcgaccgaggaggtcagagaggttggataccccaacatcagaagcatccatgtctacagcaaggcgcaagttcagtacactctcctcagtctcatattggatgacacagattaggcttgcagaggctgcttccaagcactctatctctctgggcttcttcaagctggcccttgagtcagaatgcgagcctctggatagaatgagagaagaactcaaggcttatgtggcccggcatggccttgcaacagaattggaggagccggtgaaggaggttcttcaggtctatgatattgtggaagattttgagaagctaaagatctccctggactcttcacaagagccaaaaaagtctgacaaggctgctgttagtgctaccaatgtgactccaaagggtaatctgaaacctagatctctgaactctgttgcagctcatagtaaagatggcaagaaagagaacattcagaaggagaagcctgatgccaaaatcagaggttcctacaaccggaatccagccaagaatgctcctgcaaaagaaggtgccaaaaataccggcaagaaaaccaagaagcaggctaaggagcagcaagaagattgcaatggaggtagtgaggtttcgccagttgacgcagaccaagaatctgttgatgtggtgaaggagatcacatatgaagataaggagaacatgggggatgctgagatggcaatagatgctggcaacgccgtagcccaagaagtctagaattgacagactgacttcagattcaaaccttttgtttgctgaatatgaagtatcgagtgtggtgcttgttttctttcgccgttgttgatatgtcactagtacttgtctttctggttgtcaagccgtaatatgtctttaagagtgtgtattatggtttgctgggtgagactgctcgcttgttccctttgtctaagtcagtttgcttatctgtgtccagcttctgaatatagc

SEQ ID NO: 30 - DNA, 1038 bp, Hordeum vulgare
agcgatagtcattccaccatccctttgtgtgcagtctgcaccaacctccgtgcttttatccatctattaatccaccacctcaagctccaagatttcactctcactagcagaatccacccgctatcctatcatggctcctcacgccgctgtcctcctctccctcctcctgctcaccacctgcgcggcggacacgcatctccacttcttcctccacgacgtggtctccgggagcaacccgacggcggtgcagatcatcaagggcccggcctcgtcgtccaacgccttcccgggcatggccttcggcgacacgaccgtcatcgacgacgcgctgacggagacctcgtcgccgacgtcggcgcccgtggggcgcgcgcaggggttctacatgatgtcgtcgcagtcgggcatggtgctgatgatgtgcgtgaactttctgctcaccacgggggactacaacggcagcacgctcgccgtcatcggccgcgacgacatcatgaccaccacgcgggagctctccgtggtgggcggcacggggaagttccggatggcgacggggtacgtgctgtggaagaccaacagttcgaaaggcgccgacgccaccatcgagctcgacgtctacaccaccgccctcaacggcaccaccaccatcgacgccaacgcgccagtctcccccatcgacgggggcggcggcggtacggccggcggggccaccgggaagtcgtcatcgggcgcggcggcgctgaggggagcagtaccttacgggtgggccaacgcgtgggtagccgccgtccttgtagctctggctggttgcgtttggtgagcagctcgatttcgatacaccatgaatctgagtgggtgcgagtggggtccatacatacaacggaatagatcttgattgggcgtgaggcgttggtcggtgtagtggtgtggttggtgatgatggggtgggtggtttcttgtcgctgttcgggttggggttggtgatgtgcacatgattgcgcatctccatgcgtgagcgtgagaggttactttctggct

SEQ ID NO: 31 - DNA, 1077 bp, Hordeum vulgare
cacaagctatccagtcacgcgtccgcgccgaaaatgtcgcctccggcaccatgccagctcctcggcgctgagagcgcccacgcgacggcagagccattccgcgtgtacgtgggctacgactcccgcgaggacatcgcataccgcgtgtgccggcgctcactgctgcggcgctcctccgtgccgctggaggtcatcccgatcgtccagcaggagctccgcgaggccgggctgtactggcgggagcgcgggccgacggagagcacggagttctccttcacccgcttcctgacgccacacctcgccggctaccgcgggtgggcgctcttcgtggactgcgacttcctcttcgtggcggacgtggcggagctggcgcgcatggccgaccctcgctacgccgtgctctgcgtgcaccacgactacacgcccaaggaggccaccaagatggacggcgccgtgcagacggcgtacccgcgcaagaactggtcctccatggtgctcttcaactgcggccaccccaagaaccgcgccgcgctcacgccggaggccgtgagcacccagagcggggcgcatctccaccgcttcgcttggctcgacgacgccgacgtcggcgaggtgccgttcgcgtggaacttcctcgtggggcacaaccgcgtggacccggcggacgtgggcgggaccgcgccgcgcgccatacactacacgtccggcgggccgtggttcgagctgtacaaagactgcgagttcgccgacctctggatccaggagcgcgacgcgtacgagtcggaggagaaagaaggcgaggtggaaggcacaagagtgccatcatcgtctgcagttgctgtggacgcatgatgcaccacgtgttccggtttaatttttttacacagcacaccacgtgttccgttcgtctttgttggttaatttgcttgtttgacgcgcggtcgtgtcactgcgtacgtgccgttgtcaagttagttcctactgcaagtgtaacgatcgagtaccatgtgtaagaataaggacctgtaaggcgcgttccttgagggccaagtatccaatataattatcggttttgct

SEQ ID NO: 32 - DNA, 966 bp, Hordeum vulgare
aaggaatttccagcctccgcgcctcgtccccaccagccagccgccggacgaggaggaggggagaggaaagcggccgctggatcgacgatgatgtggggcgtcgcagccgccgtcgcctccgcggccgccgtcgccgtggcctccggcgccgagctcctcgcctgcgactgcgccccgacggaccccgccgccgccgtcgccgtcggcagatgcgacgacttcctcctccgccagcgggaaccctcgtcgtcgagcgcggggagcggcgtcacggacgacaagttcgcgccgcggttcgacgggctgcgcttcatcgagacgctcgtcacggcgcaccgctgaaaccccccctgggggattctttccagtcgtcttcttcgtgcgattcgcggggagaggctggctgctaccctattaattcggcgattggcgaccaacgcgccgccaaatttttgctactaggacaaattgaggttttttcgtttctttttctcttcctttgctgatgacgattatcgtcctattgttgttgagtgatgcgattgaattggaaccttcaagtatgtgatgattgtgtgtaccagtgccagcagcggttctttacctgatccgtcgtgcaagcatggtattggtatgctatgatttcacctccaaactttgcagttctcatgtgtggtaggtctgccgtcctctgtttgtggttggcctcgttccgggattgtcctttcccccactttgctgcacgcgtatcacatggctcaatgcttggagtccatcctgtccatggattttggggtaaaattagcagctagagcacctcgatgtatgttaatgattactgattctgctcggccaaattagtggctccttgccgtccatgtctgcttcctgatttggataaccattttcagctcatattcacttgtttctgttctgtacaacaagtagaagaatatgtttgtcata

SEQ ID NO: 33 - DNA, 2393 bp, Hordeum vulgare
gcggcgcgcgagctttctacgccccctcgcctccgctgattagcactggcaccggcgattagcagtataccagcagtgaaggcgaggccttcgagcccgcaatccctttttttctgctgctgctgcccgcaagattacaaaatcctgcgtttgtcctgttgccgctgcttccgctggcgctctcgggagggcggccatagaaaggagataaggagacgaaggaacgaaaataaaagaaataaaggctggaggcttttggcgctcataatttttggcctctctctgcgctccccggggagattttccggcgctttctctctttctttccgggtggtgggagagaatccagcctctgaattcgcagtttctggttcacagcgagagagtgttcttgagtcggtgttgatccaatgggcgagatgaaccaccagccggggcagccgccggtgggcgtgccgccgcccatggggatgcagcccatgatgaacgcgccggtcggcgcgggcgccatgcaccagccctacgagcagttcaaccaactcaactactgcgtccactccaatccttcttgggtgcaggtggcagggcttgcattcctccactacctagtgatgttgggctctactgtcatgcttgtgtcaactatagttcctgcaatgggtggtggtcctggtgagaaggctcgtgtaattcaagcgttcctgtttgtgagtggcattaatactatgctccaaacactcgttgggacacgacttccaacagttatgaatgcctccttcgcatttgttgtcccagtgctgtcaattgccagacagtttgacccaaacgactttggcagtaatcacgagagattcgttcacacaatgagagcaactcaaggggctctgattgttgcttcaatcctcaacatgattcttggatacagcagagcatggggggcatttgccaagaaattcagtcctgtaataatgactcctgttgtttgtgttgttggtcttggattatttcaaattggctttcctcaggttggaaaatgtgttgagattgggttgccaatgctaattcttgcaattgttgtgcaacagtatgcgccactttacttcagacatatccatgatcgaaccaccttcttgtttgagaggtattcgttgcttctttgtatcggcattgtgtgggcctttgcagctatccttactgctgctggtgcatacaaccatgtttcactcaagacacaacagcactgccgcactgacaagtctttccttatatcatctgctccatggatcaaaattccataccccttccattggggtccaccgatcttcactgcaggtcattcatttggaatgatgggtgctgtgcttgtttcatcttttgagtcaactggtgcacactttgcaactgcgcgtctagccggtgcaacaccacccccagctcatgttcttactcgaagtattggtttacagggcattgggatattcctggcaggactgtgtggtgctccagccggttcatctgtatcagtcgaaaacatcgggctacttggattaacaaaagttggaagtaggagagtgatccagatatcaactggcttcatgctattcttctccatatttgggaagtttggggcgttctttgcgtcaattccgttgccaatcttcgcagcaatttactgcatcttgttcggtatcgtagctgctgtgggaatctcgttcagccaatttgcaaacaaaaactcaatgaggaacatctacatcatcggactatccttgttccttggcatctcgatccctcaatatttcgccgagtacaccgcttctgctggccgtggacctgcccgaacaaatgcaggatggttcaatgacatcatcaacacagtttttgcctccggcccaacggtggcgctgatcgtcgcgtcgcttctggacaacacgctggacccccgggccaacgaggccgaccgggggctctcatggttcacaccctttctgcgccgccgtaaagggtactcggaccctaggaacgaggagttctacagctacccgatccgggtccacgacctgatcccgcaccggtttctctgattctagaaggaccgctgctaattatcctgtgctgctgtgcgtgcatgtaaatcccctttgttctttttagccttttaccctttgtggcctgcagcgattggtgcagtcacagatttcaggttagttggatatggtacaaggagtcaacgatgttagtactttcgtcgttgccgttgttggccgtttgggccaaggagtggttgacgtagagttttattttccgggtgtatcttgtctctggggaaaaatgaatgcaaaaggatactagtacctcaactatcggatgcgttgatgaacgttcagtgaaaa

SEQ ID NO: 34 - DNA, 775 bp, Hordeum vulgare
gccgcagccgcagaccatttacgccattagcaggagccaacctggccaccacccatcacttccattcccacagcgcaagcctgtaaagtgttaagcgcctggcttcgctctgctctatttaaccatcacactggctgactccggcgttgcatcgccacccaagcctaagaaaccacacagctcaaggaagctcttgtttgttagtcatggcgatggcgctcggtaagcttgcggtggccgcgttggtggcgtctctccttctgctcagcaccatcaaggccgccgacttccctgctccagctgctgctccgctcggcccccctccccacaacatcgtagacccctctaaagactgcgggtgggcgtgcaacctgcggtgcagcgccaactcgcggcagaacctgtgcagccgggcgtgcctcaagtgctgcagtgtgtgccgctgcgtgccggcgggcacggccggcaacaaggagacctgcggcaagtgctacaccgactggaccacgcacggcaacaagaccaagtgcccctgaatatcttcggccggcttaaatatcttagtagagtagctaagatttgctcgtggttgtcgttagcggtaccggtggccttcgtgatttcgtcttggtgtggaaggaacggtgttgactagcactagctagctggtgaacccggtgtgtgttcttgtgtaaaaagtagtggtggtgtgtgttctcgtcccgtagttcggcgtatttctcgtgtaataaagcccatccggcggtttatgtga

SEQ ID NO: 35 - DNA, 1233 bp, Hordeum vulgare
gccgcgcgagactgagcctcggctaggcctcgaatggcgtaccagcttctgtccaccgtcgcgcaccgcgataccctcccggagggttacacgcggcccgagaacgaccgtccgcagctcgccgatgtggtgacggacaccaacatccccctcatcgacctcgcgtcgctagacaagcacagcatcatcgccgagatcgatcaggcctgccgcacctacggcttcttccagatcgtaaaccatgggatatcagaggagctgctggagaaggtgatggctgtgggtctggagtttttccggctccctccggaagagaaggcgaagctctattctgacgagccatccaaaaagataaggctttctacaagcttcaacgtccgcaaggagacagtgcacaactggcgggactacctacgccttcattgccacccgttggaggagttcgttccagactggccatccaatcctgaaacgttcaaggagatcatcagcacctactgccgcgaagtccggctgcttgggctccgactcctgggcgcgatctccctgggcctgggtctcgacgaggactacatcgagaaagtgctgggcgagcaggagcagcacatggccgtgaactactacccgcggtgccccgagccagacctcacctacggcctccccaagcacacggaccccaacgccctcaccatcctcctcatggacccccacgtctccgggctgcaggtcctcaagggcggcgtccagtggattgccgtcgacccccggcccaacgccctcgtcgtcaacctaggcgaccagttgcaggcgctgagcaacggcgcgtacaagagcgtctggcaccgcgcggtggtcaatgcgtcgcgggagcgcctgtcggtggcatctttcctgtgcccgtgcaacagcgcggtgatcggcccggcggccaagctcgtcgccgacggggacgagcccgtgtaccgcagctacacctacgacgagtactacaagaagttctggagcaggaacctcgaccaggaccactgcctggagctcttcacggatcagaattgatccgcatgcacaagcttgcctcgtgtacggttgggtgactatctgcttgggttgggtgaggatccacggccaaaaaataaatgcccccgtggtgcgggttacttgaattatttaaaaatgtttttcttcagcacaacgcgtgtcttgacgttcattttgtcttgtatttaacattct

SEQ ID NO: 36 - DNA, 1923 bp, Hordeum vulgare
aagcaaccatttttttttcctccttcctcagaaaagcggaagttggcactcagaaatcctacccggagcggagagcggagagcagagggagcgcccgctcgctcgtcgtcggcggtggtggctccgccctccccctccgcgtcgcccaggtgttagctggtaaaatagaaggggaaaggcgctaccatgggcatttcatccaagtggatcaaaccacttgtcgggataaaaaagcatggaaaagctcagaatggtgaaagcagcagagaaaggagctctgccgctcaggtgctacacaaacggaagcattccgtggatactgaaggtgcccttgcagttgcagaacacacagtgcaaactgaaccattggctagtgacaccaatacacagacagtttcatctcagactgaactaaatacaaaggagcatcaggctgcaacagttattcaatcagcctttcgagtattcttggctaggcgagctttacgggcattaaaaggattagttagactccaggctctcgttaggggccatgctgtacgaaagcaagcagcagaaacacttcagtgtatgcaatcactagtaaaggctcaagctcgtgtcagagcaagacaggttcgtattggtttggaaggtcaggtgacccagaagaaggctcctgaacaaaatgctcacgatgatcatgctcgagaaattgaggaacgctggtgtggcagtattggctcagcggaagatatgcaagctaaagtattgaaaaagcaagaagctgctgctaagcgggaaagagcaatggcatatgctttaacgcaccagcggcaggcaggttccaggaaactgaaagctgcagatgtccaagggccagaggcggatgagaaccagtgggggcggaactgggtagagaggtgggtggctgtacgcccgtgggagaacaggttactggacagtaatgccaaagagagtgtaccaattggcgatgataaggaggctgaggaaaatggggacagggatgtaaacaatccaaaaggaaaagttgcagtttcgggcattcagtcaaatggttcaagccagacgaaagatgcaaaacacaagaagtcacattctgatgcaagtggttcttcatcggggcaatctgcggctgcaccacccaccgcttctttgggttcatccaagctgaaaccgaagccatcggatcaaacctctgaggaagtcagccctcaacctacagatccggctccgcggtccacaagtaatcccaaggaaaggccagcacaagtcagtgcaccaaccaagaagcggctatcccttcctaacaacgctgtcggtggcgcggcaagaaaaggccaggtgagcagcagcgagagaactcggtccgtcggttccaagaacacggtgaagggtgcatcgaagcctgaatcgaagcagcgaccgagtcccggtagcgcaaccgcgaagcgggtccaggcacaggcctgatgattcaagccactccctcccatttcattcagaaacttggtcatggcaatgcccatctgtcacggtgtgtcgccgcatcgtctgtgtacataaaaccgagaaataaacaaccccgcatctagatcgccgccatgctccacgccccgccatcggtaggcgtcgtcgtaaccgtttcctcggtcatgcttccgtcatctaccatttctgtgtgtatgttatcttcttcaagccactcttccgaaagaagcaaagaggctagcaccatgttatctgcaagttgtgttcgtccttgagtttcagtgtaagaaaaaaacatgatttagttgttccaacttgacatgttctccagcactcggtggtggttggtgccatgccatcaaccatgcgtatcccccatgtatatctctctctggctgcccttctttcatggaaagttcatcttgattcttc

SEQ ID NO: 37 - DNA, 1966 bp, Hordeum vulgare
gagggcagagcccctcccctccgtccgccagccgccacgtccccggccgacccgaccacccctcgccgccggaccgcatctccatctccatctccatctccatcccctcccctcatccccacctccagatccgcgcgctcccccagcatccctccgcccgccgggaactttcctccgagctcgatccatccagtggccggcgacagcgaccgcccgccgcgccgatcgatccagccagcaacctggagtcccagtcaacccaagtcgcaccacgtgccaccattttgacgagctccgccgctgctaccccgtagtatttttctccctaaattcctgcccccggcctcccctcacaccgacggcgccccggccgcccctccccgcccgccgcacctccgctccgcgtccacctcccgcccgagaaaccctagccacagcaaggaggaggccatgagggggaagaagccgctcaaggagctcacgctctccgtgccggcgcaggagacgcccgtcgataagttcctgacggcgagcggtacattcaaggatggtgaactgcggcttaatcaaagaggtttgcagcttatctccgaggaaaatggggatgaacaccaatcaacaaaaatgaaggtggaagatgtgcagttatcaatggatgacctcgaaatgattcaggtcattggtaagggaagtggtggcgtcgtccaactagtgcggcacaagtgggtgggcacattttatgccttgaagggcattcaaatgaacattcaggagtcagtacgcaaacagatagtacaggagctcaaaataaatcaagcaacacagagcccccatattgtcctttgccatcaatctttttaccacaatggtgtaatatatcttgttctggaatatatggatcgtggatctcttgcagacataattaaacaagtcaaaaccattctggagccataccttgcagtactttgcaagcaggttttggagggtctgttatatcttcatcatgaaaggcatgtgattcacagggacataaagccatctaacttgttagttaaccataaaggtgaagtaaagattactgattttggggtgagtgcagtgctagcaagttcaatcggtcagcgtgatacatttgttggaacctacaactatatggcgcctgagcggattagtggcagctcctatgactacaagagtgatgtatggagtttgggcttggtaatacttgaatgcgccattggccgcttcccctatactcctccggaaggagaaggttggttaagcttctatgaactattagaagcaattgttgaccagccaccaccttctgcacctgcagatcagttctctccagaattttgctcatttatctcttcctgcatacaaaaggatcccgccgaacggaagtcggcttcagaactcttgaaccatgccttcatcaagaagttcgaggacaaggacctagacctgcggatcctcgtcgagagcctcgagcagcccatgaacgttcccgagtgagggttgccgctcggagaggcgaggctttgcggcgactctcttccagggccaccctcccgacggcaatcgtgtaattgctgcgaacccggtgggttcacagatgatgccccacccctgtatgtgatgatgtttacgttgggaaaaattcgcggaggagccgaacggattgttaatgtatggtggtgacttgaggcccttttgttgtgtcttgctatgaatgaatgagtgagtgaatgaatctggtgttgctcgtggtgatgttggctttgccatctggtctgtgtgattcctgctgagagtgcagcctttgattgcgcgcttggaccttgtggttctgctagtgatgtacccctggaccctggttgctgccatggttattaggcggcaaacagaatcaagctggctgagaagttgagaatcaggcagtttgtcctctctaaaaaaaaaa

SEQ ID NO: 38 - DNA, 1845 bp, Hordeum vulgare
gcattcgcctccgaattgcctgccaactccacctccatggcgctagccggcgccgcgaacgccaccttccgcccccgcctggtcactgccgccgccgacacctccgacactcatacacgccgccgccactggaaggccggcgagttcccattccccaccacctccccctcctccggcacgcagcagcgccggagaccccggaccacggagcgtccgcccccacctccaccgtccaagggggaagacccggaggggagagggcgccagaggcactggaaggcgggggaagacccggaggggagaggacgccagaggcactggaaggcgggggagttcccggcggcgggcgagtcccaatcccagtccgggaggaggggccgcgctcgcacccccatcaagaacgtccagaagaggctcgacgcgcgcgccgatgccaaggcctgggcctgcaccgtcaccgaggccctcgccgaccgcatcgccgccaagaactggcaaggggcgcttcaggtcttcgagatgctcaaggagcaacctttctactatcctaaagagggcacctacatgaaactcctcctgttgctggggagatcaggccagccttctctagcacaagaccttttcaccgagatgcagcagcaaggatgccagccaactcccgagctttacacggccttgatcggggcctactgccggaacggcctcctagacgaggcactcaagcttctccaagacatgaaagccaacccgctgtgccagcctgatgtctacacctatagcatactcatcaaggccttcgtcgacgccccaaggttcgacctcgtcgatgctatgtacaaagagatggctgagcgctccgtggcgccaaacacggtcacgcagaacattgttctcagtggctactgcagggccggaaggttggatgatatggagaagctactctccgcgatgctcgaaagtgcaaatagtaaaccagatgtctggaccatgaacattatcctaagcttgtttgggaacagtggccaggttgagctgatggagaagtggtatgagaaattccgaggctatgggatcgagccggagactcggacgttcaacattctcattggtgcttacgggaagaaacggatgtatgacaagatgtctgcggtgatggaatacatgcgcaggctagcgtttccatggacgaccgccacttacaataacgtgatcgaggcatttgctgaggcaggcgatgcaaagaacatggaggacacatttaaccagatgcgctcagaggggatgaagccggatacaaagaccttctgttgtctcataaacgggtttagcaacgcagcccttttccacaaggtggtaggcatggtaaagcttgctgagaggctcgatgtaccgccaaacacatcttttcacaactctgttcttgcggcatgtgcgaaagcagaggatctgatggaaatggagagggtcttcaggcacatgaaacatatgcagtgtgaaccagatgccatcacatactccatcttgttggaagcttatcggaaggaaggaatgaccgataagatgtacgctctgcaacaggagaacccaagtttggtttcgactgagcttgtcatggtgtaaccgacctcatgaattgattatggtgtgagttcatctgactgaaataaaaaatctgttcctctacatgtctggaatccataatgcaacctagcaaattaactagtgccagaattgtttcatttctgttgacctacaagattagtatgtatatctcttgatgactgtattgctgtaagtacagagaagcttcattatatcaactctcaagtgatattcttctatttt

SEQ ID NO: 39 - DNA, 613 bp, Hordeum vulgare
taccttcctccttcgtcctcgcaagcatcgcaccagatcgcccgcaccggccggtaggagcaaggaagggagatccacctaacctatcaatggcggccgctgcttcctccagcgcctggaaggccaggtggctccgcccggaggcgtacccgatcttcgcggcgacgggcgtggccgtggggatctgcgtgatgcagctggtgcgaaacatcaccaccaaccccgaggtcagggtgaccaaggagaaccgggcggccggggtgctggacaaccacgacgagggacgccgctacgcgcgccatcccttcaggaggttcatcgacggcaagtccgccgagatcatgcccggcatcaacaacttcttcaccgccccaccaaagaactagacgaagaccacgtcgtcgccgcacagctcttggactccaagagaggaaggaatcattcctccgccgagatttttgttttccccttctcaagaatacggaaatgaatactgttggtttttcctcgaattcaagtatgttattcgccatgactaattgtatggctgtacaccattgattgttgtgatcatacacacaaacctcgatctgaataatccctctatatatgt

SEQ ID NO: 40 - DNA, 810 bp, Hordeum vulgare
ctctctctctctctctctctctcgacaggctgacacgtccatcctccactccagctccgctttcggttttcagtccacctccctctcctgcgtcgaccctgcagtccagagccttgacgcgtgagccacctccgcttccaggagcttctcgaaggggggccgccgatgaccctctgatcgtccgtcgccatgggctgcgccggatccacccctaaatctgacggcagcagtaagaagctgaaaaagccaaagccttggaagcacacacaatcaataagcccggtagagctcaaacagatgcgtgaagaattctgggacactactcctcactatggtggacagaaagaaatctgggatgcacttcgggccgctgcggaagctgatctgtctctctcgcaaactatagtagacagtgctggcatcatcgtctcaaatcctgacatgacactttgctacgatgaaagaggtgccaaatacgagctaccaaagtacgttctgagcgagccaaccaatttgatccgggaggaatgaattcatataccgtgaaggtgaaaggctcgtgtaaattatgtgaacctcatttgttcagcgactttagtcttcacttgctcaagaggtcaatggacataccacacttaattcataactagaagggcagtgcgtgctttgccgtgtcgtttatattcttgaggttgtacatgtttcatgtaattcttttaatgttctggaaaaaaatacgtattagttggtttggcgtgtggggatacaatgaagtgtattattttattagatatgctagtcctaaggaca

SEQ ID NO: 41 - DNA, 1373 bp, Hordeum vulgare
ctatagtccgcctataacaccaccaccacctcccgggctcccccgcacgaaccgcggaccagacacacacaaccccgacgcagccgcgcgcgcgcacagagccggagagagagggagaaagaggcaccgggcccgtcgcatgggagcgcggtcgacggcgaccgcgggggaggcggtggcgaggcggggcagcaggaagaaggcagccatggcgccgtcgctgggcggcgtggaggccggcggcaggcgcaggggcccgccgcgtctggtggggtacgaggagctccccgagtacctcaaggacaacgagtacatccgcggccactaccgcgtcgagtggcccatccgcgacgccctcctcagcgccttctcctggcacaacgagacgctcaacgtctggacgcatttgggcgggttcctgctgttcctggcgctcgccgtcgccggaggcggcccggaggccgcacacgaggccgcgccggggatcatgaggtttgtggtgggatcagctaactcgtcatggaagagcgatcagtcgggcctgccgagccatgacgcggcggcggcggtcctgggaggacacggcgtgccgcggtggccgcggatggtgttcctcgtgggcgccatggcgtgcctggccatcagcgcgacggcgcacctcctcgcgtgccactcgcgccgcgccaccgtcgtcttctggcagctggactacgccggcatctccatcatgatcgtcgcctccttcgtcccgcccgtgtactacgcgttcctctgccacccgcccgcgcgcatcgcctacctctccgccatcaccgtcctcggcgcgctcgtcgtggccgtgctgctctcgccgtcgtgctcctcgccgcggtaccgccggctccgcgccacgctgttcctcgccatggggatgtccggcgtcatcccggcggtgcacgcgctctggatcaactggggccacaccgcctgctacatggccctcgggctggaggtggccatggggctcgcctacgcggtcggcgcctggttctacgtcagccgcgtgccggagaagtggcgccccggcgtcttcgacgtcgtcggccacagccaccagatcttccacgtcttcgtgctcgtcggcgccatcacgcactacgtcgccgtagccgtgctgctcgactggcgggagaaggcggccgtctcgtgcggcggcgtgacgtcgtaggcggcttgctggaacttggaacaagaaattaaattgtaagtcgtgccattcgaaatcattggacaattcgaatgtacgtagtagtgagctagtagtagcaatgtgcttaatctagtggcagcttgtgaatttgtgatttgagatatgcaaatgcaatacagttgat

SEQ ID NO: 42 - DNA, 1265 bp, Hordeum vulgare
agcacgagtcagtcgtcagtcgcctacttccgggaactcttgctgccatgggtccagttgtgctcctcctcgtcgtcgttgccgttgccgtcccggtcgtgcggccggcggcggccgagctgccgcggctggagcactcgcccaaggcggatgggtcgctgtccatccttgccgtcggcgactgggggaggcgtggggagttcaaccagtcccgggtcgccacccagatggggctggtagcggagaagatggacgccgacttcatcatctccaccggcgacaacttctacagcgatggcctaactggcgtcgacgataaggccttcgaggactccttcaccggcatctacactgccaagagcctccagaagccttggtacacaattcttggcaaccatgactacaggggcgatgcactcgcacagaccagccctatccttgcgaaagtcgactgccggtggatctgcatgaagtctttcattctaaacgcagaggttgcggatttcttcttcgtcgacacgacgcccttcgtcctcacgtattggaccaaccccaaggacagcacgtacgactggagaggcgttgctcctcgcgagacgtacatcacgaatctcctcaaggacgtggaggattcgctgaggcagtcgagggcgccatggaagatcgtcgtcgggcaccatcccatccggaccgccggcaagcacggcgacaccgaagagctcgtgcagctgctcctgccgatgctcaaggcccatggcgtcgacctctacatcaacggccatgaccactgccttgagcagatcagcagcagcgacagtcctctgcagtacctgacgagcggcggcgggtcaaaggcctggggcggcgtctacgcgccgggcgccgacaaggtggagttcttccacgacgggcagggattcatgtcgctgcggctgaccgccacggacgcgcgcgtcgcgttctacgacgtcgccggcgccgtccggcacacctgggggcataccaaggccgcacactactgatcgaataagctgccgtgcgcgccagccatgcatgggcgccatttcgatataatcagcgcagcgcccgcgcgaacaatttaagcatcttcactacgcactcaaattcttattcttgtaagttctccgggttaaactgcaagtccttttagacttttgaatcatttgattaaaatgtaactggtgatgagtgatggatgatgttgtcggtgcataaaacaagggcagtgatctgcccgctaaact

SEQ ID NO: 43 - DNA, 985 bp, Hordeum vulgare
tccgcgccgagcagtcgccgtcccctcgctttcaacccccccaggcaggaaagcaagaattctccgctagaatccgagcccgggccgatttgcgtggattccgtgcggccctttctgcgccatgcacttctgatccggggcctctcggatcttgggagggaggcggggcggtgagccggccgggagatggccggcgggaaggagccgatcgaggtcaagttccggctcttcgacggcacggacatcggccccagcaagtacgaccccgccaccaccgtctccgcgctcaaggacttcatcctcgcccggtggccgcaagataaggagataactccgaaaactgtcaatgacctgaagctcatcaatggtggaaagatattggagaataaccggacacttgccgagtcccgtgttacaataggagaggtccctggaggtgtaattacaatgcatgtggtagtgcgccctccacaagttgacaaaaaccagaagcagctgggcaattcccccaagcagaacagatgcggatgcaccatactgtgatacggcaccccccctgatgatgtacgatgcacctagttgtagaatttctcttgtgcttttgttgcgtccacggcgcggtgtgtattcattttgacatccagttcctggagccattgaaactcgatctagaatcgcatgcatgtacttgacactcctgaaagcatgcttggaatctggtgggagtgggactggctgggagtaaaggttcctccttgggatgttgctgctgtagcgagtgtgtgcaggagtcaaggaatggattggatgcttgctgttgtgtaaattgtaatgtggaaacaaccatcatttcattttcttttgcctttggctatgtttgacattatatcgattctttttagcgctgctgtttgccatgtaaagcagatatattgtaccattggaatatatatacggttttgctaaatatcaggtacctgatttc

SEQ ID NO: 44 - DNA, 907 bp, Hordeum vulgare
acgggaaaacgtttggtggatggaggcgctgggcctcctgggccgcgcgtgccgcctcggccactcctgccgccgcagcacggccactccttcccctccccctcctcgcagcagcagcaaccgcggcagagccgtgcgcgccggagccaaagccgcctcgtcgtccgcgccgcaggcgatggaggccaagcgggaggagaagccgagggtggtgacgctccggccggtggaggccacgccggagtccttcgcgcccttcgggcaggtcatcgccgcctcccccgacggcgaccagttcggcccccacgacgcccagctcgacctcagccgcggcatccctaggttctacatcatgagattggagagcaggccgctcaagttctcggcaatcacccaccacgccagcgtgacgcagtgcctgggctccatcggcggccaggactggtacctcggcgtggccaagccttccatcgtgaacgagcacagtggccaggatggtggcaggagtcccgtgcagtcgcgcgccgggcactactatctgcctcccgatccagccgaggtctgcgtcttccgggtctccggccccaagttcctcaagctgcacgccgggacctggcacgccgggccgctgttcaaggcagacgccgtggatttctataacctggagctgagcgacaccaatgtcgtggatcacaccacgcaccacttcaaggagcacgacggcgtaacctttacgatcgaggactgaggacccaggcacaacaaaaaaacgggtgcgcctcgctgatgctgttcttcagccttgcctctatgtactctttgacgtgtgatgaacatgaacatccagtatgtatgtatgtgcaataatctacttactgcaagtcattttatacgtacttacgtacgc

SEQ ID NO: 45 - DNA, 1200 bp, Hordeum vulgare
ttggactggaagcgacccgcgtccaccaccgccgctttccccgtctcctcccctcaccctcaccctcaccgcgcggcgaggccgagcgacccacccagcggcgagcccggcatgcatcacgaccccaaccccttcgacgagggcaccgccggcgacgaaaaccccttctccaatggaggaggccggggcgggaagcagcagtacggcttcaggcccaccgagcccgtcggcttcggcggcggcggcggcggcggcagcaggggcgacgccaccgtcgatgtgcccctcgacaacatgggcgactcgaatggcaacgcgagggagctctcgtcgtgggaatcagatctgaggcggcgtgaggcggatatcaaaaggagggaggaatcgctcaagaatgctggagtgcccatggaggagaagaattggccgccatttttcccgattatccaccatgacatcgccaatgagataccggccaacgtgcagaagctacagtatctggcgttcgcaagctggcttggaattgtgctctgcctctcctggaactttattgctgtcatagtctgctggatcaaggagggagattcaaagctgttcttccttgctacaatctatgctttgcttggaattcccctttcttacttgatgtggtatcgacccctctaccgtgcaatgaggactaacagtgcattcagttttgggtggtttttcctgtgttatctgatccacattggtttttgcataattgctgccattgctccgccaattgtattccaagggaaatcattaacgggcatattggctgcgatcgacactttctctgagcatttgataattgggatcttttacttcgtcgggtttgcactattttgcttggagacactgctgagcatcggggttcttcagaaagtatacatgtacttccgagggcataagtgaagccgtcatggatgggaaattttcggaagtctacaagcagcggtgattctgtccatgtgtgtcagcacacctagagtctatgttctgttctgccaaaggttatcgaaaaatgcttctgagcctgaatcgagtatggaaggtagccctgctaccacaggatgttctctaagatggggtgttgagattctttatatgctgtgcttggtgcgtttggtagttcgtttgggagtttggcatgtcggtgcacattacagtagtcgg

SEQ ID NO: 46 - DNA, 720 bp, Hordeum vulgare
cacccacgcaccagcaccaagcccacgcagcgcccgcctcctcccagtcccaccccaccacacccctcgctccgatcccaaggttggcggccggcggcaggatgaaggccaaggcgggatcccgcgccggcggctccaggctcgcggtgaagaagagcaaggccgacaaggaccccaacaagcccaagcgacccccgagcgccttcttcgtcttcatggataccttcaggaaggagtacagggagaagcaccccgacgtcaagctggcctccgtgattggcaaggccggtggtgagaagtggaagtctctgagtgacgctgagaaggctccctacaatgccaaggccgagaagctcaaggccgagtacaccaagaagatcaacgcctacaacaacccacaggcaggagaggcgtccggcgactctgacaagtccaagtccgaggtgaacgacgaggacgacggcagcgagggcgacgcgtgaagcggcagcagggggagggtggtctctggaacgtcgccgtttgatgcttctctgtttgccagtgtcaccgatcgatgatggatgtttgctgttagtttagctccttggtagtccctccctctctttcaggctctcctgctgctgctggtggtagtaatggtggctctagtcccatgtaggcattgtcctggatccgagtggcgaagttgctatagcctagtcgtctttctgtagggtc

SEQ ID NO: 47 - DNA, 1463 bp, Hordeum vulgare
acgcgcctcaagatcgtgcctactccctctctccccgccctccaccgaggatggctctgccggctgccaaggcggcgccggcgacgcctttctcgtcgcagacgcacggcggaggcatcctcctcggacgagcttcgtcaccgccgccgcctgccgccgcgctgcgcctcggaccactcttctggccgtgggaaaaggtgaatgttgggcccctttcagtttcccccatgggttttggaacatgggcttggggcaaccagctgctctggggctacgaggaaagcatggacagtgaactgcaggagtgtttcaatttggctctgaagaatggcataaaccttttcgacaccgccgactcctatggaactgggaagttgaacggccaaagcgaaaggctgctcggcaaatttatccgcgagtgccaagggccaataaaatctccagacgacgtggtcatcgcaacgaagtttgccgcgtatccttggcgactaacgtccggccagtttgtcaacgcctgcaggtcgtcattagaaaggttacagatcgaccgtctcggaatagggcagctgcattggtctactgccaactatgcgcctctgcaggagcgcgctctctgggacggtctagttgaaatgtatgacaagggtcttgtccgggccgtgggtgtgagcaattacgggccgaagcagcttctgaagatccacagctacctagcatccagaggtgtccccctgagctcagctcaggtgcagttctcgctgctgagcatgggtgatgagcagatggagctgaaaaccgtgtgcgactctctgggcgttcgtctcatcgcttatagcccgcttgggctgggcatgctcaccgggaagtacgacgcctctaaccttccaaatgggccaagatctgtgttgttccggcagattcttcctgggctggagtccctgctgtcttgcttgaagagtattgccgaccgaaagggcaaaaccatgtcccaggtggctataaactggtgcatttgcaaaggcgcaattccgattcccggcgtgaaaacagttagacacgtggaggacaacttgggtgcgcttggctggaggctgagccctggtgagatctcagagctggaagccgcggcgatggagtgccccaagaaaatggttcagaacatatttcagaccacatgagcaaactgtagtactccgtattaaacatgacagcaacctgaaataagagcagagcaggttgctttctcttctgtgcctagttcagagttcggttcagaacttcagagttataccattgtataaatcctgactagatgtctagagctgtatgctgattgcctgttgagatttaattaacccacgtgttaattaagaagaatcttcactatccctaaccgtcatgcacaaggaacgcgactgttcgctcgtgtcttttcggaccatcgtgtctgttggacgcatcct

SEQ ID NO: 48 - DNA, 617 bp, Hordeum vulgare
cccttctccctccaccctccgccgcggcagcccccgacccttctccgagatccggccacctccgtcctccgtacccccagcacgcctcctccgtccaccgcccggtcgtacgcaggccgatccgccgccgcgtcacgacagcgggccccgccgctagcgagcaatggaccgggtcggcagcggcgagaagcacctcgaggactgcaccgtcgccaatgccctcggaacttgggtcttctctgttgctggtgctctccttgccattcctgtgggcataaagaggaagtccttcgctccgctcgtgttctttggcactactggaactatgcttgacatcatcatgggcattagccagtgtgagagggagcatgctgagcggcagatgaagcttttagaagcgcagaaccttgcaacaaatgcttcagtagagggtgaaagcttgactgattcatttaccaatgtggataagtgagatggggcctactgtggggtttcctttgatggaattccctgagtttaatagtcatgatccttgggaaacattgtgggtccttctatatccaaaaatttgtttggaaccatgatcacggttgtaaaaagacacatgaaaggcctct

SEQ ID NO: 49 - DNA, 4230 bp, Hordeum vulgare
gggctttcctcctcttcttgccatttctcgtctgcttgcttgcttcttcttcttgccccccatcccctgtctgtcccggagcgtgcagaacctgatctggttctcctcgtgtgtccgtccacatccagggggggtcctggatttggaggcggagattggtacctggaaagcggttgatgtgcctgtcggccttgttgttttgccgggattggtaactggcgggcgggcgagaaaggagtgatgggagcttgatttgccactttgatcttgggattggttgttgggggggcggcggcggttggcccgtttcttggttcttctggggcggagtttgtttgggatcgggagcggagcaagccatttccgggcggttcttgtcggggggattcgcgccgactgaagcaagttcgtcgggaagatgcggctgactgtgcgtgtgatcggggcgcgcaacctgcgcgccatggatttcaacgggttcagcgacccgtatgtgaaactgcaggttgggaagcagcggttcaagaccaaggtggtcaagatgaacctgaacccggagtgggatcaggagttcagcttcgtcgccgccgatgtccgggaggtgctcaagttagatgtctacgatgaagacatgatcgggactgatgacttcctgggccaggtgagggtgacactggaggatcttctggccgtggagaacttctcgctcggtacgcgctggtaccagcttcttcccaagaccaagagtgacaaggcagttgattgtggggagatttgtcttgcaatatctttagaaacagctggggccacacgatcatggtcagatgatcttgcaactgaactaactggtacacggaaagagtattcattggcatcaagtcaaagtgcaggatcatcatcggctgcattagcttatgaagaaaatgaagcttctaaagaagataatgttaatgagtatttttctgatggaactgaagtccctgaagaggacaaatgtggcgaagtgagagctccagaggacaggtttaatgggattcctactgaaatttctaatgaagccgaaacttctaaaacagaaaagcttgacaagccctcgcttgttgatcgtgtctatcaaatgtttgccaagaaaaatgatgatatttcgtcaacatcatggagaaagaccgaggcttcagaagaagttcaacaagcaacagcagtatttgaggctcctttaagccaaaatagtgacatttgttcagatgttacatttgatgaactactggggtcttttgaatcaaggcacgaagaagtcgaaatgcctgtgaatttacaaggaattcttgttaatcagtcatattttacgtcgcccagtgatttgaataaccttctcttctcaccagattcagatttccggcaaacattggttcagcttcagaattgtactgatttcaaaactgaaccgtggagaattgataatgatggagagtccctgaagagagtgataagttacacaactgcaccatccaaattggttaaagctgtaaaggcaacagaggaacaatcttatttgaaggctaatggaaaagagtattcagttttgttgagtgctagcactcctgatgttccttgtggtacttattttcggacagaggttcttttccgtattatgccaggccctgaacttgattctgagcaacagacttcacatttggtaatttcttggcgcatgaattttcttcagagtactatgatgaaaagtcttatagaaaatggagcaagacaaggcttggagcaaaattattcacagttctctgatctactgtcagagaagatcaagcccattgatgtagacgatgctggatcagataaagagcaggtcttagcttcattgcaaggggggcaggagtctgattggaagatagcattcctatacttctgcaactttggtgtcttgtcctctctttttgttgccttgtacattggtgttcatgtttcactagtgaattcaggtgcagttcagggacttgagtttcctggattagatttgccagattctctcagtgagattgttatgggtgggctattgtttcttcaggtgcaacacatatttaagaaaattatatgtttttttcaggctagagaacaaaaagttggtgatcatggtgtcaaagcacaaggcgatggatggttgctaacagtcgccttaattgagggaaccaagttggcaccagttgatgctactggtttctctgatccttatgtggtatttacttgcaatggtaaaaccaaaacaagttcaatcaagttccaaacacttgaacctcagtggaacgacatctttgagtttgatgccatggatgatcctccatcagtgatgaatgtacatgtatatgattttgatggaccatttgacgaagttacctctcttggacatgctgaaatcaactttgtcaaatcaaatctgtcagagctagcggatgtatggattcctcttgaaggtaacttggctaagtccaggcaatctaagttacacctaagaatcttcttgaacaactcaaagggcactggtatggtcactgagtatctgagcaaaatggagaaagaagttggtaagaagatgacgttgcggtctcctcgaactaatactgcattccaggagctcttctctctgcccgcagaagaatttctaatcagcagttttacatgctacttgaagcggaaattgcctacacagggccatcttttcttgtctccaagaataattgggttttattcaagcatgtttggccggaaaacaaagtttttctttctatgggaggatattgaagacatacaggcaattcccccatcgctatcgacatggagtccatccctttcaataactcttcacagaggtagaggcatggatgcaaagcatggtgcaaagagcgtagagagtggaaagctgaagttttctctgcaatcttttgcatcatttagtgtggccaataggacaataatggcgttatggaaagcaagatcattgagctccgagtctaaagtacagattgctgaggaacaatctcaaaataatacacttcaaagtgaggacagtggaatttttgtaggtgttgacgattccaagagccttcagatgagtgaagttttctcgtcaaccatttctgctaatatgaattcacttctggaggtgttcgaaggaggttcgttggagatgaaagtcatggagaaagttggatgcctcaaatactcggctacacaatgggaatcagataaacccgatgaatatcaaagacaaattcattacaagtttagcaggaagttgtctcctgttggaggagaagtgactgggacccagctgaaatctcctatgcccaataagaaagggtggattattgaagaggtgatggaacttcaaggcgtccttcttggtgacttcttcacgcttcatataaagtatcaattcgaagaccttgctcctaaacaaaaggtgtgcagtgtccaagtctatcttggaattgaatggtcaaagaccaccaggcatcagaagagaatcgagaagaatgttctttccagttcatctgctcgcctgaaggagatgttcagccttgcatccaagcaactctcgagcaccagataggatcattcatccgtgacaacccatgtgcataatactgaatgaccaaagatttgctgaccagtggtatggtcccctgtacatacattgcttgattgaaggtacgcatgggcaaactgattcattcgttagaccattttagggccgagctttgcagatttttctgtagctgtgagcaattgcagcgcagcattttctgaactcaggataccaaatccaacttttttggtgtactgtatctgatcgtagatccaatcagaacagaccgcagcaatttggaccagacacatgatagcagcatcatacatccagttatgatttacactgaagccatggcctgcaatttgttgatctgtagacagtagtgtttgtcttgtgtacataggatagcaagtgttgttctctgtacgttggaattgggccagttcaactccctgtttcattgataatacacatgttgatgatacagaaggaaaataaaatgtgatccggtgataaataatattagatttttatgacactagccgtgtgaccatgcttgctctctaactgtcggttgtaatcttctggccaaactattggctaccatggccctgatgctcattgtggct

SEQ ID NO: 50 - DNA, 1368 bp, Hordeum vulgare
ctcctttgctggcggctgccgaggagcggagccgcaccatcccagccggccatgaagcgcttcttccagcccgtagtcaaggacggctcccccgccaagaagaggcccgccggggccgcgacctctgactgcgttgatggcgccgcccccaccggggccgacgccgccggggagggccctcccggcgaggagccacgcaggttcgtcacgtggaacgccaacagccttctgctccggatgaagagcgactggtccgcgttctgtcagttcgtcgcccgcctcgaccccgacgtcatctgcgtccaggaagtgcggatgccagcagcaggttccaaaggggcaccaaaaaatcctagtgagctaaaagatgacacaacctcgtcacgcgaagaaaaacagatagtgctgcgtgctttgtcgagttcacctttcaaagactaccgtgtctggtggtccctttcagattcaaaatatgcaggcacagctgtgtttatgaagaagaagtttgaaccaaagaaagtgtcattcaacttggatagaacatcttctaagcatgatgcagacggtcgtgtcatcattgtggaatttgaatcattcttgttactaaacacatatgctccaaacaatgggtggaaagaggaggaaaattcatttcaaagaagaagaaagtgggataaaaggatgttggagtttgttcaacaagtagacaagcccttaatctggtgcggagacctgaacgttagtcatggtgaaatcgacgtcagccatcctgatttttttagcgatgctaagctcaatggatatatccctccaaataaagaggactgtgggcagccaggattcacccttgcagaaagacagcgctttggcaatatattgtcacagggaaagctagtagatgcttacagatacctgcacaaagaaaaggacatggagtgtggcttctcttggtctgggaatccaattgggaagtaccgaggaaagagaatgcgtattgactattttgttgtttcagaagggttgaaggacagaattgtttcatgtgaaatgcatggtcatggaattgaactggaaggattttatggaagtgatcactgtcctgtttcacttgagctctccaaagaagcagccgaagcaccagaatcgaagagctccggctaacttctatgtttttctctctgaaccggtcattgtggattattagattaggtcagctgaagcgcttagcctatcattagctatttaaacatcttctgtgacctgtagtaattctgtataggggccaatactgtggcgcgccctctagtcaggatctggattggaattagagtgcaccctctatgtttatagaagtttcttttccttttt

SEQ ID NO: 51 - DNA, 1887 bp, Hordeum vulgare
gctggcggttccctcactccccggaaaatggaggccaccactacactcacgctctcctcgtcccctgccatcgcggcccgccgctcgccagtgagggcgaccatctcccaatcccacctccggcattgccccgtccgcacttcgcgcctccacgttgcccagagcctggcctcacgtcccctctcctcggggtggcggtggcggcggcgggggagcgggctggtggtgcgggcggagacgttcgggcagctcaccaccgggctcaagtccgcgtggaacaagctgcgtggcgtcgatgtgctgacgaaggaaaccattgtggagccgatgcgggacatcagaagagcgcttctggaagcagatgtcagtttgccggtcgtcagacggttcgtgtcgtctgtgagcgagaaggctttaggttcagatgttatccgaggaatccgaccggagcagcaattagtcaagattgtgcatgatgaacttgttcaactgatgggtggagaggtatcagacttggtgttcgcaaaaactggcccaacggtcatcctactggcaggtctgcaaggtgttgggaagacaactgtctgtgcaaaacttgcattctatctgaagaaactggggaagagttgtatgctggttgctgcagatgtttacaggcctgctgccattgatcaactcactgtactgggtgaacaggtgggtgtgccagtttactcagaaggaaccacagcaaaacctgcagaaataaccaagaatgccatggaagaagcgaaaagaaataatattgatgcgatcgtagtggatactgctggcagactgcagattgataaaacaatgatggttgaattgaaagaagtaaagaagtctgttaatcctacagagattttgcttgttgttgatgccatgactggccaggaagctgcagcattggtcacaaccttcaatattgaaattggtatatccggtgctatattgactaaattggatggtgattccaggggtggagcagcacttagtgttaaagaggtgtctggaaagcccatcaagtttgtagggagaggagagcgaatggaggaccttgagcttttctatcccgaccgcatggcacaacgtgttttgggaatgggagatgtcctttcatttgttgaaaaagcacaagaagtcgttcgtcaagaggataccatggaactgcagaagaagatcatgagtgcaaaatttgacttcaatgacttcttaaaacagacacaaaatgttgccaaaatgggatccatgagccgtgtaattggaatgattccaggcatgaacaaggttactcctgcgcaaattcgggaagccgagaaaagacttgcattcgtagagtcgatgattaatgcaatgacagccgaggaaaaggaaaaacctgagttgctggctgaatcacgcgagaggaggattcgggtagctgaggagtccgagaagacagaacaagaggtgagccaactggttgcacagctcttccaaatgcgcgcgcagatgaagaaattgatgggtatgatgcaagggcaagaagcaattgcaggaatgggagatctcatggactcgcttaacgcggacgagaaggcacctcctggcaccgcacggaggaggagacggcggagtgagccgccgcggcagagggagttggatgcagtgggtggcgccagtaggccttgagttgtgcactggagcttgattttttactggaatagttgtggattggcatgtactccctccgttcctaaatggagtataaatctttttagatattccactaggggactacatacggagcaaaatgaatgaatctacactctaatgtatgtctatatacatctgtatatagttttttagtaaaaactcttaaaagac

SEQ ID NO: 52 - DNA, 1083 bp, Hordeum vulgare
gccgcgtttctcgacgccgttcgttcgtttcctttcttttcttatcatctcctcccgtgtgcgtggccgtgccgtgccgtgctgtgctccgctttattgaccattgtcgctcgtccaacacctgacagaaatccacaatggccaccgatacgttcgtcaccgtcgtggacttcgaggacgacgagatcaccgccaccgtcacgtcctccggcgacgccgtgaaggcctggctccgccagatccgctacgtctaccgctgggtctaccacaagctcatcgtggggctggacgtggagtggcgccccagcttcggccgcgcgcagaaccccgtcgcgctactgcagctctgcgtcggccgccgctgcctcatcttccagctcctccacgccgacttcatcccgctggccctccgccgcttcctcgccgacccggacttccggttcgtcggcgtgggcgtgcagaacgacgtcgaccgcctcaacgacgaccacggcctcgaggtcgccaacgtcgtcgatctgcgtagcctcgcggccgacgagatgcgcaggccgtggctccgccaggccgggctcaaggacgtcgcgggcgtcgtcatgggggccaacctccacaagccacgcagggtcacgatggggccgtgggacgcctgccgcctctcccaggagcagatccagtatgcctgcatcgacgccttcgtctccttcgaggtcggccggaagctcctcaccggcgactactccgactccgaagaggaggatgactccggctactgaggccatagatcgattgcctcgtcccgtacgtgtcctgcaaattccacctgctgttcccaagtactacctgcctcgttccgtacgttcttatattagtttatagagggagtattacttgtgcgtttagatttagttgttcatctcgtaatcctaagttagggatggtttattaggagtttatctgcgatggtaatgatgctgtgactagtactagcttctagtggttagaactggcttggtgccatgaccatttgtgccgtatcgatcaagaccttttctcttttctttgtgaattatgctgctcatc

SEQ ID NO: 53 - DNA, 1716 bp, Hordeum vulgare
tcaaggtccaggctcgtcgtgaaggcgactggagcacgtggacactgacatggactgaaggagtagaaagcacaaagaaagcaatggcggctatggttgcgcttgtgccctggctagcatggcttgtcatcgctttcctctccttctatcttctcaacctcctcgcgcatgcgcgctccggcctcccgccgggcccccgcccactgccgcttatcggcagcctccaccttctcggcaacaagccacaccgctcccttgcccgcttagccaagatccacggcgcgctcatgtccatccgcctcggcgcggtcaccacggtggtcgcctcctcccccgccatggcccgcgagttcctgcagaggcatgactccgtgctcgccacccggtccgtgcctgacgccaccggcaagcacgcggcgggctccgtcccctggctgcccccggccccgcggtggcgcgcgctccgcaagatcatggccacggagctcttcgcgccgcaccgcctcgacgcgctccgccacctccggagcgacaaggtgcgggagctcacggaccacgtggcgcggctggcgcgcgagggcactgcggtgaacatcggccgcgtggccttcacgacgagcctgaaccttgtctcccgcaccgtcttctccatcgacctgacgagactcgacgaccacggccgctccgaggagttccaggaggtgatcacggccatcatggaaggcttggggaccccgaacatgtccgacttcttcccggtgctcgcgccggccgacctgcagggcatgcgccggcggctggcgcggctgttcgcgcggctgcacgccgtgttcgacgccgaggtggaccagaggctgcgcggccgcgacgccggccagcccaggaagaacgacttcctggacgtgctgctcgatgtggcggcgcgtgaggatggcaaggacctgctcgaccgcgagacgctgcgctcacatttcacggatttgtttgcggcaggtagtgacacaagctctagcacagtggaatgggcaatgactgagcttcttcaaagctcgtcctcaatggccaaggtttgcgacgagcttgcacaagttatcggctcaaaaagaaacattgaagaagatgacattgttcggttgccctatctccaagctgttataaaagagacttttcgactccatcctccagctccactcttgttgccacgccaaccagagacgacagtgaaaatagcaggttacacaatacctaaaggttcacgtgtgttcataaacgtatgggcaataggtcgagataaagatgtatggactgagcctgagaagtttatgccagagaggttcttgggttcgacgattgactttaaaggtctggattttgagctccttccatttggtgcgggacgccggatctgccctggaatggcattggccattaggatggtgcatgtgatgctcgcttcattactaaatcagtttaagtggagtctacctcttgagctggagcatgatgggattgatatggaagatcagtttggcctaacactagcaaaggtagtgccccttcatattatagcaacaccaatttgacctgataacataatgcaacctttttaagaatgatttgttaatgtgtaataattcaagtgtatcagccatgtaatttataccgtttatgtggaaaacaatcatatgcctagagttcaaagttttggcaaaaaac

SEQ ID NO: 54 - DNA, 1641 bp, Hordeum vulgare
accacatagatcgtcagttcatcccaccacctaccacctaccaccttcctgctcccaccttcctccgctccgatctccatggaagccaccgccgcctgctcctcgacctccctcgcgcggaccctcgcctcctcgccgcttccccaccactgccgcagccgtgtgcgcgtgggcaactacgtggtgccgctggacgccgcgccgtcggggatcacgcgcccgctcgtcgagatcctcaacttgacagatcaaaacctgacagaaattgacaattatgccttcagtttcctctctgtaggagtagatttgctgctgatatttatcctacacgagaagaattgccaattcagacttgcacatggattgtcctgtggtttctcctgttgtgatgtgtagaattggtggcttgcatgtgtgatttgctcctgatctttattcagagcagagtggtgctcctctgaatattttgatgctctgaattaacaggtgtggaatcctgctaggcgtggctgtgcagcgtcgggttcgcccagttccccgacgaccgcgatgtgtgggtcgctgagacgccgcttcccgagaagaagtctacgacattcgtcgcccgccgcccatctgtacatcaggaagagctctgtacttgttatcaccggcagcaacacgagatgaggacctccggcgatgcaacacgagcaggggacaagcggcaagttgcagaggagcagcaagttactgaaaattcagtttactgcataatgttttaaccagaacatgaattaagatgcaagaatcattaagttgatagcagtcaatgcaaaattacagactggatgatccgatgttgctctaatttgacatcagtttggtcatctgcgagctgggtcaatctattttgtagcagtagaggcggcgaggaggagctgggtcacctcgacaaagaagaagaagaagaaatcaaggaggaggacagatagacggcggtggtcacctatgtagcaggtgggcggcggcgctgcgcctgacgatggatgcggtagtcaccctcgatggacgacggtggagtagcggcggcctggatcttgcccaacttcggcaccggattggttggacttggtgggccggggatgcgagcaggacgatgaggaggagacacccgtgagccgtggagccatcgcccgtcgaggtgtcgccgcggagggccgcggaggagcagatgggtggcggcgaagctcgcctctttgttcacacgtaagcagggcgcacgttggcagctgttgtgcaggttggcggcgccaggagtggcgcaggatgatcccaatggtgggtggggcgcaccgccggcgacgaggaagacagtggcttggggcgcgctgtgccgcggacgacggaggtggaagacgggtcgattagcaagagatttaatagaataagggtgtttttgtaaaattgaaaatgtactaagctgaggacaatttttttcggccggagggagtattagactagattgaacttctgaagggcatgtttactagatgtggtacataaataccattaattattcttattgttgtatgttcagcaaaggacaacttactagcaaaagttataactaatttatttatatcccaaaaaaaaaaaaaa

SEQ ID NO: 55 - DNA, 620 bp, Hordeum vulgare
cacgaaggccgcacaagcgaagtgagagcttttgcacgaggagttcatcagcaaccatgaagggcaccaagctcgcggcgattctgatcctccaggccgtcctggtcatgggagtcctctcgcacgtgaacgccgactatttccccacgtgctgcaacaactgcaggtccttctccggggtcgacgtctgcgacgacgcccatccgcagtgccccaccggctgctcggcgtgccgcgtggtgaccacgaacccccagacgttccgctgcgccgacatgaaagccaccgtcgacggcacctgcggcgggccatgcaagaagtactgatcggctcaggctcacatgagactattgttccgcttggcgcctaaaataaaagctcggatgagatgaccggactcatcttgcctatgcgtgtgtgtgtggccaacaatatgtatactgttccgtcgtgtctttgtcaccgtggtttctttctcgagaaatatcccccgtgaatattgtgcgtgtctactcaataacatgaatattacttgtatttatccaataatttatttaaaaaaaagaaaaatcgtttatgatgtgaacttaggttgaaaaagcaaacttatttttagccct

SEQ ID NO: 56 - DNA, 1239 bp, Brachypodium distachyon
ggaagccacaagccctcttcttcctcctctagtcaagctagctagctagcatataccaataatccacggccatggctaactcactgcccatcgccgtgctccttctgctgctgctctccccagctgctctcgccacggccgtcttccccgactccggtgactccttccacgccgtgtcctgcccgcagctggacaccatcgtgctcaccaccgtgcaagcggcgctccgtcaggagatcgctctcgccgccggcctcatccggatcttcttccacgactgcttcccccagggctgcgacgcctccgtgtacctcatgggcacgggcgccgacgagatctccctgggcccgaacctcacgctccaacgccgggccatgcagctcgtggagtccatccgggccaaggcccacgccgcctgcggcccaaccgtctcctgcgccgacgtctccgccctggcaacccgggccgccgtcgtcgcctccggcgggccgtcctactccgtgcccctcggccagctcgacagcttcgccccggccccccgggacaaggtgttggacctcccggggcccaggacggccagcgtggcggaactcgtggcgacgttcgcgacgcgtggcatggccgacgtggcggacctcgtggcgctctccggcgcgcacaccgtcggccgctcccagtgcgactccttcgctgacaggtcgggacgcatggacgacaccttctccaggaagctggcagccaactgcagcaagcacaaggaccgcctgcagaacctcgacgtcgtcacccctgatttgtttgataacgggtattacaaggcgctgacgtttaaccagggcgtgttcacctctgacatggcgctcatcaagaacaggacctcggccgccattgtcaggcagttcgcggagagcaaggaggcgttttttgcgcagtttgcgaggtccatgaccaagctggctaacgcgcccaggccggggggtaatgtcggtgagatccgccggaactgcttcacgcgcaacgtccgccagggcgcggatgcgaccatcgagctcgccggggaagaagagggattcaaggcttcagcttgatcttgaaggttgaagatcaagctttcctttctaaattagtagtgcttacttaatgtctgtcgtctgtttcttcagagcttgtacgtgtttcctgtctttgtttttggtccttcgcgggtaggatgcaataaagaaacgacttaaggtggta

SEQ ID NO: 57 - DNA, 1942 bp, Brachypodium distachyon
ggccgcacgctcgccaccaactcgcccccaccacctactacctaccgccccgcatcgatctcgcgctctctcctcgcaatggcgctcgccatcaactccgccgccgccgcagcggccgccgccctctccaacggcggggcagcccagccgccgcgccccagagcggggttactcccgatgaagaggcggggcagcatctctgccgtgcacgccgccgaccccgccaggggcaccgggtccgtcccggcggccgcgaagacctcctccccgacggtggcgcccgaggcggcggcttctccggcggcgagctggaaggtcgacagctggaaggcgaagaaggccctgcagctgcccgagtacccgagcaaggaggagctcgacaccgtgctgcagaccatcgagacgttcccgcccatcgtgttcgccggggaggcgcgccacctcgaggagcgcctcgccgaggccgccatgggccgggctttcgtcctccagggcggcgactgcgccgagagcttcaaggagttcaacgccaacaacatccgtgacaccttccgtgtcctcctccagatgggcgccgtcctcatgttcggcggccaggtgcccgtcgtcaaggtaggtaggatggctggccagttcgccaagcctaggtccgacaacctcgaggagagggacggggttaagctgcccagttacaggggagacaacgtcaacggcgacgccttcgacgtcaagagccgcaccccggaccctgagaggatgatcagggcctatgcccagtcggtggcgacgctcaacttgctccgcgcgttcgccacaggaggctacgctgctatgcagcgggttatccagtggaaccttgatttcatggatcacaacgagcagggagacaggtaccgtgagttggcacatagggtggatgaggcccttggcttcatgactgcagcagggctggggatcgatcatccgataatgacaactactgacttctggacatcccatgagtgtctcctcttgccatacgagcaggctcttacccgtgaggactccacaagtggccttttctatgactgctcggcacacatgctgtgggttggtgagcgcacccggcaacttgatggggctcatgttgagttcctccgtggtattgcgaaccctcttggcattaaggtgagtgataaaatgaaccctgctgaattggtgaagctgattgagattttaaacccttcaaacaagccgggaagaataaccataattacaaggatgggtgctgagaacatgagggtgaagttgcctcatcttatccgtgctgtccgcaattctggacagattgttacatggattactgatcccatgcatgggaacaccatcaaggccccatgtggtctgaagactcgtccatttgattccattatgaatgaggtgcgtgcgttcttcgacgtgcatgaccaagaaggaagccacccaggaggtatccacctcgagatgaccggacagaatgtaaccgagtgcatcggtgggtcacggaccgtgaccttcgatgacctgggtgaccgctaccacactcactgcgacccaaggctgaatgcttcccaatctctggagctcgccttcatcatcgccgagagactcaggaagaggaggatgcagtcagggctcacaaacaacctgccactgccgccattggccttctaaaacaggagaggaggggttagatagtttcgatctgcaagggggtggggcaatgggcattccgttgagtttgtatggtgggtgctgttttgcagaagctgtatgcttatgagcagctatggtacttatcgaggacagtagcgtacttgaggtgttgtatttttatttattttcttgtttttgaatgtccgatctgtttgagcctttggtgaccgaagaaaataaagctgggatgagttctgttggtgaattt

SEQ ID NO: 58 - DNA, 1464 bp, Brachypodium distachyon
cttaatcttccccaattcgtaactgaggcaaaaatcctccgcccttgtgtacagatgcgcaaccttgtaccgctgtagctccgcccctgccgccgaaaccccatatgcctcaggtcaagtctactgcaggtgctggcgcaatgccttccggatctaaaggtggtgatggtgaagtggaggcagggttcgcgaagctgcagggtgaggattttgagtattacatgcagacctactcgatcatgctgggacgtaacagcaagaaatcgtcagtggatgtggatctctccagccttggtggaggcatgaacatttcgcgccaccatgcccggatattttatgacttccagcgccgccgattcgccctagatgtcatcggcaagaacggctgccttgtcgagggtgtcctgcacctccctgggaaccctcctgttaagcttgactcgcaggatctccttcagatcggagacaagaagttttatttcctcctgcccgcgcgatctatctttgcctcatttgccgctgctcgacaagtccctgttattccgacacagatcctgccgccatcctttgtgcggccaggccacccaaatgtgtccaattaccatgaccagccctttgaaggtgattatggccgagagggtgatgacattcggaatggtatcaatgaaagtggaaccaggggcaagttgataaagagaaccaagaagccttctggagatctgggcatttatggtgggcaccgaatcaatgttgaagcaatagaaacactgggtgaagaaaatatatcagatgtaagaccaaggggtgacaaggatatggacaatcagcagctcctgcaaatggaagagaaggaagtcgtgtcatctgttgcgaccgtgttatctgacctctgtggtcctggagaatggatgcctatgagaaaactccatacagagctcgtggaccagtttggcaacgtgtggcaccacagcagggtgcggaagtacctgactgcggaggaatggtcgccggttgaagcaaaggggaggccatggtttggcctgctggggctgctgaggaagtacccggagcactttgtgatcaacaccaagtgcaagggccgggcgatctcggagtttgtctccctggtctccttgctctcctagaggggaccgcagactaccgacgacggccgtctctagggtctgttgtttcgtgccgtcctgttctctgtccagccatgcccagaagggccaagggcagagtggcggcgatggtcctggtttgtcttgtcttgtctgtcctttgagtaaacggggaatggaccctgctgtactgtgtcctgtactgtaatcctgggtttcccctctgtgtttacctgtagctctgtgactgtgatacctagaatgttattatctggtagcaagactttcaggtactagctcagttactgttgaaggaagtgtactagctcagttggtgtct

SEQ ID NO: 59 - DNA, 1732 bp, Brachypodium distachyon
ataccagcagccactacccccatcccggaaatatccccaaaccctcgcccgccgccgcccgacgaccacttccagatctcggcccatggacgacgacggcgccgcctccccgtcgccatcgccctccccatcgcgctcctcgtctccgctcccgctcgccgaacccgtcaccgtcgccgccgtgccccccggccacctcgccgtcgccctccccatccagaagcctgccccctccagcggcggcggcggcggcggagggggccgagaggacgcctggagcgacggcgccacctccacgctgatcgacgcctggggcgagcgcttcgtcgcgctcggtcgcggcagcctacgccacccacagtggcaggaagttgccgaggtcgtctcctcccgcgacggctactccaagccgcccaagtccgacatccagtgcaagaaccgcatcgacaccctcaagaagaagtacaaggtcgagaagtccaagtcgggctcctcatggccattcttcgaccgcctcgactacctcctcgcccccgtccagaagctcgggggcaattctggccgggctgcaggaaattcgggctcctctaacctcgccgagcggacaaccgctgttatgattccgcgtttcaacttccctacgcgcagccgtacgacctcgcacttccccccctccgcaggtctaaagcgcaggctgccgtcgccgccccaggcctcagcatcgtcggattcgtccgatgggttcccacctgagccaccggttgaggctgccaacggcaagagacagcgtgtcgaggaggctgtgaatggagcagatagcagcgtccgtgtgcagggtctgcgcgacctggcgcaggcgattcggcggtttggtgaggcgtttgaacgtgttgaggcctcgaaaagggagcatgagctccggatggagcgggaccgcctgaatgctgcccgcgagctagaggaccagcgtgtgcagttcttcctcaagatgcagatggagatctcaaaggccaacaatggtaccgcacttggtccccttgctgccgttgctgctgccatgattggcaattcagcacctgccacagtccccgccgttgctgatggcaacggctccaggagaacatctatggcacctgatgtcgggaccagcagcaatcaccatgtccggtaccgtgtgaaggatggcaggcatcatcaatccttgcaacacccatcctaccagtacaaccagaacaatgccggcgaggatgccacaggccatggtagtggcagcaacgacaacaaagaagatgatgaggtggaagatgaagaggaagagagccagtagaatttgtatccagtcaattggcattgtcctggtttgaattgctcccagttaattaggttggtctgggagcaagaaatgactattgagaactgctagattgtagtggtatttagcaaccaggagtagttaagttatggtaagtaactgcgagttggttgtagtaacttatagcttacctgtttgtgcttgtgatgtgattcatgtatcattggggatgtctcattgtggtgttagatgtatcagtgcttgctctttaatcatgataagtgtcgtgaactgttgtcaagatgtgtcattgaggatgtctcattgcagtgttggatgtatcagtgctttctctttaggatcatggtcagtgtcctcaacttggtcaagatgtgtgcacagtactcaattttccctttc

SEQ ID NO: 60 - DNA, 1618 bp, Brachypodium distachyon
tgctgcttcaggccttcaagagccactagtagcccacggcctctataaacacaggccgctcgtaccgtcctctgatgcagcatttcttctcgaggcaaagaaattactaacacactcggttctcttcgctaccgcggagagagcatatatctttgagatcatgggagggtcgatgtggatgaggtacgcgccgcacaacatgatgatcctggtgcagctgtcctacaccttgatgtacttcgtcacggaggacgccttcaaccggggcctcaacccctacgtttacgtgacctaccggcacctcctcgtcgccctcctcctctgcccgttcgcctacttccatgaaaagaagttgaggcccaagatgacgttgatgctgttcctggagatttttgtgctctcccttctgggggtgagcttgactctgaacatgtacttcgcgagcctcaagtacacgtccccaacattcgtcaccgccatggcgaacaccgtcgcctccatcaccttcgccatcgccatcgtcctcaggatggagatcgtggacgtgaagagcccgcgaggcctggcgaaggtcgcgggcacggcggtgtcgttcgccggagtgaccaccatgaccttctacaaaggagcagccatcgcgagcccatggaaggcgcccatccacatccacggcagcaacgccgtgcacggtagctgggtcaaagggtcgctcctcgccgtggccagctgcgtctgctggtcgatctggtacatcatgcaggcggggtccgtggagaggtacccggcggagctgtcgctgacggcgtggatggccacggtcggggggatacagtcggctgccttcacggtgttgctgcagcacaggaaggaggactggctcgtagggttcggcctcaacttctggtgcatcatatactctgggatcgcgtgcagtggcttcgcggtgttcgcgcagctgtggtgcacggagaagaaaggccctgtcttcgtcaccatgttcaaccccgtctccaccatcatggtcgccatcctggcctacttcatctgcggcgaaaatctttacgtcggaagcataatcggaggaggggtggtcatactgggcatgtacatgctgctgtggggcaaggacaaagatcaagagtacaacgcgagcagcagcaaggagctgcaggggtccgatctggactgggagaagcaggcaaagatggccgacgtttcttcagtacagaacgattctcagccagagacgaagacgatgacatagaagggttgggtcgccatcgtttcttcagcacagaactgtacctgcctgaaccgcgtgcattccgatttttggttttctggtgcactggcgttttagtgccttccagaaatcctaactaggagtaccacaattctgcaacctattgggagaaacatttgtggcgtggataatccactaacggtttgccagacggcccagacccagaagtaagtagtctgagaggttgggtataccagttcaggtagcttccctgaatcggaatacgcccgtctacgcttttgttccaagtacgtgctgtgttcggccaaatgcggcttgtctccgtgagaaacctcataaaacgaatataaaaaa

SEQ ID NO: 61 - DNA, 1885 bp, Setaria italica
gaaaaagagagctcaaggggggcataaggagaattttttatccagcttcctgcttgattctctttgatcccggagagcagccgccagtccaactaatccttgctgttcgtgtgcccgggctttgattgctctccagatccgagccacctgctcggtggattccaggaatcgagcacgaactcgacagggagttcttagggaaaaaggggaagaagaggctgaaagggcggtgaagttaggagcgggctgggtcccttgagcatgccgtcaagaaaccgcgtggaggggagggcgatgagatgagggatgctggccgcagtgatggactacttcagctcctgctggggcccgcgatctcgggccgggcaccggggcaagggctccgacgcggccggccggcaggaaggtctcctctggtacaaggacgccggccagctcgccaccggggagttctccatggccgtggtgcaggccaaccagctgctcgaggaccagagccaggtggagtccggatcgctctccttggctgaccccggcccgcagggcaccttcgtcggcgtctatgatggccatggcggcccggagacgtcccgattcatcaatgaccacctcttcaaccatctcatgaaatttgcaactgagcacaagtgcatctcagtggatgtgatccggaaagctttccaagcaactgaggagggctttctttctctagtcagcagggaatgggctttgaagcctcagattgcatcagtaggctcctgttgcctagtgggtgtaatttgttctgggactctctatgtcgcgaacctcggcgactcacgtgcagttcttggaaggcttgttaaggcaactggggaggttctggccatgcagttgtcgtcggagcacaatgcgtgctacgaggaagttagacaagagctgcagtcagcacatcctgatgatccacaaattgtggttctaaaacacaatgtttggcgtgtgaagggtctcatccagatctcaagatctatcggagatgtatatctaaagagaccggagtttaacagagaacctcttcatagcaagtttcggcttcgagaaaccttccagaagccaattcttagctctgatcctcaaattactgaacacagaatacagcccaacgatcagtttgttatatttgcttctgatgggctatgggagcatctcagcaatcaggaagcagttgaccttgtccagaatagtccccgtaatggaatcgctcgaaagctagtgaaagtcgcgatgcaagaagcagccaagaagagggagatgagatattcagacctcaagaaaatcgaccgcggggtgaggcggcatttccatgacgatataaccgtcgttgtgatattccttgactcaaatgccatgagcaaagctagctggagcaaaagcccctcggtctctatccgagggggcggtgtcacccttcccgcaaaatccctcgctcctttctcagctccagctcagctgaacagcacctactgaagaagttataccggaaagaaaaggcacgatgcagatctgctggagatgagagctgctgctgcaatcaagtgtagtgtaacacctgtcgtgttgcccttctcaaaacctactgtctagactccgcctggtaattagcgtactgatagcgaggtataaaaattagattatttcgtagcaatgcaaatccttccttttcttcttcttcctttcttctctttattcttatcccttttctcttcattatccatgagagaacaggtggttgtaaattgtccagaacatgttttccgtaatagtccatcatatcccgctttttcgtgttgatatgaaggcggcagcatcactgctcaagataatgttttaggacgcatggtttgac

SEQ ID NO: 62 - DNA, 2320 bp, Setaria italica
gccgcttccgccccgtgcctcctgcccccctccagctggctccgtctcgtcaatccgcgcgctcacaggtatacaaattatttgaaatagggacatagtacttggtgaaatgaagtcaacggtgttttctgcagttgttgtttcaattggttatgcattacttggatgggattttgcagcattgttagaggctaacggtcatatggaaaaggaatttgaattggagaatttaccttctattgagggtataaccatagcagtctcagcatttggggctattgtgataacaatattctctggatccctattagattggcttggaagacgtgccgtactggttcaatcatctctgctattattgtcgggtggtctcctgatgctgtggtctcctaacatctatattctacttctagctaggttaattgttggatcaggaagtggtttggttttcacctgtgtccctatttatatatccgaaatatctccttcaactatgaggggattactagtaactatgccacagttcatgttcttcataggaactatcttttcctattgcctgatattctggttaacactgatgccttcacctaagtggagaattatgattggtgcaatctttgctccttccattgtctacttggctttgttggtgtactacttgccagagtcacctaggtggcttgtaagtgatggaaagattagtgaggccagagtttctctacagtggcttagagggaagaagcatgatatttcaggagaaattagtactattgtggaaggtgtggactttatctctgacacagccattggcactgctcaggctcaaagtttctctagaatcagttctagccagatttggcccaacaatactttttattggcacctttcagacccactagttgatcttcttggaagcattcatgagactatgtcagaagcaacaggaagtagacggaatagtttcttccccgtcttcaacagtttttcttttccagaacatgaacatatgaacgagcatagggatgataacagtgatcaacagaccaggggggtttattatgctggagaagctaataatggagatggtttgcgaacttctctgctttctcagacagcaaatgttgaagttaacgatacaaatacatcttttacttctgaagggagctcttcatatttaagaaggcatggtacatcagcatttgcgcaagagtttgtggcatcttttattgataatgacattgaagaagaagatgaagaaacccatgggatggcattgccttaccagcctgcatatcggtatatggaaaacactaggcgacatccatgcagatatcgaatcctccggctatctgaaacagctgatatgaagtctaaatggcgggtgcttcttcagccaggaatcaggcatgccttgtgttatggcatgctaattcaagctcttcagcagtcagcaggaatcagtgtccttctccgctacactcctgaaatacttgaacaggttggagtggttagtttgttttcagacattggactttctcctcattcaacatcaattctcataagtgcccttaatgctttgctgttgctcccttgtataactgctgcaatgctgctgatggatgtctgcgggagaagggctcttatactggccactactccaatcctgatgttatcactgagcgttatgtctttgtccaccctggtggatatgggatcattggagcgtgccatcctcttccacctcgcgttaaccatttgcttctgctcctacgttgttggtttggggccgatacccaacattctctgctctgagatgttcccaaccaaggcccgtgcgacctgcgtgagcttctgttctctttccttctggttcggaggtctgctttcagcatactgcttccctgtgatgctgagtaccatcgggctcggcggagcatgtgggatctatgcacttgtgtgttgcattcctctttgtctcgtctactatagaataccggagacgaggacgcttaacttggagttaatcgccgaggtcttcaagctttcaaggcagctgccgtatgtacagtaggttgctcaggactgaaggtagaggtagctcaggctgggtgctgaactgctgatggatgatgtgtgtacatataacaattgtagcttggatgttgaaagttttgtgctagctttaggaggattggtgatagtgtacttagtggttatttcttctttcttaccaggttggtggcagtttttgtagtgtttacagcaagaaattattcactacatgattcctttctgagatcgaaataatatttctggg

SEQ ID NO: 63 - DNA, 900 bp, Setaria italica
caccagtctccctctccccacacctctccaaatctcgcgacgggagaggaggccatcaaatcacagggggcgccaggagccggagcgcgggagggtgggagaggaatggagccggcagagcgaatcgagtcggggaaggcgctggggaagcgcccgaggagcagggtgctgccccggacggccagcatggtgacggtgccgtcggcggctaagcagggccgccaggagcggcgcgccggcgtgacgtcgtccacttccctgccagctggtggcgcggggatgggagacggaggatccggcgccgcgacgagggcgttctactccggcggctacctcgccggcgcggagacgacggcggcgttcttgaaggcgtgcggcctctgcaaccgccgcctcggacccggccacgacaccttcatctacaggggcgaggtggcattctgcagccaggagtgccgggagcagcagatcgagtacgacgagcgcatggagcagacgtgctccctaacctccatcaaggaggccccgtccgtctccggcgccagcggctctgaccagtccggcagcggcggggagaccgtcgccgccgcctagcccggcgcaacggcggccgtggtggtgcaagcggcgcatgttgcgcgcttggcactctggagcagcggcaccagatcgagatcagtctgtcccttgttagttttcccgggcaagtgctctagcgtctgtgtatccagcttttagctctagaagtcgtcgtcgtcgctcatgaaccgtagcggcagcgggagatggatcttcaggagaggaatgcgtcagtgatttaattttgctgtccctgacgcgtgtatctctggaatcttggtttccttgactgtcggaaggaagaaggaaaaaaaaaacttt

SEQ ID NO: 64 - DNA, 1339 bp, Setaria italica
tcagtcattgaggcgatctgtgatcgagttcctcttgtgtctccagagaatagtagcgtgagaacgagggttttcaatatggcgtccaggatcgcactcctgtgccttcttggcttgctggtagcatcacctgctattgctgactccggcatctactaccagcttgaattgatgtggccaggggcgtactgcgagcagagcagcgccggatgctgcaagccgacgaccagcgccaagccggcgcgcgacttcttcatctcgggcttcaccgtctacaacgcgacgaccgacgctccggtgacccgctgcagcaacaaagctcctttcgaccctaacgagattacggacatcccaggcctgaagcagtactggagcaacatcaagtgccccagcaacaacggccagggcggctggaagaacgcctggaagaagtccggcgcctgctccggcctcaaggagaaggacttcttcgagaaagccctcgagttccgcagccggctcaaccctctcgttcgcctccagaaaaacggtatccagccggacttcgagctgtacagcttgaagaagatcaagaaggtgttccagtcgggcatcaacgcgacgccgctggtccagtgcagcatgggccccttcaacaagtacatgctgtacaagctctacttctgcgcgacggagcagggcacgttcatcgactgccccgtggcgcccaagtacacctgctcggcggagatcctcttccaccctttcaagaggtggatgctccagcagctccagggggaggacgccgagtttgccgccgcggccgacggcgacgaccaggacgccttcgtgctgcccggcgtggccatggatatgtaaccgatggatcgatcggaagcatatgcgtgtcgtcgaggagagaccccacctgatctccgatccatccagatcgtctttcaattcgtgagtttcggtggcgtacgcgtgcatggaataatgtcgttgttcctgctcccccgagcaaacaacaacgcagtgtagtaatatgtgaaaataattaaacactgagacgtacgaagacaataatggtacggtgatctcctcctcttctacgacgagttccttctattcctactcatcagggaagatgtggccgtgtttatctagctcttctgctttgcgccgcctcaccaagctcactgcccgcagcgtcgccgcatggccacatcccacatcttaaattcggtggttcaataacataaatatggtcccctggtcccgcaaaattacgttgactgccgcttaaattctacgttgatttgcatcaatattcttcatgctgtgttatatattataaaag

SEQ ID NO: 65 - DNA, 847 bp, Setaria italica
agtcttgacacctctagcaacgagcccacctccaagcaacttctcgcacgtagtctcccactctcctcttctttccccactccagcgagctggcaaagcgtgacatcttggccggcgatgccggcttatgccctgacggcgaagcaggagacgaggcggtgatcagcagcaaggcggtggtgaagaagctgtaccgcgcgctggagcgtggcgacgtggacgccgtccgccgcctgctgaaccccgacgtggactggtggttccacggcccgcgggcgcaccagcacctggtgctcatgcgcctgctcaccggcggcggcggcggcctcccgttcaagatccggtcgctggacgcgttcgggccgaccgtgctggcggagggcacggacgcgacgggcgcgctgtactgggtgcacgcgtggaccgtgggtcccggcggccgcgtcacggaggtgcgcgagtactgcaacaccgcgctcgtcgtgacaaggctcggcggcggccgcgacatggaggcgcgggcggcgccggcgagcgaggatgtgtgctccaaggctcagcaggtgtggcagagccggctgccggaccaggctcggaggaaccttcctggcctcgtgcttgccatctgaactgatcagatagtgtcatgtaacagaactcctgaggcaaactggccggctgtaatttaactggccacaggctctacacgatggttcaacttttgttaactgatcaaatggttaaaagcttgacgctcgggagtcaaagcttccacgcttttgcatcctgtggggtcgtgaccaccggatgccacgaggaagatgatagaatcctagtggaacttctc

SEQ ID NO: 66 - DNA, 1576 bp, Zea mays
ccgcgatctgtaacgtgtggcgcagcgggcgatctccgattcgctgccttatcctctgctactgccgcaccaaagcgtgagcaagcctgcctcccgcgagagcgctcaaccagccaagccggcgtcagaggcgagcagagaaatggcgggagcgaacttcctctccaccgcggcgctcgtcgcccgcggcgtcgctgcctgctcttctatttcaactccgacacggaggcacccgcaaatccgggtgtgctgccgggctgacgttgaggctatggaggcctatgcccatgaagagcgccttcgattccgtcggagagatttcatcggcacctgcgtcggcaccgctattggtttggaaatgatcgacggctctacgagtttctctggagtggctactgcagctgatctcattgagcgtagacaaaggtcggagttccaatcaaaaatcaaagacaccctttacgtagccataaaggctaagccagagctcgttccatcgttgttgaccatggcactgaatgatgccatgacatacgacaagaccacaaaaactggaggcgcaaatggatctatcaggctagaaacaagcagacctgagaacagtgggctctcttccgcgttggatttgctgactgaagccaaaaaggagatcgattccttttccaagggaggtcccatttcgtttgcagatctgatccagtttgcagcacaatcagcactgaagagatcgtttcttgacgctgccattgccaaatgtggtggaaatgaagagaagggaagaacactgtactctgcatatggttcaaatgggcagtggggtctgttcgatagaacgttcgggagagcagacgcacaggaagcagatccagagggaagagtgcctgactggagcaaggcttctgtgcaggagatgaaggataggttcgtcgctgttgggttgggtcctcgccagcttgctgttatgtcagcgttccttggacctgaccaggctgctacggagggacgactgatagctgatccggattgccgtccatgggtggagaagtaccagcggagccgcgagaccgtctcccggactgactatgaggttgacctgataactacactcacaaagctgagctcccttggccagaagataaactacgaagcctacacataccctaagcagaagattgacctgggaaaactgaaactgtaagagatgattgccgggcacctgcatcggccgtatccaggaatcgggagctaattgtatggtaggctctgtctgctagagtgatttgattcggcgctgacgtccaagtattggctacttactggtcagctgtcagacattcttcccacggcaattaggatggtccctgtacatggttaaattggttctcccatttcgttttgtgtgaacttgaagaggcaaacgcttgtgagaagtgaggtgttgtgtcaatccccttacgtatacgagacgactgaagaattagtagaaaagaagtgcaagtgtcatgtcttgagtctgaagtctgagctcatgtttctgaattctgatcagaagcaggacagctggctcgtcattttg

SEQ ID NO: 67 - DNA, 1095 bp, Zea mays
gactcgtctcggatcgtgctaattctactactacttcggaaccgccgccgctcccggcgcctcggattatcaactaccgcaggaggtcgcggcggcaggatcggtggtccagcgtgcgatggcggcggcgcctaccgtgcggggctacgggccagcgtcgccgtcgtcgtcgtcggtggcgctgcctcggccgcgatcgcgggtgcccgcaccgctcgtgcccgtgacgacgcggcggggggcgccgtcggtgcgcctgcgcgcggcgggcgcggacacgcctccccgcggcggcctgcagctccagcggcgggaggaggacgaggggctgccggggaccgtgttgggccgaggggaggacgatgaggtgtcggagaaggtcggggaggagaaggtggagaggtggatgcgggactcgatcgcggagatcgtgcggcacgtcggggaggcgccgttcctggtgcacctgttcagcagcggcgagggcgagcgcgtgacggtgcggcgggagcccgcggcgccggagagctggccggacgtgcggcgccggtgggggccaggcggggcgcggaggccggacgggatcatcctggtcgagcaggtggcctcggacggcggcggggcctccgccgcctcggaggcggcgcggcaggtgtgggggctggtggtgcaggcgcgcggcatggagcgcgcgtcgtgctacgtgctttccacctgccgcgtgcgctcgtcggccgggttctgcacgcacttctgcctcgcgcgggcgcagtgcttcggcgaccctgtcgagctccagctccgcaacgcctggctcaaccgcctggccggccgccggtagccgcccgtcggctgctgctgctagtgctactgatactactaataggattcgaatcgatgctccaaggaccaaatgcaatgatgcctcctcttcgctggcaagaacgaggaagagaagcttgcagattggatttgaagcaggggagacgaacatatcttttcgttcacttggggttctcccggaattggatatcaattgtacagattattgaatgtaaatttgcctattcaatcaagaagcaattcatcgagtca

SEQ ID NO: 68 - DNA, 3019 bp, Zea mays
cgggcgcagggcacacggctagagcctaaaagggagggagggggaggcgcgcgagccgccaggacctgagagcggctgctgctggcgaatcgacctcctgggcccgggaagagattgggtactgtagagagaccgggtagagatagagaggccaggatgagagtggcggtggtaggcgccggcgtgagcgggctggcggcggcgcacgagctggcgaggagcggcggctcccgggtgaccgtgtacgagaaggaggactacctcggtgggcacgccaggaccgtggccgtcgaggacgccgacgccgccagcaccgtgcagctcgacctcggcttcatggtcttcaaccgggtaacatacccaaacatgctggagtggtttgaagggctcggtgtagagatggagatatccgacatgtccttctcagtgagcacggaattgggggccagcggcagcagatgcgagtggggcagccgcaatggcatctcaggactcttggcacagaaaagcaatgcactcagccctagtttctggcgcatgattcgggagatactcaagttcaagaacgatgctctcaggtacttggaggaccatgaaaacaaccctgatatggaccggaatgagactctcgggcaattcattcggtctcatggatattcacagttcttccaagaggcttaccttaccccgatctgtgcgtgtatatggtcatgcccatcgcaaggagtgttgggattctctgctttctttgtgctctctttctgccgtaaccatcatcttcttcagttgttcggtcgcccccagtggctcaccgtgaagggtcgttcgcactcctatgtacacaaggtaagggaggagttggaaagtatgggttgccaaattaaaaccagctgtgaaatcaaatctgtttcaagttctgagggaggtttcagggttacagtgtttgatggttcagaggagacgtatgacagaatcatatttggtgtccatgcacctgatgctctaaagattctaggagctgaagcaacacatgaagaattgaggatcctaggagcttttcagtacgtctacagtgatatatacctccactccgataaaagtttgatgccacggagtttgtctgcttggagttcctggaacttcctggggacgacaagcaagggggtttgtgtaacctactggctaaatctgcttcagaacatagaatctacaagcagaccttttctggtgacgctgaatcctcctcatgtcccagaccacgtctttcttaaatggtacactagccaccctgtcccatctgtggctgccgcaaaggcttctcttgagcttcatcacattcaaggaaacagaggaatttggttttgtggggcataccaaggttatggtttccatgaagatggactcaaggctgggaaagctgcagctcaagatttgcttggtaaggagagtgaccttttggtgaacccaaaacagatgatcccatcgtggtctgaggctggggcgcgtcttctggtaacaagatttcttggtcaatatgtgtctgtcggcaacttggtcttgcttgaagaaggaggcactatgttcagttttggtgaagtaggcaaaaaatgccatgtgaaatctgtcctgcgagtacatgaccccatgttttactggaaggttgcaactgaagcagaccttggcttggcagatgcctacattaacggttatttctcatttgtagacaagagagaaggtcttctaaatcttttcctgattctcattgcgaacagggacgcaaacaagagtagtagcagcgctgctggtaaaaggggttggtggacacccctgctattgacagctggggttgcctccgctaaatacttcctgcgtcacatagcaaggaggaattctgtctcacaaacacgtcaaaacatctctcaacactatgatctgagtaatgaattcttctctcttttcctggatccatcgatgacttactcttgtgccatcttcaagacggaggatcaaagcttagaggcagcccagctacagaaagtttgcctcctaatcgataaggctaaagtggagcgagatcaccatgttcttgagattggctgtggttggggcagcttagcaatccaattggtgaagcaaactggttgcaaatacactgggatcacattatcagtggagcaattgaaatatgcacagagaaaggtgaaagaagctggattagaggaccacataagcttcatgttgtgtgattaccgtcaaataccaactcagcgcaaatacgacaggatcatctcttgcgagatgatcgaaggtgttgggcacgaatacatggacgatttcttcggctgctgcgagtcccttttggctcaagacggcatatttgtcctgcagttcatctcaatcccagaagaacggtatgaggaatacaggcgcagctcagacttcatcaaggaatacatcttccctgggggttgcctgccttcgttagcccggatcacgtctgccatgtctgcagcatcaaggctctgcatcgagcaccttgagaatattgggtaccattactacccaacgctgatacagtggagggacaacttcatggccaataaggatgcaattttggccctgggcttcgatgagaaattcatccgtatatgggaatactacttcatatactgcgccgctggtttcaagtcacggacacttgggaactaccagattgtgttttctcgccctggcaacgacaaattaggtgacagcggtatacactccttaagcaagctttctggcagctaataatgcgaggatctatatatatgtggtggtagctggatcagtcggagcctacacacctgaacttgagcctttttatttgtgatcgaattggacacgcagtgctgtgtacacgtcgctaactaactgtacttgcagcggcggatcattccattgcttcgatccaatttgacgtttcatcactttctgtttctgttggcgcaacgtaactccaatgattaaccttggcaca

SEQ ID NO: 69 - DNA, 1225 bp, Zea mays
attcattgggggcatttgctacaccaccacacccacaccccatcccagcacacaacaagcagcctggtttacggtagctgctagcaaaacaatggagaaccctgctccgagcatcgtagtggccatcgccgcacccgtggcggcggagttcgtgaaactcaccttccgtgccctgtatatgcgccgggctggtcctggcagcagggagatgactgtgccgggaaggccatccgaccagctgggcaggagagtcgtcactgacagccccgtgtacgacggccgtggcgccgacgcccgcctcgtggctcgcatacagggagtcacggtcctggtcggtaacgcagacgccttgttcaccatggtgttcgaaaccgacaggctaaagggctccacgctcgtcatcaacggaatggtcacggatgggtcagacgaatgggcgatctacggcggaaccggggtgttcgccatggccaccggtgtcatgaagagaagaaaccttgccggcggtagcaacgacgggaactctgacgagcttgccctggaagttttctgcccggtgtttggcgcatcacagcaaccaattagcaagcagcaggagtccatctcctccgtcaccaagatcggactatggggcggacagggagggtcggcacaggacatcacggcagagcagccaccacggcgtctgcacagcatcaccgtccgcgctggcgttgccgtcgactccatcgagttcacctacaccgacgacgctgggcagaggcgcactgctgggcggtggggtggacttggcggcaatgttcgaacgatcgaccttggcgacgcagaggatgtcagggaagtctcgggaacatacggcgcatttgaaggtgccattacgctgacctcgctcaggctcgtcaccagcagcagaacctggggcccctggggggtcgagaacgggacgcgtttctccatcacggcgcccaacggcagcagcatcgcgggattctatgcgcgggcgggaaccaggctcgtcgacgctatcggtgtttacatacgtccagtggtgccaggcaggcctcggtgaacaagcgagccgagctcgctcgtattacgagctgtaggattatggttcggcttgacttgatgtaggctacctgctacatcatgctcgattcactatcctttaattcggtcatcgtcgtcgtcttgtctcgtgtcaaataaagctctcttgtgccta

SEQ ID NO: 70 - DNA, 799 bp, Zea mays
gcagtctgcagacctggaaaacattcggaaaaatgcctagcagaagtactctacccatcccccatttctcaaaaagcccaaaccccaggcgtcgctctgtatttttctctcctcactcaacgcggcgatgccccctagatcggatcacgccgccggcagcggcgccgcggcggcggccacgcaggcccacttcgactccatcgatccactcttccatgtgctccgcgtgctacccttctccttcctcctgccgccgcgcacccgcctgaggctgccgtcgaacctggcgcttccctctcccatgaccgtcttctccctcatcctgctcacctactttgcggtcgtctccggactcgtgtacgacgtcatcgttgagccccctggcatcggcagcgcccaggaccccggcactggcgccgtccgccccgtcgtcttccttccagggcgcgtcaacggccagtacatcatcgagggactctcctccgggttcatgttcctccttggcggcattggcatcatcctcctcgacctcgccgtcgaccgcacgaggccccggagcctccgcgtctcgtttggaagcgccggcgcagtcgccgttgtcatcgcctacgccatggccatgctcttcctccgcatcaagatccccggctacctctggtgaggttgataaatcttgcctgttaactagaccagatccgtcgcgagatctcgctgcatctaaatagacctgcgtgctgtgcagtgtggactgtgctctttcaattttgtcaattaatgttccatcacacaatttgtatgg

SEQ ID NO: 71 - DNA, 1833 bp, Zea mays
ccaataaaatgctcagctccactgacgaaagcttgccggtgtcgtcctgcccacgcgacgcgagagcgggagcggtgggtcgagggacgagctggaccccgccgctagtcccctacccctgcctgctcccccccgcctgccccgtgtttatatctgccgcgccgcacagggagagagtcgagtccagctcggcaggtcagtcagtagtggatagctccgctcgcggtcgcgggcggctcgagtcgcaccccagatcccaatgcgccccgccgcgccgctctaggccgcggaacggaagctaggtgcgtcacacgccggggccggtcgcggtcaccggaccggacgcacaggggcgccgtacgtgcagtcatcggccatgaaggtcctcgtcctcgccgtgctggcgctcgtcgccgccgccgccgccgccggtcagggcgaggaggggggcgggccgccgctgccgttcgcggtgggcgcggcgccggcgggctgcgacgtcgcgcagggcgagtgggtgcgcgacgacgacgcccgcccatggtaccaggaatgggagtgcccctacatccagccgcagctgacgtgccaggcgcacggccgccccgacaaggcgtaccagagctggcgctggcagccgcggggctgctcgctgcccagcttcaacgcgacgctgatgctggagatgctgcgggggaagcggatgctgttcgtgggtgactcgctgaaccgggggcagtacgtgtccctcctctgcctcctgcaccgggccatccccgacggcgccaagtcgttcgagacggtggactcgctgagcgtcttccgggcgaagaactacgacgccaccatcgagttctactgggcgccgatgctggccgagtccaactccgacgacgccgtggtgcactccgccgacgaccgcctcatccgcggcgcgcccatggacaggcactacagcttctggaagggcgccgacgtcctcgtcttcaactcctacctctggtgggtcgccggggacaagatccagatcctgaggggcgccgacaacgacccgagcaaggacatcgtggagatgaagtcggaggaggcctaccggctggtgctgcaccaggtggtccggtggctggagcgcaacgtggaccccgtcaagtcgcgggtgttcttcgtcaccgcttcgccgacgcacacggacggcagggcgtggggcgacgacgacgcggagggcagcggcaactgctacaaccagacgtcgccgatcagcgccgcctcgtcctaccgtggcggcacgagccaggagatgctgcgcgcgacggaggaggtgctggccacgtcgcgggtgcccgtcgggctggtcaacatcacgcggctgtccgagtaccgccgggacgcgcacacgcagacctacaagaagcagtgggtggagccgacggccgagcagcgcgccgaccccaggagctacgccgactgcacgcactggtgcctccccggcgtgccggacacgtggaacgagctgctctactggaagctcttcttccccagcaacgatcaggtcctctgatggtgcattggtgcctgcatacatacgcctggaaaccaactgctaggggctagcccaaagaaaatgtgtctagatgaacaaagacatggggttcaaatgttttgttttgatttcggatatggacgctgtcgatgctcttgttctctgtggaattcttcttaccaactgtgcctcccatatatacatcactactgatactagaatctatgctgatattttctttcgttaaaaaaagcgacagtgaagcgtagaagcacctacaagagttttcaaaa

SEQ ID NO: 72 - DNA, 1058 bp, Zea mays
aattctatatagaatgggttgggaattatgcctagatcccgtataaatggaaatttcattgataagacctcctcgattgtagccaatattttattgcaaataattccgacaacctccggggaaaaaagggcatttacttattatagagatgggatgttggctcaatccgaaggaaattatgcggaagctttgcagaattattatgaagctatgcgactagaaattgatccctatgatcgaagttatatactatataacataggccttatacacacaagcaatggagagcatacaaaggctttggaatattatttccgggcgctagaacgaaaccccttcttaccgcaagcttttaataatatggccgtgatctgtcattaccgaggagaacaggccattctacagggcgattcggaaattgcggaagcttggtttgatcaagctgctgagtattggaaacaagctatagcgcttactccaggaaattatattgaagcacagaactggttaaagattacgaagcgctttgaatttgaataagaccactctccattttcataaaaagggtggtttggttgaaaatcaaatcaagaatttcattatatccctttcttctaccttcaattttatatcatatttcataaggataaacaatagggataggctctggaacagaagtaataaagtacataaaaatcggcaatctaaatattcctacctaatatatcaggacggtcttattaataattctaatgagttatcttggaattttgaatcgaatcaaaaaatctatattatgctcactcaaggaaagtagatgtagataggggcttataccctcagaaaaaaaatacaccagcttcttaaattaaaacgtaaaaaaagatttttttgttatgtcgggaaataattttccagaataaccaatgtccgttaggcacctaatccttatgtcataatagatccgaacacttgcctcggattgacttcaatatataattgctccagtgaataactaaaaaaaaaatagaaggacggtagatagtaaagaaaaggac

SEQ ID NO: 73 - DNA, 1311 bp, Zea mays
cttttccaccgaaaaccagcccggccgcccggcggcgaggaggaatccccattccccccctcctcacgcacgctcctcgccatctttagcctggaccccacctcccgtgccccggccattaaagcgggggaggccgacccgggcgctccctgcctcctcgtcccgtccctcccagcgccccgttccattcgaccgccgaccagatccacccccaacacgtccagccatgccggcgccgccgcatccaacgccgctgctgccaccggcgggggagccgttccgcgtgttcgtggggtacgacccgcgggagcacgaggcgtacgaggtgtgccgccgcagcctgctccggcgctcatcgatcccgcttgacgtgcgcccgatccggcaggcggagctgcgcgccgcggggctgtacacccgggcgcgcggccccacggagagcaccgagttctccttcacgcgcttcctcaccccgtacctggcggggtaccgcggctgggcgctcttcgtcgactgcgacttcctctacctggcggacctggccgacctcctcgccgccgcggccgccgccgaccgcgcggccggcgccggccgcattgccgtcgcctgcgtgaagcacgagtaccagcccgccgaggccaccaagatggacggcgccatccagacggtgtacccgcgcaagaactggtcctccatggtgctctacaactgcggccaccccaagaacgtggccgcgctcactccggaggccgtcagcacccagacgggtgccttcctccaccgcttcgcctggctcgacgacgacgagatcggggaggtgcccttcgcctggaacttcctcgtgggccacaaccgggtcgacccggccgacccggccacgcgccccagggccatccactacacctccggcgggccgtggttcgagcgctacagggactgcgagttcgccgacctctggctcaaggaggccgaggagctgagggccgacaaggacaaggaaaacgacaagctcaagctcctcaaggacatggacgacgccaacggcaagcaggaggtggaggaagagacggcgcaggagaaggagaaggagaagggcaagtgatggtggtattcatccatggatcggtgatgctgcattgtgtggaagtggattggttcgtttctgtgctttgctgctatagagatttcattctttcatctgtcttcgacaccaatgtagcgttccattccatcgatctgttactgctgatgtctgggagattaggatgattggtaggcctgtatggagtaagaaggaataatttgtagctg

SEQ ID NO: 74 - DNA, 1794 bp, Zea mays
agttttcctcgccgctcctagatcggcagattttacctgcctctgctctgctcgtcgccagccggccggccgggccatcgcacgtcgctggcaggcaggcatgggaaagaagcacgcggcaggtggcggctggttcgccgccgtcaggaaggtgttccggccgtcgggctccggcggctcatccgcgaccgcgaccaccaccacctcctcgtccaaggacaaggacaaggacgccgtgcagcacggaaaacaggacgccgccgccgccgaagagccagaggtgctgctgctggagcacttcccggcgtccgagacgtcggcggaggcgagcaacgagggcggcgacgcggaggcggagccggcggcggcggcgacgaagggtcgtcgtcgagaggacgaggtcgacgacgaggatggggagatggaggaggagctggccgaagacatggagcgcgcgagggcgctggcggccgcggccgaggctgccgtggccgcggccgaggcggctgccagagtggtgcggcttgcggcgctccggcgcctgtcgcgcgaggagcgcgccgccgtgcgcatccaggcctactgtcgtttgtttcaggcccggcgagccctgcgcgcactacgtggcttggtgcgcctgcaggcgctggtgcgcggtcaccaggtgcggcggcaggtgcacctcaccatgcgctgcatgcaggccctcgtccgagcccaggcccgcgtccgcgcgcgccgcctcacccaacacccgctcctcctcctcccgccgccgacacctccagccagcagtcccaccctgctgttgggagcggggcgtccattatgcgtcgagctggcattgcagggcgaccacgacgtcggtgacgacggcgaggtggccgatctgttgctccagcagagaagcaggagcagaggcaggtttggaagaggcgacgataacggcggcgcgaggagcccttccggggcctgggacagcagtagccgcaccctggaggacgccagggcggagggcgcgcgccggcacgacgccgccgcacgccgggagcgggcgctcgcctacgcctacgcctaccagcagcggcagtggcagcggcaggaggacgagaaggccggcctgggcttccactggctagagcgctggatggctgcgacgacgcaggcgcagcagcaggagcacgcgcccgaccacgccaagacgcaccagagcacccccaccaggacgacgtcatcctacgtgacggcggccgctgctttcgcgaacggcatgtcggagaagacggtggagacggagacgacgtcccggagcccactgaaccaggcctccgcggctgctcacgggcgtccgcccgcgatcccgggctacatggctgcgacaaggtcggctcgagccaaggcgcgccccgcgccgccatcggctacacccacgcatgccaggagccggtcgggtggcgggctcgccggggacacgtcgagctcgggccagaacggcagtgcggtcgccgggtacagcccggactcgagctgcacaggggactggaccccgccgcggctcggtgtcagcacgcgcaccagcagggtggcctatacttgagcttgacttgagcatggcgacaacatcagtttcatcatcatgaatgtgcgcttgagagttgagactcatttttgaatgttcttgtttgttcaaaatttatgtatagcttgctctgtcagatgagatgacacgcctgatgccgctgtaaacgctctgaatactcaaaatgattgcgaataaaacactcgagaattcta

SEQ ID NO: 75 - DNA, 2323 bp, Zea mays
atggtgagtctctctcagcagcagcactcagcacacagagtccgcctacgccgcggctccggcgcccgcatccgtctcaggagtcccttctccccgcgggtggagacatcttgatcgtttctgagattaaactgatgatgctgatgctcgtttagttatcttggtttggagatatatcagatatgggtgatcggaatcatggacgctctctccctctactgctctatctacatcttttgctgccaatacttccgtttgctatggcagatatagcctccgagaagcaagcactctttgcttttgcctctgcagtctaccatggcaacaagctgaattggagccaaaatatcccagtgtgctcatggcatggtgtgacatgctcactggatcgatcatgtatattggcccttagggtgccaggtgctggtttgattggtaccattcctgctgatactcttggcaggcttgtgtccctccaagttttaagcatgaggtctaaccgtttgagtggaagccttccgtacgatgttgtctcacttccttatttacaagccatatttgttcagcacaacgaattgtcaggagacttgcctccatttctctctccaaaccttaatacccttgatctctcttacaactcctttacaggacaaatcccatcaggtttgcagaatcttaccaaattgtctgtcttgaatttagcagaaaattccctgtccgggccgattccggatctcaaacttcctagcctaagacagctaaatctgagcaacaatgaactgaatggttcgattcctccctttttccaaatcttctcaaatagttccttcctagggaactctggattgtgtggaccgccgctaactgaatgttcttttctatcttcaccaacaccgtcgcaagtgccttcaccaccaaaattaccaaatcatgagaagaaggctggcaatggcttggtaatcgtggctgttgctgggagctttgtcatatttctgctagctgctgtgatgttcactatgtgcatttcaaagaggaaggagaagaaagacgaagcgggttacaacggtaaggttactgatggtggaagggttgagaagcgcaaagaggatctcagcagcggcgtccaaatggcgcataagaacaagttagttttcttggagggatgcagttacaactttgacttggaggacttgctgagagcttctgctgaagttctcgggaaagggagctatggaactgcctacaaggctatactcgaggatggctctactgtggtagtcaagaggctaaaggatgtcgtggcagggaagaaagaatttgagcagcagatggagctcatagggagggtaggtaaacatgcaaacatcgcgcctattcgtgcttactactactcgaaggatgagaagcttgttgtttatgagtatattggtagaggcagcttctcagctctgttgcatggtatcaagggcgtgtgtgagaagaccccattagattggaacacaaggatgaagattatactcggaacagcacgcggcctcgagcacatccattcagaaggcggctccaggctcgcacacggcaacatcaagtcaaccaacgttctgctcgacggagaccacaacccttacgtctcagactacgggctgagctcgttgacgagccttccgatcaccacttcccgagctgtcgctggctaccgagctcaggagaccttcgaatcgaggaagttcacccacaagtccgacgtgtacggtttcggcgtcctcctcatggagacgctgacgggcaaggccccgcttcagtcacagggtcaggacgacgccgtcgacctaccgaggtgggtgcattcggtggtccgcgaggagtggaccgctgaggtgtttgacgtccagctgatgaagtatcccaacatagaagacgagctggtccagatgctccgtatcgccatggcgtgcacggcgtggtctcccgaccggcgtccgacgatggcgcaggtggttaggatggtggaggagctccggcactctgcttccgggagtcgcgctctctccgttggcagtcccaaggaatccagtcctctgtcagcctgaattgtggttctgattcagaattcgtgtatccatgacatcgatgatcgatggtatcctgcatgtggttcacggtgcacacgttgtctgcctcgtcagatacttcgtactgctgtaactttggttcaatggaatgcttaagaaacaaggtcggaataggcgaatagctattttcgtctttcacctattgattttgtccttgcatacaaaaaaaagaatagacgtttcagttccta

SEQ ID NO: 76 - DNA, 1322 bp, Zea mays
cggagcaagcagaagaaagcaaagtgcagagcacgagcagcagcaccagtccaccaggccggcgccgcccaaaatctccgcgtccccccccccatggcctccttctttgcggacgacggcgccgacgacctcccgcgcgccacctcccaccccttcgactccgacgacttcggtgctgccgcagccgacgacgctagcgccggcgggtacgcctccttcgccgacggtggcgtcgaggaggtggacgaggagatcaccgtagagtcctacggcgtcccgatccgccacgtctccgggggatactcgccattctcccccgacctcgagcccaacggcagcgacggcccgaccctgccgccgcccaccgagatggggcgggaggagggaatccttctccgcgagtggcggaggaaaaatgctatggaacttgagaaaaaagaacagaaggagaaggagctacgtgcccaaataattgctgaagcagaagaattcaagaaagctttttttgagaagaggatacagaactgtgcgtcgaatatggtcaacaacagagaaagggagaagatttttgtagccagccaggagaaattccatgccaacgcagacaagcagtactggaaatcgatctcggatctcatcccgcatgaaatagccaccattgagaagcggggaaagaaagacaaggacaagaagccatccgtcacagttattcagggccccaagcctggcaagcccaccgacctctcccggatgcgccatatcttagtgaagctgaagcacgctccaccgccacatatgttgcaacctccaccagcacctgctgctaaagagggcgcaaaggatggctccaaagaaggtggaaaggatggtggtgccaaagacggcgcggcagccccagcaaacgacgccaagcagcctgcagagagccaagaaaccagcaccgccaatggcccctcggaggccgagaaagagcagcctgcggcgtcggagtgaccggaaaggaaagcgtagcattacagaaacacaagaggcttgactgtcagtagatggaaacgtgtttttgtttctgatgatttcgcagacccgtttatcccgtactgatcttttgcagagatctgcatcaggatgtcttcgtatgagcacagaacattcataatttagtatcaccacagtagtcgtatctttgctgttttcacccctgtccagttgtgtcgtcactgagatgcctgtgatctcatacaagttgaggtctgaaactgttacgatgatatggtactgccctaataataatctgaagctgtgcaacaaacagcaatcttgca

SEQ ID NO: 77 - DNA, 1390 bp, Zea mays
gagtattccaatccagcaccgaaccatccagaagcagccgcctcctgctcttaaaaaactctcgtctctggtcatccattccacacacccaacatcacgaaaccacgcgcagatccaaacgaacccgagcccttccaaaccctaagctcgcctcccctcccccccaaacaccaccgcgcacctatggcgaagtacggcgagggcgacaagcggtggatcgtggaggagcgcgccgacggcaccaacgtccacaactggcactgggcggagcgcgactgcctggagtggtcccgcgcgcggctctcttccctgctcgcgggcctcaccatcctcgacggcgagggcggcctcagtctccgcaccgtcgcgctcgacaagcttgatggcgaggcctacgtcaacatccgcaagggcaaggtcatcccggggtacgagctctcgctcaccctctcctgggaggccgaggccgcctcggagtccggagctgcgaaggtcaccggcaccgctgaggttccctacctcgccgacgagaacgccgacgaggaccccgacctccgcgtcaccgtgcgcggcgacgagacgcccctcgcgctccgcgccaaggacgccttcctctcccgcgggaaacccatggtgctcgagaagatccgggagttcgtcgctgccatggccaagggtggaccggccaaggacgagctggactccaagaaaactcccacgaaggtcgccggctccgcaccggcgaaggaggcggtactggctcctgcgccggctgtggagaagaaaaaggccaaggggaaggacaaggagggcttcaagaccattgagatgacggagaagttctactgccgctcaaaggacatatatgagatcttgatggatgagaacagatggaaagggtttacgcagagcaatgcgaggatcagcagagaggttggaggggaatttagcctcttcgacgggtccatcactggcgtcaacgaggagctgcaggaagggaagctgattgcacaaaagtggcggtttggaagctggcctgacggcttgtactcctcggtccggttggtgtttgatgagcccgagtctggagttacaatcataaagctcaaacaaactgatgtgccagaggaagacaagtatggaaattcaactgtggtagagaacaccgagagaggctggagagaactcatattccagcggatacgcggagtgttcggttttgggatctaaagaatctaaagaggcgatttggcatgaagttagatttcaaatttttacggggtcagaccatgcacgtcatagcaatccatgttttattcacccatttgttttccatgtccttaaacacagaacactgcatatcgtggggggtttaaaaacatctgttatt

SEQ ID NO: 78 - DNA, 1277 bp, Zea mays
gattccttccttgtgagctctgagctggttgctgccgccaggattggaggagtgcgcgcgcgcgcaagtgagccatcactgagctgtggacgtgaattgcgatcatccgttctcgctttctggggctcggctgctgtggccatggcgccgccgccgccgccgtacgcgcgggtgatggaggacatggtcaagggccgggagtacgccacgcagctgaaggcgctgctccgggagtcgcccgaggccagccgcctcgtggaccggatcctgcacgccatatccctcaccatccagacggccaaggccgcggccgccgccgctgaggaggaggaggaggaggaggcgtccgaggtgcagagcgaggtcacctgcaccggcaagaggaaggccgctggcggagcgggcaagagggccgccgcgtgtcggaggagagcccagccatcgtcggttgtgacgaagagcgtgagggatctggaggacggacacgcgtggcgcaagtacgggcagaaggagatccagaactgcaagcacccaaaggcctacttccggtgcacgcacaagcacgaccagcagtgcgcggcgcagcggcaggtgcagcgccgcgacgacgacccggacgcctacacggtcacctacatcggcgcgcacacctgccgggacccggccaccgcagccgacgacgagctccacgcggggtcccgcctcatcagcttcgcggcggccaacgccaccacggccagcaccaccaccaccaccggaaacgccagcaaccggcaggccggacacaagggcgccgtgctgcctgcggagcccccgaggcagctggagggcggcggcggcggcggcgagcgggagcaggagctggagctggaggaggtgcttagcagcctcaccccggcggggagctccgctgccacggccgaggcggtgcggaccgccacgcccggcccggaccagggcgacgtgacgtctggcctccagctgcagcagcagcagcagcactggttcggcggcggcggcctctcgggcgtggcgcacttggggtacgacgacacgttcgatctggaagacattgtgttcggctccatcaccggcggcatgtatgctgctgagtactgacggccggacgacgactggtcgacctgctgtgtgttggaggagagtaggagacggtaggtagggtggagtggagccagggcatgttgatggatcgagctgtgaataatggcctagtttagtttgtatttaatatacgatatatctactctgtaagatta

SEQ ID NO: 79 - DNA, 1498 bp, Zea mays
cccccttccacccgcgttcgcttcttccccagcatccagcaaggaaggaggaagaagaagagggaggagaggggacggtccgcgaatcctgcctagccttcgccgccttcctccgctcgagcggctcgccgaggaaatagcgaaagggcgctatgagttcagcgaatggtacaaccaatgtccatgggaaagaagcagcaccgtatgaggagcagctgttcaagattggtaaagttagaactgacctaggacaactatctggaaaatcagctctatattgctcagatgcttcaattgcaaggtacctgatagcaaggaactgggacataaggaaggctactaaaatgctgaagaaaaccttaaaatggcgttcagaatataagccagatgaaatccgttgggatgacatatctgatgaagcggtaactggaaaaacttaccgaactgattactttgacaagatcgggcggagtatccttgtcatgagacctggatgccagaataccaagaatgccaatgggcaagtcaagtacttggtgtactgtatggagaatgcaattctaaatctgccacatggtcaggatcagatggtttggctcattgattttgctggtttcaatttaggcaacttgtcaattcaggtgacaaagatgacggcagatgtcctacaaggccattatcctgaaaggttgggtgtggcaattctttttaacgctccaaagttttttgagcctttctggaagatggcaagcccccttcttgagaagaagaccagaaacaaggtcaaatttgtatactcagatagacctgacaccatgaagatcatggaagaccttttcaacatggatgagttagaatgtgcgtttggtggcaagaacccagctactttcaatataaatgattatgctgcgaggatgagagaagatgacaagaagatgccatcattttggagccctgagaattcagctcttgcttctgagccatatcagatgagcagccaaaaagccctaggaagcgtttcaggtgcgaagactgaagatgctggatctggaaagatggacgacatggagactgctcctgaaaagagtgaagaatcgggtactgaatctggagaggaggtacaaacacggactgaatcaagcacagttgagcagaaaaacttgcctggagaagataatgccccagcagataaaagtggcctttaatctgatctccgggtatcaccatgaaacataaatgtgaaacattgataggagctctaccacatttcactaaggtttgaacatgaaaggcgacgagaaactcttttaacacggcaaatcggcatgcctgacttgttttgtagtcggcacctatttctctgtcctcaagatcttatttggggaaccttttcatgacagaatgagatctaccagatggtaaagaactaataccatactgttaccctcagttttcatgacagaatatggtctggtgttcagtttctgatatgcccttg

SEQ ID NO: 80 - DNA, 2384 bp, Zea mays
cacccgtccgagccaaatacccccgcaccgatcgcgcgcacctgcttcccacccaaactcgccgtccgcctccgccaccacccccgcccgcgcccatagcaagctcgccttccacgcgcgcggccgcgccagcgcaccacgcctcgcttcgttttcccgttgcttgacgctgaatccattccaccaccacccaggcacggccaggccagcgccagcgcgtcgtccccggcccccgctccgcctctccggtcgcgcccgcctcggggcgaccaccaccaaaatagaaacttccgtgtgtaggtgacccccggctttacccccgcccgaccgcccccaccccaccccgcccacgcctccctccctcccgccgggacaaaaccgccgctcctcctcctccgcccctccccgctctttctgtgaggcgggaagcgaggcggatgccgaggcgacggggctcgcgcaccgcacgcgtgtgcccgccgcccgggggccaggcgaggtggtgaggtgaggccgagcgcggttttaaattgttcacccggccgcccttctcgccgtagttttcagtggtacaagcaagggaggaacgaacgtgagggctgcctgcctgcctgcggacatgggctccagcctcaagtaccgatctggcctgtgcctcatcgtcgccgtcgtgctgatctgggtcatctctgccgaggtcacgcaggggatattcacaaagtacagacatccatttgcagttacttacttgggggcctcccttatggtcatatacctccctttgtcatttctaaaagattttatatacaattcgttgagaaggcattctagaaacactagtgcttccaaaattgcaagcaaatcttcctttggtggtagtgcccctttgaagaatggtgaatttcagaagatgttggaaatggaatcacagaaaactatagtggtaaattgccctgatgtgagcatccctgtagtggaagagacaaaaccactcatatgcggaatcactgaaatggatgatggccttttcaaggacaagcaactttccactaaggagattgcaacgtatggattgtatctttgccccttatggtttgtgacagagtatttatcgaatgcagcgcttgcaagaactagtgttgccagtaccacagtgctgtcttcaacttcaggactcttcactcttttcattggtgttttacttggccaagactccataaatgctgcgaaaattattgctgttttcattagcatggctggcgttgtaatgacaactgtgggccagacttgggcatctgatgaatcagaagcaggcaaatctggttttacacagaggactcttctaggtgatatgtttggtcttatgtcagcaatcgcctatggtctatttactgtgctgcttaaaaaattttgtggagaggaaggagaaaaggttgatgtccaaaaactgtttggttatcttgggctttttacccttgttgctctatggtggattgtctggccattaaccgcactaggcgttgagccaaagttttcaatgccccactcagctaaagtggatgaagtggtggtggcaaatagcctaatcggaagtgtattatcagactacttctgggctctttctgttgtttggactactcccttggtggccactctaggcatgtctctcacaattccaatagcaatggttgctgatatgatcattcacggccgtcactattcagcagtatatattcttggttctgtccaggtattttcaggctttgttatcgcgaaccttgcagatcgcttttctcgttctctagggctatcatagtctcataaaacagaacaggcccttattagagcgtgcatcaggaagctccaaggtcgggttggttaggccaatacttcagaaaacctggatcgggagataccaggaattattttccctttgcttctttaaacatagtggaggtgaattttgccgtggtgaatagtgaaaggcagcagatgaagaagaaaacatatgttatagcaaccctttgcaactgtaaattctcttactacaaattgcgcgacagtgtagactgcggccgttctcggcccatgtcaacaggcttgctcgatttcaaatttgcaatgtccttttatccgtgttcatggcaattgcaccaagttctaccgaaaagaaaactagcaaaaaagaaggaactacaatcggaatatataagcattaggtttcaaaactaaataataaatagtcatttgtagtcaaaattttataagtttgactgaaaccttgtccaaaatggcaactaatagtgcacaatctatttttttagaactggccaactgggttatactttttgaaatttcaattttttaaaatataaaaaggaaat

SEQ ID NO: 81 - DNA, 1728 bp, Zea mays
aaatattaggtcggggctcgggcggggccgccggcctcgccctcgtcgccgagtcaccactcaccacacaccaaacaaagcaggggccaggggagcccacttcgaggccgcggcgttggctgtctcggtgtcatcgtctcctctcgtctcgttctcttctcctcacctccttcgtttcgcggagcagagcgagcagccggcaccggacctccagggagcgcaccgcggaggccagcgaagatgcccgggctcacggcaccgtccgactacgcggaggagccgccgcgtcacccggccctcaagatcaactccaaggagccattcaatgctgagcctcaccgatcagagctagtcgcatcttacatcaccccagtggatttcttctacaagaggaatcatggacccatccctaaagtcgaggacctctcaagatacactgtttccatttctggtctcgtcaacaagtccattcagctatcgatggctgacatttggtctcttccaaagtacaatgtcacagcaactttacagtgtgcaggaaacaggaggactgcgatgagtaacgtacggaaagtgagaggtgttgggtgggacatatctgctcttggaactgcaacttggggaggtgccaaactatctgatgtccttgagctagttggaataccaaaactcagttcagtcacgtctctaggagggaaacacgttgagtttgttagcgttgacaagtgtaaagaggaaaaaggtggtccttatacggcatctattccattaaatcaggcaacaaatcctgatgccgatgtattacttgcatatgaaatgaatggagaggtactcaaccgagaccacggatacccgctccgggttgttgtacctggagttattggtgcacgctctgtaaaatggctggacagtatcaacgtaaaagaggaggaatgccaggggttttttatgcaaaaagattacaaaatgtttccgccaaccgtggactgggacaacattaactggtcaactagaaggccacagatggatttccctgtgcagtctgctatctgtacactggaagatgtagatgttatcaaggaaggacaggctaggattgctggatatgcactttcaggtggtggccgtggcattgagagagtggatgtatcagctgatgggggtaagacctgggtcgaggctcgtagataccagaaagacaatgtggcgtatgtgtcagatggacctcaaagtgataagtgggcttgggttctctttgaggccacattagacgtaccagcgaatcctgagatcgtagttaaggcggtggactcagctgcaaacgttcagcccgagaaggtagaagacatatggaatctgaggggaatcctcaacacgtcttggcatcggatcaaaatccagagatcttcgtgcgttgaaagatctaagctgtgaaattaagtacgcagctgaccacttggagaaagcacactcactttaccattgtccctgaataataattagtcacttcaactttatgcgtctgtggagtaaggttgtacgagtgttgtggctgtgtcattatgggatttgagctcacttggtttctgtgtaaatgtcagctgctgcggtttttttttggttggtcaggtttgatatcgagaaatatccattgcattctgcgtttgaaaatactatcgcagcatagaactgttctttgggcaaatggcagctctgggaagaggtgcg

SEQ ID NO: 82 - DNA, 3368 bp, Zea mays
gttttattatttttttgaatttagggctctaatgtgaatttcgggccaaaaactgaattttgggccaaaaactgaatttcgggccctaatgtgaatttcgggccaaaaattgaatttcgggcttttataatttcgggccgcccgaaataagcccggcacgtttaagcaattacgggccgggccgtgggccgagggcgaggcccatgggccggcccggcacggcccgaaattcaaacaatacgggccttttcgggcttgggccggaccgggccgggcggcccgaatgtacacctataggcttgggcgccaaccaaccaaccaagtcgccgccctccttcactgcgagctgcagaggcctaccgttccttcttctacctgctctgctctgcttcggctttcggcttctcgcttcatcacccatcaatccaccgctcttctcccatctcttggctcttgcttgcgcactcgtccaaacggtaaaacagcaagcgctaactgatccaaaacatcaaaagcgccgcgcaggcagaagcagcagcaggtaaagaaccggaagccaaccaggagcgcattcccactcatcaaccagcagagctcagatataagctcaccagcactaccccttcccatcctctcccactccctcctccctccccctcgtccagtccacacccattgggcgagaagccgagaaggacagggagggagcggaagctagccaggccgtcccgtccagagccgctatgtccggcggcgcgcccctcctggccctgctgctgctggcggcggcggccatgatcgccccgtcgccggccaatgccgccgtgtcgtacgaccacagggccgtggtcatcaacgggcagcgccgcatcctcatctcggggtccatccactacccgcgcagcacgccggagatgtggccgggcctgctgcagaaggccaaggacggcgggctggacgtggtccagacgtacgtgttctggaacgggcacgagccggtgcgtgggcagtactacttcggcgaccgctacgacctcgtccgcttcgtcaagctcgccaagcaggccggcctctacgtccacctccgcatcgggccctacgtctgcgccgagtggaacttcggcggcttccccgtgtggctcaagtacgtccccggcatcagcttccgcaccgacaacggccccttcaaggcggcgatgcaggcgttcgtggagaagatcgtgtccatgatgaagtcggaggggctcttcgagtggcagggcgggcccatcatcctggcgcaggtggagaacgagtacgggcccatggagtccgtcatgggcgccggcgccaagccctacgccaactgggcagccaagatggccgtcgccaccggcgccggcgtgccctgggtcatgtgcaagcaggacgacgccccggaccccgtgatcaacacctgcaacggcttctactgcgactacttcagccccaactccaacagcaagccgaccatgtggaccgaggcctggaccggctggttcacggcgttcggtggcgcggtgccgcaccggccggtggaggacatggccttcgccgtggcgcgcttcatccagaagggcggctccttcgtcaattactacatgtaccatggaggcaccaacttcgaccgcacctccggtgggccgttcatcgccaccagctacgactacgacgcgccgatcgacgaatacggtctgctgaggcagccgaaatgggggcacctgagggacctgcacaaggccatcaagcaagccgagccggcgctggtctcaggcgacccgactatccagtccctcgggaactacgagaaggcgtacgtgttcaagtcgagcggcggcgcctgcgcggcgttcctgtccaactaccacaccagcgccgcggcgcgggtggtgttcaacgggcggcgctacgacctcccggcctggtccatcagcgtgctgcccgactgcaaggccgccgtgttcaacacggcgacggtgagcgagccgtcggcgccggcgcggatgagccccgcgggcggcttctcgtggcagtcgtacagcgaggccaccaactcgctggacggccgcgccttcaccaaggacgggctggtggagcagctcagcatgacgtgggacaagtcggactacctgtggtacaccacctacgtgaacatcaactcgaacgagcagttcttgaagtccgggcagtggccgcagctgaccatctactctgccggccactccctgcaggtgttcgtcaacggccagtcctacggcgccgtgtatggcggctacgacagccccaagctgacatacagcggctacgtgaagatgtggcaggggagcaacaagatctccatcctcagcgcagcagtcggcctccctaaccagggcacccactacgagacgtggaacgtcggagtgctcggtccggtcacgctgtccggcctcaacgaggggaagcgggacctcagcgaccagaagtggacctaccagatcggcctccacggcgagtcgctgggcgtgcagtccgtcgccggtagctcgtccgtcgagtggggcagcgcggcagggaagcaacccttgacatggcacaaggcctacttcagcgcgccgtccggcgacgcgccggtggccctggacatgggcagcatgggcaagggccaggcgtgggtgaacggccgccacatcgggcggtactggtcgtacaaggcctcctccagcggctgcggcggctgcagctacgcggggacgtacagcgagaccaagtgccagaccggctgcggcgacgtctcccagaggtactaccacgtcccgcgctcctggctcaaccccagcggcaacctgctggtgatgctcgaggagttcggcggcgacctgtccggcgtgaagctggtgaccaggacggcgtgaccaggaatggagaggggagggcatgccgcacgcacacaggatgtgaataatttgctgggaagagaagcgagctgagggcagggcgcgcgcgcgcgcagacacgacacgacacgacaccgattctttcttcctcgtgaagtatctatagatacggcgtacatacggacacaatttgtgcccactatacgtacgtacaaaaaagattagtactagagtttaccgtagatctgttcttggagttggccgacgccggcacggctgcaggaactgcggctcacggccggctggtaatggtactagtagcgtggtttttgctctgcactccgcatgaatctcaaggcgcacgcaggcttaattttcttagcacaaatttgcgaaactgagttgtaaatgaggttatttattcctacgattaagtatgatacaagacgaataattattatgtgagttcttttt

SEQ ID NO: 83 - DNA, 2315 bp, Zea mays
aagatatataattattattcgcagcaaagaggggcacaagcaagagaaggattaggacacaaacgctagagagagagagagagaggtggtggccggtgggacgtccgtggtggtggtggagttagatcggctgtgcttgttcctcgctcctcgctggttcagaggaggtcatgatcaactaatgcctattcatttattatggacttgcaccagttgttaaagtacagattaactggtgctaacgtctactacgaatttcctacagagaacaacttagcaaacactccttggccagctagtccactgaagtctgagttcagcagctcatcatacactcctctttcatcccagcttgagtgtgataatttgtctgcactcagcaatactccagataaccagagctccacagaaaccatttcagcacaatcaatatcaccactggaagtagacagctcatacaaacaggcagctatccttcgggagaacacccaagtgagacctgatccattgtacacaacatcaaggcataatatgcaacacgctttacgagaaatagagactgttctgatggcacctgatgctgatgatgcagctactagcaccaagcatgaatttgaggaacataaacctgctcagctgatgaggcagcggtcaaggacatggagtcatgaatctaggcagccatcaccaggagttgtacggacacaacttgcatctggataccccacagcaagctatgagttccgcccagagaaacggctaagggagttaagggaggatccgcagagcatggtgaagcagctattaaccaagtgtgctgaagcattaagtgaggagaggatagaggagttccttaaccttgttcagcaagctcgtggagttgtatcaattactggggagccaatccagcggttaggtgcttacctccttgagggtttggttgctagacatgcaaactcaggtacaaacatatatcgtgccctgaagtgccgtgagccagagagtaatgaactcttgtcttacatgaagattttgtataacatctgtccgtacttgaagtttggctatatggctgccaatggggcaattgcagaggcattaagaaatgaggacaggatccatattattgatttccagattgcccaagggacacagtggataacactgatacaagcgctagctgcaaggcctgggggtccaccacacgtgcggatcactggaatagatgacccagtgtcagagtatgcccgtggtgaaggtctggaccttgtagggaagatgttgaaaagcatgtctgaggaattcaggatacctttggagtttacccctctgcccggtatttatgcaactcaagttacaaaagaaatgctggacattaggtcaggcgaagcacttgctgtcaacttcactctgcagctgcaccacaccccggatgagagcgtggacgtgaacaacccacgggacgggctactccggatggtgaaaggcctgtctccgaaggtgaccacgcttgtggagcaggagtcgcacaccaacacgaccccgttcttgatgcggttcaccgagaccttggactactattcggccatgttcgagtcaatcgacacgaacctgccacgggacaacaaggagcggatcaacgtggagcagcactgtcttgccaaggacatcgtgaacatcatcgcctgcgaggggaaggaccgggtggagcgtcacgagctcctgggcaaatggcggtcgaggctgaccatggccgggttcagaccatacccgctgagctcgtacgtgaactcggtgatcaggaagctccttgcctgctactcggacaagtacaccctggaagagaaggatggcgcgatgctgctcggctggaagaacaggaagttgatatctgcttctgcttggcactgacagtaacgttttcagaagaccggaagtacacgtcaactcttacatatatatatgtatgtatgcataatgaattacctggtctgctttccgcaaaaaaggacgccctttgttgtacatgtacatgatgctgtacccttagttttcctgaagtgcagaccagagaagagaacattgacattagattgtagctgctaagctgtatggtaattacagttttcttttgctctcatgtattcacccctgtcatggacttctccaagcgtattcttagctaatcagcatgcatacatgctgagatgcttcttagtctttctttcatgctcttgagcgtgcaatgatgtcaacaagttaacatgccctgatgcccctccgagggaagatggatctcaagtcttccatctgcg

SEQ ID NO: 84 - DNA, 668 bp, Zea mays
agtaatttcttcatctggtggtcttcttgttcaatccccatctcgatcggggaggccaccaaccaccatatggcgggagggaaggtttactcgttcgaggaggtgaggaagcacagcgaccgcaaggactgctggctcatcatcgccggcaaggtgtacgacgtcacgccgttcatggaggagcaccccggcggcgacgaggtcctgctggcgtccgtcggcaaggacgccaccgcggacttcgaggacatcggccacagcgcctccgccaaggagctcatgccccagtactgcatcggcaaggtcgacgcggctaccttcccggccaagcccgcctacgtcgtcaccaaggacgacgccaggtcgtccgagaaggccgcgacgagcgccggcgcttgggccacgctcctgcagctcgccgcgcccgtcctgctgctggcgctggccttcgcgctgcagcagaactatgccagggccaaggcggagtagacaagatacagatagataccatcgttgattccgctgagtcgcggccgtgcggcctctttggaagcatctgaattacattttcttcctggcaaaattaactactcgtggtttcgttactttcgtaataatggttacattttcttcctggcaaagttctttttgtcaaccgtttgggtgca

SEQ ID NO: 85 - DNA, 1322 bp, Zea mays
agtcttccaaaacgaagcaaaagcaaccgtcgagcttgcaacgccttacgcctccacactcaacagtcatggtcgtcatgggcaaggagcagcaacacgaggaggaggaggtgcaagggaaggtcgtccaagaagaagtgcaagtcgtccaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcatcccgcgcagcagcgtggacgtggagcggctgggcccggagctgcaggagatgcgcggcgggctgatccgcctctgcgccgacgcggaggcgctgctggaggcgcactactccgacctgctggcctccttcgacaacccgctggagcacctgtcgctcttcccctacatcaacaactacatcctgctgagccagctggagcacgggctgctggcgcggcacgtgccgggcccagcgccggcgcgcgtggccttcgtcgggtccggcccgctcccgctgagctccctggtgctcgcggcgcgccaccttccgggcgcctccttcgacaactacgacatctgcggggaggccaacgaccgggcgcggcgcctggtgcgcggcgacggcgcgctccaggcgcgcatggcgttccgcacctcggacgtggcggacgtgacccgggagctggcgtcgtacgacgccgtgttcctggcggcgctggtgggcatggcggccgaggagaaggcccgcgtggtggcgcacctcgggaggcacatggcccccggcgccgcgctggtggtgcggagcgcgcacggcgcgcgcgggttcctgtaccccgtggtggaccccgaggagatccggcgcggcggattcgacgtgctcgccgtgcaccacccggagggggaggtgatcaactccgtgatcatcgcgcgcaagcccgttgccgtcgacgcgcacgccaccggcggggtggggcacgcgcacgcgcacgcgcacggcgccgtgctcaaccggccctgcctctgctgcgagatggaggcccgggcgcaccagaagatggaggaggtggccgtcgagcagctgccgtcctaggcaggcgcacaccggcgtcctcgctttcttgtccgtccggccgcccatttgattttcggagttgcatctatctcatctaatatggatccatccatccatccatctatagcagtattatgtatgcatccacatggtaataatctggctgaccgcatccgcata

SEQ ID NO: 86 - DNA, 2226 bp, Zea mays
cggccacgggcagcgcccggtccacggcgcccgcctggctgacgcgcggggcccagggtcccccagctggcgcgcgcggcaggtggcgcgccgggcgcacgcgggcggttgatgcgggaaggaagaggacgaggacgaggacgacggacggaccggggccccccgccgggccagccagccccagccagcctcctctcggttccggtgatccggtctcccactttccgcggctcccctccccacctcgtgctccctcctcccctttctttcgccccgcgggccgattcctactcatcagccgcggcgggagaagacaagcgcctttctccccggaattccgcgcccaccaccaccaccaccacctcctccctcccctgtgcatttggcagcgcagatcccgccgctcccgtccagccatcctcttctcccttgctctactaggccttgactgttctcgactccccagtcaccaactcggtttcctcttccacgccgcgttccgttcggccgcttgatccaacacgccagcagctgctgccgcgtaaaacaccgggaaatacctgccttcctttctggtgtaagcaagtttcaactcccgaagtttgctgctttgggtaaatcttttctgacctttcaggtctcagcatcaccaggccccttttactaccaatctttctgtccgatcactgcaattttaagcttcagtcccctttttcggaaaatccagtctctgacaaagctgttcggcggctcatgcaccagtagcttcagctaagatctccccatgccacagactcctcctcctccaggaccgtcagccatggtatagagctatagcgctgctccggccggcctgcctgcctaagctgcggaattcgggccccctccccggcttcccgcgccatggacggcctccccgacgccgacacggcgccggttgcggccgcgccggcgcagaagcgcgacgagtggagcgagagcggcatcctgcgcctgctcgaggcctacgaggccaagtggctgctgcggaaccgcgccaagctcaagtggagcgattgggtcgacatcgcccgcgaggtgtccgtgcattgcgccgacgacgccgcagccgcggggaagccccccggccatggcggcggcagcagcgccaagacccccaaccagtgcaagaacaagatcgagtccatgaagaagcggtaccgggcggaggccgcggcggcggcgcgcgcgggccccgccgccgccggcccgacctggaggttctttgcccgcatggacgggctgctcaaagggccgcccgtctgctctgcccaggtgcagcagcccgagctgactagcagcatagacttgcgagctccggcgaaaccagaggccgaggtagaactagccgattttgccacgcagttgcgggaggcagttccagttccaggtgcattctctgatctgatgaacatcgacacgaatggcgctgtcccggataaagcggagaaggttgacaacagcatgcagaaggagagcaggcctgctgatagcgatgccaacgtgagctccccaaggagtaaggtggccgacgaggacgtggaggaggtggacaaggcctgggaccggcccagcaagagaaagagcacagaattcgatatagccaagagcatcgagctgctggctagctcgttcttgaagattgagcacgccaggatggagatgtacagggagacagaaaggatgagggttgaagctgagattaagaagggggagatggagctcaagagaactgagatcatggcgaaaacgcaccttcagatcgctaggctttttgcaaagaaattgaaacagagcagtggaaagaatggtgtcagttcgtcagtaacagctgaagtggacacccttaccaagaaaggcgagaatggttccgggtgatgtggcatgcccggcagttgattctatcctcagcgtacatggcacctcacttttcctgtgcagcaagtgtaccgagtctgattgagaaatagtcagctgtaaacttacagatgcaataatgggagcgaagatttgactgtttggcccattgcgggattatagaagcgatttttgaatcagtgacttcctaagtctgaaagtttctgccctctgttcgtgtagtaatttactgacaagtgacaaccaccatttgtataagcacatgcccatgctgtgaagaaatgaagcagcaatcaccaatgctgtggt

SEQ ID NO: 87 - DNA, 1923 bp, Zea mays
gactgcatccatcccgttcctaccgcggccggtgtaggtagccacgcccgccacgcccgtccgcggccacgaccagttcgagaaaggcgtgcgcatgccgtctatggcgcctccgctataaggaggagaagcaagcgcgcaaggccagcaaaaagcgtcgcggagccacgaccacgacccctattttggcacgcccgtcccccgcttatacgccgcgccggcgaggtcgctgctccgaatcaccttcccttcctattccctctctctctctctctctctctctctctctctctctctctctctctctctcccgcccgctccgcggcctcctcctctacccgccccacaaaccaaggccctccgctgtctgcacggcgacggcggtgcatgggcggcgggcgcgccgggacgacgacgacgacgaccgcgccgccatgaccaccaccaccacggccgcggccgcggtcgcgcagctctgcgccgggccacggcggcgcaagcaggcagcaggggctcggctcgacctgcgctgggcgcgcctgctccgcctcgccgtcgtcaccagggtgctccgcctcgcgcgcgaccagctgctcgcctgctcctcctgcgggggcggcaccgccgcccgccgccggtaccgccgcctcggcccgcccaccagcgccagcgccggtcccgtgctgtcacccgtcgacagggacgacgactgcgccgcggacgccgaggccgcggcccctcgcgacgcggccgacgacgaagacaacgttgtcagcctcaaggtcagcctgctcggcgactgccagattggcaagaccagcttcatggttaagtatgtgggagatgacggggaggagcagaacggcttgcagatgacgggcctgaatctcatggacaagacgatgcccgtcaggggagcaaggattgcctacagcatctgggatgtggcaggagaccaccagtccgtcgaccacgtcccaatcgcgtgcaaggacgccgtggcgatcctgtacatgttcgatctcacgagccgctgcacgcttaataacattgtagattggtacgggagggcgaggaaatggaataagacggctattccaatcctaatcgggacaaagtttgatgactttgctcagcttcctcttgagatgcaatgggccatcgttaaccaggccagagcatacgcaagagcgatgaaggcgaccctcttcttctcgagcgcgacgcacaacatcaacgtgaacaagatcttcaagttcatcacggccaagctcttcaacctcccgtggacggtggagcgcaacctcaccatcggcgagcccatcatagacttctgacgaccccttcctctaactagtaactcggcagcacacgcacgacgacccttggtatatatcatgggttgacagggtcgtgtctttcgatcctcttgccctgtgcgagccgccggagccatgaagtgaccgagcatgcccgtcgtcctcttcctcctggtggccggctgcagcaggcaagatgccctttgtaaatatagccataggtgacggtcccgcgtgcgtgcggccgtgcgggagcgtcgtcaaatgggaagaaaaccgcgaggtgtgactgtgatgtaacaccccgtctgtaacattcgccagagtatataggaaatccatgttaatataccctccattccaactgacaaaggcatgcgctggcgcgtggcggcttgctgccggtgcagaacctcttctttctcctcacccgggcctatttggttcagcttttttctgaccagtttttctgagaatctagctgtggaaagaatctggctgtgagagaatctgagtattgtgtggattacgtgcggaggaagatgaagtggtccaaagggttcaggatctagaaagcaataaattcctactatcatgacgattc

SEQ ID NO: 88 - DNA, 1276 bp, Zea mays
ctacaaatatatggctgcagctgaggtccgacaccacacaaacagcacatctgtttagccaagctgtggccaacctctgcgaggaatggagatggagtcgactcctctcttgacaccatacaagatgggcgatttcaacctggcacacagggttgtgctggcgccgctgacgaggtgccgggcgttcgggaacgtgccgcagccggagcacatggctctctactaccgccagcgggcgacgcccggcggcttcctcatcgccgaggcctgcgccgtgtcggagagcgcgcgcgggtacccggacgttccggggctgtggacccaccaacaggtcgaggcctggaagccgatcgtcgacgccgtccacgccagcggtgccgtcttcttcgcccagctctggcacaccggccgggcctccccctcagaattccaaccaaatgggcaggcaccgatctctagcacggacaagcaaatcccagcacaggtgaaccattccggtgacgtcaacacgttcgcggtgcctcggagactagagacagaggagataccacacgtcgtcaatgacttccgggttgccgccagaaacgccatcaaagcaggctttgatggagtggagatccacgcggcaaacgggtacctgttcgatcagttcatgaaggacagcaccaatgaccgagacgactcctacgggggcagcttggagaaccggtgccgtttcacagccgaggtgatggcagccgtcgcggacgaggtcggtgccaaccgcctcggtgtgcgcctctctccgttcgcggattatatggactgccacgactccaacccagaggcgctcgcgcttcatgtcatcgacgagacgctgaacccgctcggcgtgctttactgccacatggtagagccaaggatgcgggtgaacccagacgacggtattatgactctcgagcacatgctgctaccgttcaggagggcgtttcgcgggacgttcattgctaatggaggctacgaccgtgaggaaggcaatgacgccattgcccgtggccgtggctatgcagatctcatcgcatacggccggatattccttgccaacccggaccttccgatgcgttttgccaagaatgccccgctgaacaagtatgataggagcaccttctatacctctgatccggtggttgggtacacagattatccatttctcgatcaactctaggatgattggcttataaacaatttccccacctggagtactatcttgaccttaaaataaaatgagtgtcactat

SEQ ID NO: 89 - DNA, 1117 bp, Zea mays
cttctcaactaaaatgtagttgaagacatctgcccaaatttcttccaaatatccctgtatataagggagacacgagtaggtgtctgattacaaaagccattccttcaatcactcaaatccactgtgactccgtgagctctccctgcctgctgccctgcacactccccgcccagccgcaccagctcagctcagcagtcatggctcgcccctgccgcagcagcagcagcgccgctgcccgcctcctcctgctgctcgccgccgtcgcagcggcgctccaggcagcggccgccacgccgccggtggccagcggcttcatccgcaaatcctgccgcgcgacgcagtacccgtcggtgtgcgagcagagcctcgcggcgtacggaggctccccgccgccgcggagcccgcgggagctggcgcgcgccgcgctggcggtgagcgcggaccgcgctcgggcagcgtccgcgtacgtcggccgcctgtgcggctcccggtccggatccggcgacggcagcccccgccgcggcgccggcgcgaagaaggggtcggcggccgcgggtcccgtgcgcgactgtctggagaatctagcggacagcgtgggccacctccgcgacgcggcgcaggagataggcggcgccgggatggcccgcgccgggacgcgcgcgttcaggtggcacctgagcaacgtgcagacctggtgcagcgccgcgctcacggacgagaacacctgcctggacgggctctcgtcccgcgccgtggacgccgccacgcgcgccgccgtccgcggcagggtcgtcgaggtcgcgcaggtcaccagcaacgcgctcgcactcgtcaacaaggtcgggcctgggtactagtagcccagggcggcctgggtgctactactactactgcctcctccacgacgttggttgtttcagcctcggcggttaactagttctgttattatcaatgtgtgtgtgtttctttgcatataagtatatgctttgtatctgttgtgtgaggtaatttatatatagttaaggccttaagggtaatttgtatattgtattatgggtggcgagaggtacacgaagacggataatccttcttatgaattgtcaccatgttcactgta

SEQ ID NO: 90 - DNA, 2271 bp, Zea mays
ctgttgctttcgtcgccatctcgctccggtccccgccgctgctccaagtgggagccaagtcatctctctggccgaagatccaggttgagtcggcgtcgccggcagaggcaagagactccggcgcgatgtcgttggactcggaggcttcctcgcagggtgggggctaccgtagcttccgccagatcacgcgagatcgtttattatttgaaatgctcagatcaactaggaagaattcgaaatcaacatggaaggttcttatcatggataagtttacagtcaagattatgtcatatgcatgtaagatggcagatattacagaagaaggtgtttcattggtcgaagatttatataaacggaggcaaccattgccttcactggatgccatatatttcatccaaccaactaaagagaacattgtcatgttcctatccgacatgtcaggaagaagccctttgtacaagaaggcatatgtgtttttcagttctcccgtacataacgaattagttgctcaaataaaaaaggattcaagtgtactacctcgtattgccgcacttagtgagatgaatttggagtactttgctattgattcccagggtttcataactgaccatgagagggcattggaagaactttttagtgaaaatgcagaaggatctcacaagtataatgcttgtctgaacacaatggctactcgtatatccacagtatttgcatcaatgagggaattccctcgtgtacactaccgtattgccaagacgattgatgcttctacaatgacaacactacgagacttagtccccacaaagcttgctgccagtgtatggaattgtcttgcgaaatataaaacgacaatacctgaatttcctcaaacagaaacttgtgagctacttatagtagaccgttcaatagatcagattgcaccaattattcatgaatggacttatgatgctatgtgtcatgatctgctttgtatggatggcaacaagtatgttcatgaggttccaactaaaaatgggtcggcaactgaaaaaaaggaggtcctgttggagggtcatgaccctgtctggcttgagcttaggcatgcacatatagcagatgcaagtgagaggctacatgataagatgaccaacttcatttcaaagaacaaagctgcacaattgcatcaagcacgaaccgatggagaattatcgacaagagatttacaaaaaatggttcaggctcttccacagtacagtgatcaaattgataagctttccctgcatgttgagattgcaggaaaactcaataacataataagggaacaatgtcttcgggatgttggacagctagagcaagatcttgtgtttggtgatgctggaaccaaagaactaatcaactttttgagaacacaattggttgtaagtcgtgaaaataaattacgcttgctgatgatttatgcagcacttaacccagagaagtttgaaagcgacaagggtgcaaaattaatgcagttggcaggattatctgctgatgacatgattgctgtaaataatatgcgttgcttatgtgggcctgataccaaaaagtcttcagtagggggttttacactgaaatttgatgttcacaagaagaaacacacaaatcgaaaagagcgaacaggggaagaatcaacatgggcactctctcgattttaccctattttggagcaattgattgaaaatcttagcaaaggtgagctgccaaaagatgaatataactgtatgaatgaccctagtcctactgttcatggactgccaaccagtagctctgcccgaacaagccccgctcactcaatgcgatccagacgaacaggtggcacatgggcaagacctcgtggctctgatgatggatattcaagtgattctgtgttgaagcatgcctccagtgacttcaggaaacttggtcagcgtatatttgtttttgtaataggcggtgctactcgatcagagttacgtgctgcacacaagctttcatccaagctgaagcgagacatcatccttggttcatctagccttgatgatcctccccagttcatcacaaaattaaagttgatgtcagtagaagaattgacacttgatgaccttcagctgtaaatggtgtccgcccacacggagtgtaaccttttattttctctgttctgtcagctcttatttgtgggggcctgtcatattcattcggtgaaatgcattcttaataccacttttactggtgaatgtaagaaaaaaactgttatgcaattaatcttttcatgca

SEQ ID NO: 91 - DNA, 956 bp, Zea mays
gaaccttcgtcttttccgcttcctccctcccccactactccactagtcggattgctccgattccacgcgggcacgcacgtggtgcccacgcacgccgcgcgctggggggccgccgtgtcgccctcctctccccgctacttgatgttactgatatatacgcacgcgacgcggccaccactttccccacccatccaccgagctgccctgctacacggtcccctgccaagatccatcttcccggttacgccgcctgatcgaagtgaacaagcaaggaagagccatggcgagcgagcacgcggcggggggcgaggctaagcatgaccagaagcagagcctgatggacaaggcgaaggggttcgtcgcggagaagatcgcgcacatccccaagcccgaggcgacgctggacggcgtgacgttcaagggcctgagccgggagtgcatcacgctgcacagcagcgtgaacgtgtccaacccctacgaccaccgcctccccatctgcgaggtgacctacacgctccggtgcgccggcaaggaggtggcgtccggcaccatgccggaccccggctggatcgccgccagcggctccaccgcgctggagatccccgccaaggtgccctacgacttcctcgtctccctcgtcagggacgtcggccgggactgggacatcgactacgagctccaggtcgggctcaccgtcgacctccccatcgtcggcaacttcaccatcccgctctccacctctggcgagttcaagctccccaccctcaaggacttgttctgatctagtagtagctcgcttgccttgtgttctgtgcgggcgcgcaccagcgatctgtacgacgagcttttgcaaataaacgacgcagctcctctgttctatatatctcagtgaatgcctaagctaaggggatggatggtttaatttgactgcaaataaagagctggatttcgttcag

SEQ ID NO: 92 - DNA, 2248 bp, Zea mays
ctcatagagtcaaaagtcattgcagacttgcaagcttccctcccctactatcaggcgaatcatatccatccacttactacgctgctaggctgctacgaacaaaatcctcctaattaagacgggcgtcgttggcttcaaatactggtctctcccctgtccaaaagtctctcgaatctccaccctggttctgcaccggttccagaattttctcccatttacagggtctccccgtttctgtccggcggttctgccgttccactgcttttgatttcggagtgtgaacttacatcttgctggataataaagattggattttaagcgatttgggggtgcttgcctgatctccccctgcgaggtactgccgggggattggatttcggggaagttttggtggtttgagattcggcttggccggagcaggaatgacgatcgacatgtccattcccgggagctccgggctgctgaacgctgcggggaagagggacatgaagttcttcagcaacccctacgtgcttgcgctcacgggcgctgcaggaatcggtggattcctctttggctacgatacaggtgtcatatctggagcccttctgtatatccgcgatgattttccagcggtcaaggacaattacttcttacaggaaacgattgttagcatggccttagtcggagctatgattggagctgctgggggtggttggatcaatgatgcatacggtcgcaagaagtctactcttcttgctgatttgatgtttgctcttggctcacttgtcatgtgtgctgctgctggtccttacattctaattatcggaaggctcctcgttggtttgggtgtgggtgttgcatcagtcacagcaccggtatacattgctgaagctgctccttcagaaatcaggggaggtttggtgtcaactaatgtactcatgattaccggtggccaattcttctcctatcttatcaatcttggctttactgaggtgcctggaacatggcgctggatgcttggtgttgctgctgttcctgccattatacagtttgtgctgatgctattcctgccagaatctccgcgttggctttactggaaggatgagaaggcaaaagctattgccgtccttgagaggatctatgaatccgaccgcttggaggaagaggtagagctgcttgctacatcctccatgcatgaattccagtccaacaataccggaagctatctggatgtcttcaagtcgaaagaattgaggctagctttctttgctggggctggccttcaggccttccagcaatttaccgggatcaacaccgtgatgtattacagccccacgatagtccagatggctggtttctcctccaacaggctggccttgctcctctccctgatcgtcgcggccatgaacgccgccggaaccatcgtcgggatctacctaatcgaccgttgcggccgccgccgtctggccctcacaagcttggccggggtcgtggtctccctggccatcctcgccacggccttcatactgcagtcatcatccggcctctgcatgagcgccgccagcggcacgtgccagggcgcgctaggctggttcgcggtggccggcctcgctctgtacatcgccttcttctccccgggcatggggcccgtgccgtgggccgtgaactcggagatctaccccgaggcgtaccgtgggacgtgcggcggcatgtcggccaccgtgaactgggtctctaacctcgtcgtggcacagacgttcctgtcgatcgtggggctggtcgggaccggcccgacgttcctgatcgtcgccgggatcgcggtgctggccttcgtcttcgtggccacgtacgtgccggagacgaagggcctgacttttgagcaggtggagcagatgtggagggagagagcgtgggggaacagcggcggcaactgcgagagccttttggcgggtactgctgctgcgccgtaggctacccgttgtcagcactggtcaagcgcgtcagttttagtatggccgcgctgggcttgatcggctccgtcctggcattagttggaagaaagtaaaaacagattggagatgcagatgcaaactgttgtatgtggtggtgcttatattgctatcctgttgcctgattgtacgtgttgtcgtcgtggcaaatgttcagtgggtgtaaaatatgaggtcataccgtaacgtcaaactaaggcaaaaggccagttgtatgacccagatgggtgattataattatttgtacagtttccggc

SEQ ID NO: 93 - DNA, 1253 bp, Zea mays
cgcggcgaactgcgcgccctggttctgggaagaaacatttcactgcgttttttccctggcgcggcccagatcaagatcttaacgaccctcacggcccagcgccaggccgccagcatccgacgcatctaaccccttccgatgcgtgtcccgatccaacggtctccgtcgtcccgtccgcgtgataaagcgccggcgcctcttctcgcgtggcctcccgaaggttctaggctcgattgaacaaattggagcggcactacactcctccacgcctccacctccagcctcccactgatctggcctctctcgaggtgagcgcgcctttaatcctagatcaatatgagaaggggctacagttacagtccttcaccaccaaggggctacaggagaagggcgcgcagtccaagtcctcatgatcattatggtggtcgtggtagggatctcccaaccagtcttctggtcaggaatctccgtcgggactgcaggccagaagacctccgtcgcccatttggacagtttggtcgagttaaagatatatatcttccaagagattattacactggggatccccgagggtttgggtttgtccagtattatgatcctgctgatgctgctgatgcgaagtactatatggatgggcaggtagttcttggtaggcaaataacagttgtttttgcagaagagaacagaaagaagcctcaagagatgagagctagggacagagtcaggggtcattcttatgatgacaggaggtattctcgctctaggtcgcctcgttattataggggccgctctccttcacgcagccaaagctactcgaggtctccacctcagaatccaagacacagacttagagagaggtcctactccggctcacctgtggacagcagatcaagaagtgggagcccttatgaggatggatatcgcaaatcatcacggagagagaggtctctttctgtcagcggatgaagcagttttacggtctagagctattgctgtgaatctgcgcatggtggcctacttgctatgtctttctgaaccatatatgttctgtctagattatcattcccagtaccagagaagtatcgtgagactgtttgctgtactttctagtcttgaggatacagaagggggtcaccgattctctcagtagatggactattgaccactagctacgccagttccactgctttgtgtatttacaggcagctttgcggtttgaataaaattgtttgcatcgtgaaagctaattggta

SEQ ID NO: 94 - DNA, 609 bp, Zea mays
atttaaaacattggtatatacagtgcggatagcgtgacagcgtcaacgccagccatggcggcggctcagtcctccaccgattcgttggctccgcacctccgccgccgtccgcgccgcctcgtattcgaccgccgctacggctggatctttgacgaatggacgcaccccgccgaccaagccctctccggcggccgcggaatgttctgtgcgctgacgatggcgcggtcgctggtgagcgctgcggcgtgctcgattaactatgctgtcagttcaatcagcagagttctggaacgccccaaaagactccacaagaagcagcaagcctggttccgtgaacttgaatgctcgggagttgtagctgatcttaagttaatacagacttgaagccattctgaactagaatgcaccacaactggttgcatgtgttccgtaaagaagcatgatcatctgtaagcacggtatcagaaaattatgagacacttatccttagcaaaaagctatttgtcctgtttctactctaatgtggcaatgatggcacatttattttactggggcactaaccatgaactcatggcagtactgaatgacaagggccattctatttttaaa

SEQ ID NO: 95 - DNA, 892 bp, Zea mays
ccgtcccatgccattgcccgccacaaacacaaccgaacgacgaagcgtccgatccaatagggccggctagcaagtgcatgcacacgcgtagcagctaataactgcccggtgcctgcctgtgacatatagagaggcagctgctaccgtacggtcgagagagatatagatcgatggaggcgaggaggagcagcgcggcgctcgtatcggtggccgccgccgccgccgccgtcgcgctgctgctggtgctcgccgccgagccgtcccgcgcggagcggttcgtcgtcggcgacgcggcgcggtggacgtgggggtacaactacacggactgggtcatcaggaaggggcccttcttccagaacgacacccttgtgttcatgtacgacccgccgaacgcgacggtgcacgcgcacagcgtgtacctgatgcgcaccgccgcggactaccagtcctgcaacctcaaggcggccaagctggtggccagcgtcacgcagggcgccggctccggcttcgagttcgtgctccggaagcgcaagcagcactacttcgtgtgcggcgagcgcggcggcatccactgcaccatgggccagatgaagttcgtcgtcaagcccaagagctctgcctgccgcgacgactgactgacacgccgccggacgccgatgtcggtgcgcgtacgtgtggcctcgatctcgtcctgtctttgttcgatctctgcatgccgccttctcagtcagatcattcctcctgtccaattgttgcgccctgcttgtaagttattattactatcagtcggtgtggatttactcagtgtgttgacgtatgattcgtgctgtctgatacaccagtgtttatggatgaaaaggttggttcaataaattagtgagtctttgtttct

SEQ ID NO: 96 - DNA, 2179 bp, Zea mays
cactcgatccacactctcaaccagctcattaaatacaagagcatgtgcagaaaacaagctcataatcgacacacacctaacagagtaacagacaccaaacaacgcccatcactcgcgccgtacatcctgcctcctcccgcgcgcgcgcgcgcgtgcacgctagctagctgccggtcgcctcgccaccatggtgttcgacgcgagcggcagcaggtcggcggcggcggcgtcggggaaccctctccgcgtgatcctgacgcgcgggttcgcgcggcaggtgctcgcggggcggtggttgacggtgttcgcgagcctgctcatcatggcgtcgtccggcgcgacgtacatcttcgggagctactccggcacgctcaagtcgtcgctcgggtacgaccagcgcacgctcaacaccgtgtccttcttcaaggacctcggcgccaacctgggcgtcttctcggggctcatcaacgaggtgaccccgccgtgggtggtgctggccatgggcgccgccatgaacctgtccgggtacctcatggtgtacctggccgtgtccgggcgcaccgcgccgccgccgctgtggctcgtgtgcctctacttcttcgtgggcgccaactcgcagtcgttcgccaacaccggcgcgctggtgacctgcgtcaagaacttccccgacagccgcggggtggtgctcggcatcctcaagggcttcgtcggcctcagcggcgccgtgtacacgcagctgtacctggccctgtacggcggcgacgacgccgagtcgctgatcctcctcgtcgcctggctccccgcggcggtgtccgtcgtgttcgtccacaccatccggtacatgccgtacccgcgccgccgtggcggcggcaggcaggagacgagctccgactccgaccccttcttctgcttcctctacctctccatcgcgctggcgtgcttcctcctcgtcatgatcgtggtgcagaagcaggtgcccttctcccgcgccgcgtacggcgtggccgccacgccgctgctcatcctcctcctcatgcccctcggcgtcgtcgtcaagcaggagtacaagatctaccgggagcgccagctcgacgcggccgacccgccgccgccgaccatcatctccgcgtcggcaacggacgccagcaagaaaacagagcagcagccggcgccggcgccgccgccgacgacgtcgtcgttctgtgggtgcgtgaggaccatgttccgtccgccggctcgtggggaggactacacgatcctgcaggcgctggtgagcgtggacatgctggtgctgttcgtggcgacaatctgcggcgtgggcgggacgctgacggcgatcgacaacatggggcagatcggcgagtcgctgggctaccccgccaggagcgtcaacacgttcgtgtccctgatcagcatctggaactacgcggggcgcgtgacggcgggctacgcctcggaggcggcgctggcccggtaccgcgtgccgcggccgctgctgctgacgtgcgtgctggcgctggcgtgcgcggggcacgtgctgatcgcgctgggcgcgccgcggtccctgtacgcggcgtcggtggtcgtcgggttctgcttcggcgcgcagtggccgctggtgttcgccatcatctcggaggtgttcgggctcaagtactactccacgctctacaacttgggcggcatggccagccccgtgggctcctacatcctgaacgtgcgcgtggcggggcggctctacgacgcggcggccgcgcagcagcgcggccgcggcaggatctgcctcggggtggagtgctaccggcggtcgttcctgatcgtcacggcggccacggtggtcggcgcgctggtgtcgctggtgctggtgtggcggacgtggacgttctacaggggcgacatatacgcgaggttccgggacggagacgagggcccggggcgggacgggcgcctgccggtcgaccagaaacgggaggaggaggagagggagaaggcggcggccaacggcaggaaggcgtgaggtggtgagcgggagcgggaaggcatggtcagggacgacgacgggtggggtgtacatgtacatgtgaatatagtacttttttgttgcattcacccgtgatgaccgacccttgttacctttcaaatttaaatagcctaaaaaaagccttcttgtccgtttcca

SEQ ID NO: 97 - DNA, 2032 bp, Zea mays
gccgcctcctttccctgtcttccgccccaccagaccagaccagaccaccaccctccggctgctacttttgcgcctccaccgcccatccccaaagccccaaccgactgcgcgtcccctctcctcccaaacgcattccatcctctctcctccagtgacagcctccggcgcctcctcgggctgccatccagcccgtgccactgccactgccactgcacttgctgtgccgacccgagctgcggtcgagtgagcaatggagcggcggcggcggcggccaccgaggctgccgctccttgtgttcgtcttagttgccaccacttgccccctcgggagctcagggattggaagcttcggagtcggtgcggagagcaatggagcttcgtctagttttaggaccaggagtctgctgcagattggagacagaaacgaagatggcctatttcatctgccacatacacgggctctcacgcacaagagcagatctcatagaaaagttccaacacccgcaccagcaccagagtccgctccagcaccctcaccatccatgtctccaccggacagctcaccgtctccgtcaccacatggttcacacccaatgccacgccaatcaacttcacatcgtcatccatccataacacctccacatttggtcaggcctgggcctaggcaagatggaaatgatcctttggtttatactccagctcattctcggcataaacatttttggacaacctatggtttagttgcagcagggattgcggttttccttttggtatcagcagctagtattctctgcttccgagctaagaaaatgggaaccgtaaggccatgggcgacaggtctaagtggacaattgcagaaagcttttgtaactggtgtaccttcgctgaaacgatcagagctggaaacggcatgcgaggatttcagcaacataattggttctacctctacctgcatgctgtacaagggaactttatctagtggagttgaaatcgcagtggcctcaagcttggtaacatctgcaaaggattggtcgaaagaaaatgaatcgcagtacaggaaaaagataacaaacttgtccaaagtaagtcacaagaattttatgaacttgcttggctactgtgaggaagagcatccctttaccagagtgatggtatttgaatatgctccaaatgggacactttttgagcatctccatgtcagggaagcagagaagcttgactggatggcacggctcaggatatccatgggcattgcttactgtcttgagcacatgcatcagctgcaaacaccagctgcgctgaggaactttgactcgactacagtataccttactgatgacttcgccgcaaaggtctcggatcttgaattttggaatgacgcaaagggacataattctactacaaacaatgaactggctttctccccagacatggaggacattgtgcgcaagtacggcatggtgttgttggagatattgaccggaagagttccttcctccgaggatgacggaccactggaaaattgggtgtctcgctattttgaaggcgggatgcgtcttgaggagctgattgaccctagcatcggcttcttccccgaggacactgcacgagccctttgtgaggttgtgaggtcctgcatcgatcgggatccaaagaagagaccgcagatgaaagaggtcgcagctcggatgagagagatcaccgcgctagggcctgatggggcaactccgaaggtgtcaccgctctggtgggctgagcttgagattatgacttctgagagctgagttcgacgcatgccagatgatattgtttctcctagtgtgactgagaattctttgagctactactggctgctgctaatcttgtttgtggaagtggtgattaggtagaatttgttatgtgtgcagaattgcatatagggattggtattgtacttgtacatgtcaagaaggtttaacacacaacatactgatacgcaggcattccagccaggtgagcaatagaaagcatgtgtggcttgtttttgctgcaat

SEQ ID NO: 98 - DNA, 556 bp, Zea mays
gcaccgtctattcttgggctgtcggcctcacgttttccactgcttccagaggcttcctctcgagtccgcagtctctcttccctacgaagttcagaagttgtcacaatgactcgcggcgaccagagggaacgcgaccggcagagggcgcaggcgcggcggcccgcggccaaggggcgcgacgacgggctcaccccggagcagcggcgggagcgggacgccaaggcgctgcaggagaaggctgccaggaaggcggcgcaggccgcgggaggcgcctgcgccaagggcggcaagaacaccggcaagaagtagccggggtctttactctttagttcgcaggatctgctcgtgttggaagatctgtatttgcctagatctggaatgcaatgcgatttcgtgggcgttgtctcgagcagtgctgaaacaacggttcacagtaaaatttgtagcaaagatttaaaaagaacgagggcgttggcactttgctttgcaagtgatctgcgtagcgtaacaaggcccgtttgaaggtaattttgttaacaaaaggatgggctcattg

SEQ ID NO: 99 - DNA, 1145 bp, Zea mays
caccactcccgtgcactgttgcactgaccatcgtctcactcatctcatcaccgctttccgtttcgctcgtccgatcctcatcaccagctcgggagggaggtcgggagagagcacggacgatgtggcacgccgcggcggcccccaacaaccttcacccggccgtcgccacaacatcgtcccctgcccttcgccgtgcgaggtggcccatcgctcgaccctcgtcgtcggtgaaggtccagtcctccaccaggaacggcaatggctccgctgacaacctggaccacctgcagagggcgtccaagggcaggcagcagcggcagggggcgagtgctccaggcccgagggctagaagggtcgtccgcaccacaccattcgggctgtggtgggacagcttcccggaagcaaggacgctggaccagatggtgcggaccatcatggacgccgacgacgctgacaccgacacccgcttcggcggcgtcgtgcctgcggcggcggcggcggcccccaccgccgtgccgcgcgccgaccacgggcggacgccgtgggaggtcagggagcgcgcgggggagtacctggtccggttcgacatgccagggatggcgcgggacgacgtgcgggtcagcgtgcaggaccggacgctcgtcgtggccgcagagaagaagcaacagcctgctgctgacggcggcggcgacgaggagggagataatgaggaggaggcgtggccgccggcgagcttcgggcggtacaggacgcgggtggagctgccggagaacgtggacgtggagaggatcgccgcagaagtgaaggacggagtgctgtacctcaccatccccaagctgtcggcgggggccaaggtcgtcaacatccaggtgcagtgatgctgtgggtcagattcatcaggacgatgagcacctgctgccgtgcttttcgcagcttctagaatctggatgcttgggacgagagcgatatcgatctagctaccactcttcttttcactcttctttttctgtttcgttcctcgattttgtttgctatgtcacacatggtaaatcttggtagttggtgccagaagataaggtgtaatctttgacctgtttggaacaaattccagaatcgaacgcaagagaatttaaatattattctgc

SEQ ID NO: 100 - DNA, 848 bp, Zea mays
tccccatttgagatattccctcgctcgctcagcagcaggaggcagcggctgctgtcaacaacaactggctgtccgacaccgcatttaagcttcaccctcccctcgggcctcctccactaaaactcggatagatctcagtgcagtgcttccctgttccttccatcaagaaacagcaaagatccagtgcagagagagagagagagagaaagccccatggcactctgaacaagaaaagaaaagagagagatctcagtcagccagtctctcacaacacaatgccggcaaccaccaagccgatcttgctcccaagggcgtgggcagcagcgccactcctcctcctgctgctgctcgtcctgcacgggagaggaggccactgcgtcggcatggaggcggcggagctggagatggactcggaggcgcaccggcggctgctgtgggaggcgaccacggggcggaggtacatcagctacgacgccctgcggggcgacgtggtgccgtgctccaggaccggggtgccctactacaactgccggatctcgaccaccgccaacccctacacccggggctgcgagagcatcaccaggtgcagggacgcggatccctaggctcttgctttgcttgctccgtcgccttgcaaagggaagtgggtgtggggctgctgctcctcgctccttcgacgctgcagggcggtgttgctgcaaatgcttactaaatgaagtgtattttattctgtcttcttcttttttctttcttcctctttttttttcttggtcgtccttcctcctttgccgggatatttagtaagtgtagtaatgaagcactaatactaatggatgaatctcgtgtgc

SEQ ID NO: 101 - DNA, 1503 bp, Zea mays
tcagctattcgcgggaccgtatccgagcaggacagcaggttgttcagcgatcactcgagcggtcgagccctcgcgccgcggagagtgtctccagtctcaagtacagcggaggatggagagcggcttgcttgacaccgccgcggctgccggtctctgcccggtggcggccgggcgccgccgcgtcgggagcacgggcacggcgaggtgcttcctcagctgctcctgcgcttccagagactgcagggtgagcgcgtcctactcccactccatcagccggatgctgagcggggtgcggtcggcggcgcgcaagaggctcttcaggagcgacccggccgagctgctgggcgtcgccaactggtcggagacgggcggcggcggcgccgggggccaccagcactggtggacggcgctggagaacaacttcgtgctggaggccaccgacgacgagtacggcggggtcgtcgtcgacgccgatcggctgccggccgacagggccgccttcgcgcgctccctcgcggcgtcgctctcctactggaagtccgtggggaagaaaggggtgtggttgaaattaccggtggatctagccgagttcgtccctttagcagtgaaggaaggcttcaagtaccaccacgcggaggaagcgtatttgatgatgacgtactggatccccgatgaaccgaatatgctcccagcaaatgcttctcatcaggttggggttgggggttttgtgatcaacgaccaaatggaggttctagtggtgcaagagaagtaccgcggatcgtcgctggatggcgtatggaaactccccacaggcttcattcttgcgtctgaggaaatctacacgggggccagcagagaggtgaaggaggaaaccggggtcgacaccgagttcgttgacgtcgttgctttcaggcatgcccacaacgtggcgtttcacaagtccgacctcttcttcatctgcatgctgaggcctgtgtcgagtgagatcaagattgacgagacagagattcaggcagcgaagtggatggcgctggaggagttcgtgaagcagcccttcatccaggaagaccacatgttccagaagatcatggacatctgcatccagcgcctccgcaagtgctactgtgggctgacgccgcaccacgtcgtctccaagttcgacgacagaacgtccacgctctactacaatgtcgccgagcccgaggacgtgaactgcagcgccgcctgatgtaatatgatgtgagggggagggggagccaccccagcatctactagtctaatttttgctgcgcagaagtttcatgatgcagcagtgttagtcgtgcgattactgagagtgaaatactagtggcagactgcgcgaggcaatagagttgccgagcctgtacatatacgtgtagggcatatgcataaccagagagctgtatatcccggggcggatccccgggcaggaggaaaattttcattgccgccgtaaattacaatttaactttagctcgccct

SEQ ID NO: 102 - DNA, 880 bp, Zea mays
agcttttagttagtggctcacaagagaacaagtcggcccccatcctttcccagcggcggcttgcccccaccagtccgctagtgctacatgctctccatccaatccatccatgatgcatcctccttcgcattgctgggccttagcatactgtcaggctaccagcaagcgaagtagctagccatgctcggcctccccgccgcgcccccggccgccgcagcaccgccgaacccgaagggcaaggggcgatgcagcgccgccccgccaccagcgatgacaggccgggtgtctctggctgtccctgcggcggctgtctcgctctcgctcttcctctggtccagtccagtgaacgccggcatcctgtccggtttctcgggactggagtcgactcccggccccgacctcccccggctcgagttcctggagaaatggaatgcggagaaccagaagaagtacaccgagttcgataacaggttcaagaagtccaaggtgctgcaggacctgctcgagaagagcaggaagaacaaagagaagaacgagaggatgatccaggacaagtactgtctgcggggcgccgagtggggcgtcggggactgctccacggagggcatgtcagaccaggagagggaggacttcatttcggagctcaagaagagagctggagcagagtagcgagctgaggacgtcattcagtttcaacagacgaagtatgggcacacttcgccactgtagcagtccagggaatggccattttactcgtcataccctgattaccaagggaaatacgcaaacaatgtagaccagcccataggccactgggagtgcgagaatgttcaccaacatcatgcgagctcagaatttgcaatacatatgtacccattgt

SEQ ID NO: 103 - DNA, 1677 bp, Zea mays
ccgatcgaaaagttgcagcggcagtgttgaggccaaggccaccgacccacctctctcatagcactagcagcaatggaggtggagatcctcgagtcctgcatggtgaaacccagcgacgacatagggacgccgccgccgcccatgcacgtggtctggctctccaacctcgatctactcgtggccaggagccacacgcccaccgtatacgtgtaccggcccagccctgacccggacttcttctcgccgggcgtcctcagtgctgccctgtccaaggcgctcgtccgcttctaccccctcgccggccggctcgcgcaggacggcgccggccgcccgcagatccactgcaccggagaaggcgcgctcctcgtcaccgcgcgcgccgacgctaccctccaggacatccccggcgggttcgccccgtcggatgagctgcggcagatgcttgtcccctcggctgccgacggcgaagaccgcgccggcatcttggccatgttccaggtgacgtccttcaagtgcggcggggtgtgcgtgggcgcggcgatccaccacacggcggcggacggcctagcggcgctcgacttcgtcaacacgtgggccgccatcgcgagcaagggcgtcgacgaggccgcgccggcgccgcgcccgtggctggaccgcacgctgctccgcgcgcgctcccctcccgacgtgcgcttcgaccacagcgagtactccccgcggggcggcggcggtccaaagacggcgagggtcccgttcgactccgccatcctacccatgtccaagacccaggtggacgcgctcagggccggcaagaaggtgtccacgttcaaggccgtggtcgcccacgtgtggcggtgcgcgtgcatagcgcgcgggctcgcgggagacgaggacacccgtctgtacatgaccgccgacgcgcgctcccgcgtccgcccgccgctcccggaaggctacctcggcaacgccatcttccgcgcgtcagcggtggccacggcgggcgacgtcgtctccgagcagctcgacgccgttgcgggtagggtgtccggcgccaccgcccggctggacgacgagtacgtccgatcgctggtggactacctggagcaggtggtgggcgatgtggcggggctccgcaagggggagtgggtgatgccggagaccgacctgtgggtgataagctggcaggggctgcccatctacgacgccgacttcggctggggacggccggcgttcatgggccgcgcgtgcctccagttcagcggcctcgtgtacctcgtcccgggcccggacggcgacggccgcctcgacgtcgtcgtggccatggagcccaagagcctggccagattcaaggagctgttgtacgagctcaaaggtgcaggtgttccgtgcacggcagactgagctgctgcattccgtgcaggttccttggcttgctaccggctggcaaaacgaaaacctgtttgacaaattgttccttgcattgcctatctacttcgacctttactgcagtactcctagttttctactcgttgtttgtgatcgcaatctggtgagtactgtactctatatgcatttacatggctatctatattcggagctaaattcatcgccggtcctgtaactcggcactagatgttacttttttcttttccaaaagggaagtgatttcttactatt

SEQ ID NO: 104 - DNA, 923 bp, Zea mays
ggcattcccattcccacccgtccatccatcctccgaagctcctcggcagacaagcagcagcgagagaaagcaagcaaggcagaggcagttgtgttgctggtcggtccgtccatggcgcccaagagaccagtgtcggcggcggcggcggcggagcagccgaggctgcgcggcgtgcggaagcggccgtggggccggtacgcggcggagatccgcgacccggtgcggaaggcgcgcgtgtggctgggcaccttcgacacgccggagcaggcggcgcgggcgtacgacgccgccgcgcgcaagctccgcgggcccggcgccgccaccaactaccccgccccggagccgacggcggaggcgttggcggaggctccagcggcgagcgggagcgggagcgccgtggtgtacgagtcgtcgtcggcgtcggcgtcggcgtcgtcgtgctccctgccgctggcggccccgtcgctggacctcagcctggcgctgccggctgcggcggcggccgcagagccgtaccagctgttcgcggacccggcggcggcggccgccgtgacgccggcgctgctgcacttcttgccgcccaagagcgaggagcagcagagctactctgggtcatcgtcgctgtcctcgtcgtcgtcgtctgtagtgttcgacgcggcgccgcccgtgggcctgcggctggacctcaacctggcgctgccgccggccgagatggtgatgtgattgctgccgtccaggaggctaatcgattgctcagttaattagtcaccattagtagctaatcgatcaaggcagccgtcaggcagaggtgtaaataggatgcagatttgctcggttttcgttgactgtgatggcatggtttgtttcttcgctgcgagtcacgcaacaatgcaaaagcaaaatgaaaagagagagggagaggg

SEQ ID NO: 105 - DNA, 804 bp, Zea mays
cacttcattgaagtagatccatgcagcgccgagccatagccacagcccaccgcgcgagcaacgatgttcaggtgccccagcaatggctacggccaaccgcaccccaccgcgaactaccaccgcacccactccggcgaacacgtcaccaccaaggtcgcccagaaaccctgccatgccggcggcgccgtgcagcagcaccacgttgtccacaaggagtcgtcgttcaaggagctggacgggggtaaccgccgctgcttcgacaactatcccatgaacgctgctaacaacgcgaaccaccaccgctacgaggcctacgaggaaacctacgaggaaaccaactgcgaggaggagacgtacgcgtacggcgccggccgccaccatggtcacggcagcggcggcggcgggcgccgcttccagtaccagacccacgaggagacctacgaggaggaggaagaggaggtcgtcgtgggcgggggcgacggcgccggcgccggctgggcccagctcaggcgcccatcctgccgcgcatgagcagcaggcacctgctcgtacgtggaatgtgtggatgcgatgcgagtccggattggtagacgccacgcgttggttcatgggtacaattgcaaattataataataacctgcaggtgacaacctagctaatctcgtacgtaaataaattgtactcttagtcccaatccccattaatccatcgatgctctgcatccaccgtatgtattccatgtatggctgtgagttgtgacacaagtaaaaccaaattgacaaaaaaagatcatgaaattgcgtg

SEQ ID NO: 106 - DNA, 985 bp, Zea mays
cgatacgcgcgagggaacggggccggccggccggccggggatcggaactgaagtgtgggcacacaagagtcacaacagggggagtgggggacattccaatcagttccctgcgtgtgagcgatgcagcgggacgcgagaagctggtcgccggcgccggccacggacgccgccggcccttacgcgatgccttcgcccgtgcagccgtcgaccaagagcacgaaggagacggtgaagaatgcgctgtcgcggtgggggcggaaggtcggggaggcgaccaggaaggccgagggcctgtcgcgcaacacatggcagcacttgaggacggcgccgagcatcgcggaggccgcggtggggaggatcgcgcaggggaccaaggtgctggcggagggcggccacgacaggatattccgccaggccttcagcgccccgcccgacgagcagctgcgcaagtcctacgcttgctacctctccacggccgccggcccggtgatgggcgtcctgtacctgtccacggccagggtcgccttctgcagcgacagcccgctgtcctacgaggcttccggcggcgacagaacggagtggacccactacaaggtggcgattcctcttcaacggctgcgggcggcgagcccgtcggccaacaagaccaagcccgcggagaagttcatccagctggtgtcggtggacagtcacgagttctggttcatgggcttcgtcaactacgacggcgcggttgcgcacctgcaggaagcgctgagcgggttccgcaacctgcaggcgtgacatggaggacctcaatgcaatggacagtgttgtcttgtacgtgctcgccagaactgattgatctgtgtgtgttgcggtgctagtgtttgcatcgtgttgtgcgtgtgcggatttgtatgacatttttttgatttggttgccattgtcagcgagagaacagtccaatcattttattcagatttcagagaagaccatggttatc

SEQ ID NO: 107 - DNA, 1138 bp, Zea mays
tcgtgtctgtctcctggagccgcccgccgctagccgcccccgccacgtcacggccgcccccgcccgcccccggccccgaccccgtccgccgcggccgcccccggcctcgttctcctcctcgcaactctcttgtccatacatcgtagccgccgcctgtctctcaccgccgacatcccgacagctctcagcccagatcgagcttccccgttcccaaatcgggtcctggttgggctcccgccaccgcctccctacaccaggtgccaaggccttcgccgaccacttcgccggcgaagagcgcccaacagatgaatgtagcggtgccaccacaatctccacatcttcgtctatatgactgcgccaagagtgccatcatcaaaatttttgcctttccttatgctacggtatgtgacctgtattgcgatagtggaatggatacagacaagtggtgtgatgcccaggttggccactacataggcatcgatgcctctgcatcgggtgtcaactatgcccgtgagctatgggagaacaggaggaaacctttcactgctgaattcatcgagttggatccttctgatgatggttttgaagctcaagtgcaggaaaagggcatccaagcagatatggtttgttgtatgcagcacttgcagtcatgctttgagaatgaagaacgggcaaagaagcttctgaacaatgtatcatcacttcccaaacctggaggctacttctttggcataactccagattcatctacaatatggacaaaatatcaaaagaatgttgaggctgcacataataagggtttgaagactgttccaaatagcattcgctcagagaactataccattacctttgaagtcgaggaagagaagtatgagttgaaattgtatactaaatacacctagaaacttttgttacactgacttcctgaccatgtatgagatattgtctcttattagtactagatgatgagatgtgtctttttatgactatggatgagacttttgtgatgtaattgatgagaactatggatttaaatattgttatgtgattgtgtgtgagatgttttatgtgaaaatatgttgtgctatatagctgttgatatatttgttatattatggaatatggtgtaaaataaaaa

SEQ ID NO: 108 - DNA, 1235 bp, Zea mays
cgcgtcgcgtcgcgcacgccgtcctgcccgccccttttcacacccccgacgcaaccgcatcgccgcccgccctctatatcctcccgcaccctctctctctctcctcctagcacaccagacgccgccgcgagcccccagcatcccagcccagatgttcctcgccgacaagtacagctcgctgctgcccttccaccaccaccattccaagcccagccgacgccagcagcagaagggggaggcgcaccggttcggcacggcgctggccgcgcgcctccggggcctgctgccgctgccggcctccccgctcgcggcgctcgtgcgggtggccgacctcctcgcgctcacgctcgccgaggcggggcccgcgctcgcctgctccggcgagggcgccgccgtcgccgcccacctcgacgccggcgtcgcgctcctcgacgcctgcaacgccatcgccgcgcggctcgacggcctccgcaggcgccgtctcctcgccagcctcgcgctccacctcctcctctcctccacctcgccgtccgggcggacgcgcgcgcgcgcggcgctcgcggaccgcgaccccccggcccctccgccgctcccttggctcccgttcgagcagccccgcgggcagctcacggccgccgcgcgcgtcctcgccgccgtggacgccgtctcctcgctcgcggcggcggccgcggctaccgtcctcgccggaggacctgccaccttcccctgggtctccggcagcggcggcgacctcccctgggcggagccgttcaacgcgctgtccggccagctcgcggcgctcggcgccggcgaggtgcgcgccgtcgacgaggccgtccggaggctcgcgtcggcgctggactccgggaccgacaacgagggggccgtgcgcgccgcggcgcaggaggttgggaggcgcaccgaggagctcgcgccgcggctggaccgcctgtctgacgccgtcggcggcgtgttccgcgccgcgctgggcctccgcaacgccgagcttggatgcttaatggtgggacccgcggggaagcccgtgtaggaatagtacttcgtagtagctgttatactgggatactgcgtgaagttgatttgggatcatgtgtgcgtcagtgtcgaggacgaggaggccactagttgcaatttgcatgattttggatacgtggcatccactgctgtatcccccattcgtcaactgggactgggagaaaccatcttcaggttgctgt

SEQ ID NO: 109 - DNA, 1207 bp, Zea mays
tcagcacggggaaaaatatctgaaggcgcgcggttgcgacgcggagcgagtggtggcctggacgcctggtgtgcgctattttcccccgcgcgcgcgtcccaactccaggagctctcgatggtgcccgcggccgcggctgtcgcagcggcgagcccggcagcgctccctcgttcaacgtccccaaggggcagacgtcccagggcccgtgcctgctcgtttcggtgcgctgggccgagcgcacgctcctcagcacttgtgtcctcctataagtcgggttccgccggccatggccatccccggattcggcagctgcgcggacggccggactgcagccggcaggcggaagtgatgggcagcaccgtcgacgacgacgaggcgtgcgagctggtgagcggctcggacctcgtcatcggcgagggcgacgacagcgtcagcgcgtaccttttcaaggccgtcaagaacaacaatggcaccggcatccttctcctctccgacatcttcggcttccaggactccgccacgcgggacttcgcctaccgcgtcgcctgcaatggctacaatgtcctagttccggacttgttccgtgggaacccgtggaagctgaacgtcccgttcgacggcgacagcttcgagcggtggctggcggggcaggccccgggccgggtgtccggcgacatcgacgcgtgcacgaggtggctggtggacgagttcaaggccgcgggggtgtccaagaagctgggcgtgatcgggttctgctacggcggcgggcgcctcgtggagacgctggcgcgcgacgccgagagctgcttcagcgcgggggtctgcttctacgggtcccggatggacgcgtccctgggcgaccgcgtcgcggcgcccgtcctgttcgtgtgcggcgacggcgacccgctgtgccccgtggagacggtgcgggagctggaggggcgcgcgagaggcgcccgggcggcggtgtacgccggcaggggccacgggttcgcgcaccggccgcagtcggtggaggaggacggcgacgccgaggacgcgttcaacgcgatgcgggggtggctgcacgaccacctgctcgcctgatcggacgatcagacgctgtacacgggtttgggtgttttgtacatacgtactaatatgttatttgaccaagtctcctggtcatcctataataaagagcaaaatccaccattaaaaaaataaa

SEQ ID NO: 110 - DNA, 2185 bp, Zea mays
gtccgtggtcccttcaatctctctgcgcaatcaaactgcggtggccaaccccggaagcggcggcgggcaaagcgcgcgacgcagagaagcgtaacttcaggccgccggtcgctctacgcatcctgctccccgttctcgtcggagatccaccggggcagcctttctttccccttcctcaatcaagtcgatccaatttcgcgcgcgggtcgggctcgccttctcctccagtctccacctccaccagcgctcgaggtcgacggacgctactcgcagcagttcttctttgcggtgcggccgagaagaagctaaggctcaggcatgagcttccgggaccaggagagtggcggggaggatgggggcaggacgtcctccgcctccgacctgcggaagccgctcatcaacaccgggagctggtaccgcatgccgccggcgggtggcgtgatgggctcgcggcaatccagcctcatggagcgcttgggctcctctgcgttctctctccgcgacgtcgctatctcggccacgctctgcacgcttattgtcgcgctaggtcccatccagttcggtttcacatgcggctactcctcacccacgcaggacgccatcattgctgaccttggcctctccctctctgagttctccctcttcggttcattatctaatgtaggggcgatggtaggcgccatctccagtgggcaacttgcagagtatatcggccgcaaggggtctctcatgatcgctgcgattccaaacataattgggtggctcgcgatatcatttgcaaaagattcctctttcttgtttatgggtcggctgctagaaggatttggagttggtgtaatatcgtatacagtaccggtttatattgcagaaatcgctcctcaagatcagaggggagctcttggttctgtcaatcagctctccgtcacgattggtatattgcttgcctatttgtttggcatgtttgttccctggagaattcttgctgttctaggcattttaccctgttcaatcctgattcctggactgttctttgtccctgaatccccaaggtggttggcaaaaatggggaagatggaggattttgaatattcattgcaagttctgcgaggatttcagacagatatcacagcagaagtaaatgaaataaagagatcattagcatcatcgaggaggaggacaaccataaggttcgctgatatcaaacagaagagatacagtgttccccttgtgataggaatcggtctccttgtcctgcagcagctaagtggtgtcaatggcattctattttatgctgcgagcatcttcaaagctgctggtattacaaacagtaatctagcaacatttggtttaggggctgttcaggtgattgctactggagtgacaacctggttgactgacaaagctggtcgaaggcttcttctcattatttccaccacaggaatggtcattactcttgttattgtttctgtgtcattttttgtgaaggacaacatagctgctggttcgcacttatactctgtaatgagtatgctttcactggctggacttgtggcatttgtgattgcattttctcttggcttgggagcgattccgtggatcattatgtctgagatccttcctgttaacatcaagagccttgctggaagtgttgcgaccctggcgaactggctgacagcatgggccattacaatgacggcaagcctgatgttgaactggagcagtggaggaacctttgctatctacgccgtcgtgtctaccatggccctcattttcgtgtgcttgtgggtgcctgagaccaagggaagaacgctagaggaaatcgccttctcattccgctgacacgtcgtcatgatctaggtatgggaagccacaccacaccatgtgtcattgagtcatgccgcggtgcgttcagttcatgaatcccgcagggatcttgcggccattctcttgcttggatgtaccaccatcttcagtgttcataccaatgtacattgtacaatatgacgacgacgccatagcagaaaggcaagtgggtttatgtttgtacgatggactagtagcagaaagcactcgaacccctgtacgggttgcggaggagagcaatttatttgctgtattttcctggttcaataccggacacgttagaattttgaaaaataaaaatctgagcaaatttatcaacggt

SEQ ID NO: 111 - DNA, 926 bp, Zea mays
cctgcgcgccgcaactacgtggtcatgcctgttgcgcggtggtggcacacaacaaaactcgatggatccatcccgccgccacacgcccgtttccttcccttttcccgcagtccggatccagtccacggcccacgggttgctggctgcctggcttccgggccccaccaccaccacagcgaccgcgggacgcgggtgccgcgtgctcgctttcacgagcacgacgagctcggcttcggcgtgagccagcgtcgtacggctcatccgccccgtcctcggtcgctatttctctcccatttcccttgctccctaccgtcgcggaggaagacaagacgcgcgcgcagaagcacacctgctcgggctagattaggaggacagcttcttcggccggcgacatggcggaggagaagggcgcgttgcagtcggcgagggagtgggtggtcgaccacaagctccgggccgtcgggacgctgtggctcagcggcatcgtcggctccatcgcctacaactggtccaggccgggcatgaagaccagcgtcaagatcatccacgccaggctgcatgctcaggctctcacgctggctgccttggctgggtccgcgctggtggagtactacgaccaccagcaagggtcaggatcgaaagttcaccaatatgcaaagcagttcctttcatctgatagcaatagcggccaacaaaaggagtagctagctagtgtccttgcgaagtgcaagcagcggagtgggcgttatttcctgatcaaataattttgcctatggcacattctgtggaaactttgacggatctttgcctgcttttctatgcgatgtaagctgctgaaacctgcactcatcaaatgttgtgtatgcagatggtaccatgcatttgtttccctgaatggcttcaaatgaaatgaatgttttttttta

SEQ ID NO: 112 - DNA, 835 bp, Zea mays
tttacgcctccgctccgccccgccccgcgtctgcctgcccagcccagacgactcccctccgacttgtacctaacctatcgagacagagttccacgaagcagcaccagcacggcgccgcctcagcctatatataaacacacagccgccccccgtcttctactctgactctcatctgaagcgcgcgagagaaacgcgtatacccaggcggcggttgaggaagaggaggagaagaagaagaagatggcttcctccgcatacgcctcatggtccaagcggtggatccgtcccgaggtgtacccgctgttcgtgccgatggccgtggccctgggcatctgctcgtaccagcttgtgcgcaacatcacgggcaaccccgaggtgcgggtgaccaaggagaagagggcggccggcgtcctggacaaccacgacgagggcgagaggtacgctatgcacggcctcaggaagttcgtccgcgggaagaagcccgagatcatggcctccatcaactccttcttcgccgaccctcccaaggacgattaagctagattccgtcatggatggatggatggatggattcccgattcccgatcgtccatcgtatgttttaccattcattagcggccggcggcgcgccttgattcgtagccgtcgtcggtacatttttttttgtttctaaaattctaattctcccatataaatggaacatcatgcatttgtcgtgtgtgcttgcatggctgcgaacgaattcagcatgccttgttattttcatcacatatttgattaataacggatgactatgatattgttgcgtcccaacaaattatgttgatttatttac

SEQ ID NO: 113 - DNA, 1809 bp, Zea mays
gcccgtggaaatatccacccgcggcccgggtcaccccgcaaggccgcaacgcctccgctttcattcttctcttcccctcggcttcgagggttatttttatttctttctttccttttttcgtttttattttctttttattttcttttttcttccttttctcgttccccccgttggggttttgagctccgacgaaccctaataatcgccggggaccggcggccgatcgcccgccggcatgcaccatcagcagcggatgaagcaggcggcggcggccgcggccgcggcgcagcagcagcagctgatgcagcaggcactgctcctgcagcagcagcagcagtcgcaggcgcagccgcccttgttccccgggcaccacccgcaccccggcctcctcgccgcaccacagatagagcccatagtcagtggaaacctgcctcctgggtttgattcaagtacatgccgcagcgtgtatgttggcaatatccatcttcaagtgacggacacagtactgcaggaagtcttccaaagcattggtccagtagaagggtgcaagctcatcagaaaagaaaagtcatcctttggtttcattgactactatgaccgcagatatgctgcactagcaattttatctctcaatggcagacaactgtatggtcagccgattaaagtcaattgggcatatacaagtactccgagggaggacacatcaggtcattttaatatttttgttggggatctttgcccggaagtcactgatgctactttgtttgcatttttctctggatactctacttgctcagatgctagggttatgtgggaccagaaaacaggacgatccagagggtttggttttgtttctttcaggaaccagcaggatgctcaaagtgcgataaatgacttgaatgggaagtggcttgggaaccgtcaaattcgttgcaattgggcaacgaaaggtgctaatgctggtgaagagaaacagattctggacactaaggttgacctgtcaaatggttcatcagaatctggaaaagagaatccaaatgaagatggtcctgaaaataaccctcagtttactactgtttatgttggcaatcttcctcacgaggctaccatgaatgatgtgcacctgtttttccattcactgggggctggttcaattgaggaagtccgtgtaactcgtgataaaggctttggctttgtgaggtacagcacccatgaggaggctgcattggcaattcagatgggtaatggccaacttattggcgggaggcagataaagtgttcctggggaagcaagccgactccacaagggacagcatccttgcctctgcctcctccagcactggcaccattctccactggagtgtcggccaccgacttgctggcctaccagcgcctggctctgagcaagatggcctcgaaccacccagccctaatgggtcagcactccttgaagcaggtcgctgcattggggattggcggcggagccagccagtccatctatgatggcggcttccagggcatcaatactgtcaccggcacaacttccgcccagcagcagcagcagctcatgtactactagagtactactactccatgaggcacccagctacctatcccttcaagaggaaggcgaggatgaatggatgatgccccttactatacccctatacatatagtagatgatgaagtcattactaggaccttttttccctaatctttttaagacccatctaagtaacatgtcctgtctatgctagctatataattgtgtatttctggatacataaagccaaggttcttagtagtata

SEQ ID NO: 114 - DNA, 1343 bp, Zea mays
atatcttagttgcacggttaggtaagacatatggacacaggcagttgcgtctctgtctcttatatacatatgctagatttgctatattgagttgacatgccgttagttgcgatttgcgaagctagctcccaccatctgcgacgccatgtcttcttcctctgtccaacaaacggcctttcccgagcaagaagccgatgcggaaggcgaaacgaaccctgagctctaccagcatttcgccaacttggtctcctccctgccgagctccaaaggcttgtccaacaacaaattctaccgccacggccaaggctggcactgcagcgaggtgggcatagtgggcgccatggtcaccgacgcgtgcttcagcgcgcgcccgtcggacgtcatcatcgccaccctgcccaagtccggcaccacgtggatgaagtcgctcctgtacgccaccgtgcaccggagagagcgtcccgtcgtcggcgccgccgccgccgaccagcatcctctcaacagctggggcccccacgacctcatcaagttcttcgagtaccagctctacacgcgggacagggtcccggacctggacaggctccccgaccctcgtctcttcgcgacgcacgtccctttcgtgtcgctgccgagctccgtggtcgccacgccgggctgcaagatcgtctacgtgtgccgcgaccccaaggaccacctcgtctccctgtgggacttcgtcaacaaatacttcagggtcaaggatgggctcgagcccctctccgtggaggccgccgccgagctgttctgcgccggcctgaccccgttcgggccgtactgggaccacgtgctcggctactggcgcgcgcaccgcgcggaccccgacaaggtgctcttcttcaggtacgaggagatgcagagggaccccgcggcgcacgtccgcaggctggcggagttcgtcggcctcccattcagctccgaggaggaggacggcggcgtggtggatgccgtcgtggggctgtgctcgttcgagcgcatgaggggcatggcgccgaccaagggtggcaggactgagttcccgatcggcgtggtgcccaacagctcctttttccggcagggcgtggtgggggactgggtgaaccacctgtcaccggaaatggcgcgccgcattgacgcgatcactgcagacaagttcaggggttcgggtctcgtcgtctagctggctgttacggatcaatcattactcatcatcagtgcgccactctaccgtggtttctcaaatgctcaataatgcaaggactacctattagtattatatatctatactattctattaataagaacttatatatgttgctatcgcggct

SEQ ID NO: 115 - DNA, 2034 bp, Oryza sativa
atgtggtgtgctgctgccttgtcgtcatagaacaaccttctcttcccttccctcacctttcgcgttcacctcagctcagctcgtctctctgactctgatctcgccgtcccgagttcgccggacacgcacgcacgcggccacgacggcggcgatggagggcgccctgctctgcgccgccaaccacgcgccgctcacgcccatcaccttcctcgaccgcgccgccctcgtctaccccgaccgccccgccatcgtcgcctcctcctccgggctcacccgcacctggcgggagacgcgtgaccgctgcctccgcctcaccgccgccctcgccgccctcggcgtccaccgccaccacgtggttgcggtattcgcgcagaatattccggcgatgtgcgagctccacttcggcatcccgatggccggcgccgtcatctgcacgctcaactcccgcctcgacgccgccatggcctccgtcctgctccgccactcggaggccaagctcatcttcgtcgactgcgcgctgctcgacgtcgcccacgacgccatccgccgcatctcccaatcgggcgccacgcctcccgtcctcgtcctcatcagcgagctcctcgacgacccatccgatgccaagctcccgtccggtcgtgtcgactacgagtacgagcacctcgtcggcaatgccgggtcgtcgccggagttcgcggtgcggtggcccgccgacgagaacgagccgatcgcgctcaactacacgtcgggcacgacgtcgaggcccaagggcgtgatctacagccaccgcggcgcgtacctgaacagcctcgccgccgtgctcctcaacgacatggcgtccacgccggtgtacctgtggacggtgcccatgttccactgcaacgggtggtgcatggcgtggggcgtcgcggcgcagggcggcaccaacgtgtgcgtccgcagggtcaccgcggccaccatcttcgacgccgtggcgcgccacggcgtcacccacatgggcggcgcgcccacggtgctgagcatgatcgtgaacgccacggcggaggagcagcggccggtggcgaggagggtgacggtgatgaccggcggcgcgccgccgccgccgaaggtgctgcaccggatggaggagcaggggttcctggtgatccactcgtacgggctgacggagacgtacggcccggcgacggtgtgcacgtggaggccggagtgggacgcgctgccggcggaggagcgggcgcggatcaagtcgcggcagggggtgcaccaccacggcctggaggtggacgtcaaggaccccgccacgatgcggagcgtgccgcgcgacgggaagacgatgggggaggtgatgctgcgggggaacacggtgatgagcggctactacaaggacggcgcggcgacggcggaggcgctcgccggtgggtggttccggtccggcgacctggcggtgcggcacgaggacgggtacgtgaaggtgctcgaccggtccaaggacatcataatctcgggcggggagaacatcagcacaatcgaggtggaggcggcgctgttcagccacccggcggtggaggaggcggcggtggtggggcggccggacgactactggggcgagacgccgtgcgcgttcgtgaagctgaggcccggcgcggcggcggcggcgaaggcgggggtggtggaggaggagctgatggcgtactgcagggcgaggctgccgaggtacatggcgccgcggacggtggtggtggtggaggaggggctgccgaagacggcgacggggaaggtgcagaagttcgagctgcgggcgcgcgccaaggccatgggcaccgtcccggcggcggcggcggcgaagtcgaagaggagcaagctctgaatgaatttgtttgcgtcagctgctgacgactgcaatgcaacttcgatgcagcatgcgtgtgtgtgcctgtggaatctcgagacaacaaccaaagaaaaaaaataaaaaaatcatgatttgttgtgatgattcgtgcgagaacaggttggtgtcctttggctgtcagt

SEQ ID NO: 116 - DNA, 1572 bp, Oryza sativa
atttattatctccaccacatcatcacaagccgcagcagtcagaaaaacaaggggaagaagagcagattggattagcgccgagccgaggcggcctcgacgataagcttcgcctcgccggccgccgccatgcggaacccgcccgggaggcacctcctccgcgtcgccacccgcgccgtgcgctcctcgtcggcgctcggcagcggcggcggcggagggggcgcctcgacctccgccacgtcccccgtcgccgcctcctcctcatccggtggccgcccgcgcacccgctccggcggccgcctcctgcgcgccacctcgccgcccccgccctccgccatcgccgcggccgcgtgctgggagtcccgcacgatgcgccgcgagggggaggaggagtgggaggaggtcgtcgccggggccgaggaggcggttcatggggcccccgtgcctgttgcggaggaggaggaggagtacagggtggtgttctggtcgccgcccaccggcgacgaggtccgcgcagccttcaccagcatcgaggaggtatttggtgatccttttcgtgcgcattcttatgaaactgaggagcaatcagcattgtccacctcagtacattcgtcatctggcaattcatcaggatcagatgactggattgaacctgctgcctatgctctcaactcaactgctcttctgacaagggaacatagaaatgttttggatgccttccgtttattgcaaaaagatcctaatgttcagaaaatggtcatgtccttgtcatgcgacagggctgtatgggatgctgttatgaacaacgaggcagtgcaagaattcaggagatctttccaggatgacaaagaagcagcaggtagaaagggaaaccctggtggtcctgctggagtgcttaagtggattctgggcaacacccaagcaaaaataatggaattcatgaataatataatgaagattgtgaacatgcttttccactctgatgatgatgaagcgaagcccgacctttacactgatgcagtgaaggtgtcattcatgctctcagttttcatcttcatcgtggtggccattgctcgtatcaattttgagccgtgggatttcaaagtgtggtgatgcaagattctgcaagccgtgtgtgcatgttttgtaggacagctcatgatttccaagctatctaacttaaattcacacgaaattgtacatcgatgatttctgtatcatttgaccctgttagtctgttgtaaaggattggtttgtctgtgtcccattttcactgggagattaatatacttaagaatagataaatagttccgcttgcttggacgatgggttggaactcgcccgtcgcgttgccgccttgcagcagcaagttgaccgtggttgtcaagcccaatctctgaagctaccttccccgtccacgctaagaatgtcgagcaacaaatccacaagcacccaccaaccttaggtcaaatcgcaccaaacaaagcatatgcgcttatgtttggaagtttgaattgacactgtaacttttcatccgaataaatctgcaccaagattgattgtgcactcacaaaa

SEQ ID NO: 117 - DNA, 1956 bp, Oryza sativa
ttgtgtacaaaactaccacacctagattagatttgcacggcatcacatgtagtgcacgcgactcgcatcgcaaaaaaatttgggagaccacccacaaatcgctcgtcggcgagcgaatccaaaccaaatccttgttctagtcttgtatcacccgcatctgcgcgtccctctgcggcggcggcggcggcgacggcggcgatggggctggagatggaggggatggcggcggcgatcggcgtgtcggtgcccgtgctccgcttcctgctctgcttcgcggccaccatcccgacgggcctcatgtggcgggcggtgcccggcgccgcggggcggcacctctacgcggggctcaccggcgccgcgctttcctacctctcgttcggggccacatccaacctcctcttcgtcgtgcccatggcgttcgggtacctcgccatgctcctctgccgccggctcgcggggctcgtcaccttcctcggcgccttcggcttcctcatcgcatgtcacatgtactacatgagtggagatgcatggaaggagggtggcattgatgcaacaggtgctttaatggttttaacattgaaaatcatttcatgtgcaataaactacagtgacggtatgttgaaggaagagggtttgcgtgatgcccagaaaaagtatcgtttggctaaacttccttctttgatcgaatattttggctactgcctctgctgtggcagccattttgctgggccagtatatgagatgaaagattatcttgaatatactgaacggaaaggattatgggccagcccaactccttcaccactattgcctactttgcgtgctctagttcaagctggcgcatgtatggggttatatttgtatctatcacctcaatttccactttcacggtttagcgagcccttatattatgagtggggtttctggcaccggctcttctatcagtacatgtcaggctttactgctcgttggaaatactactttatatggtcactttcagaagctgcaatcattatatctggtctgggttttagcggctggtctgattcatctcccccgaaagccaaatgggatcgtgcaaaaaatgttgatgttttaggtgtcgaattagctacaagtgcagttcagttgccgcttatgtggaacattcaagtgagcacatggctgcgatactatgtttatgagaggttagttcagaaaggaaagaaacctggtttcctccagttgctgggtacacagacagtcagtgctgtctggcatggtctttatcccggatatatcatattctttgttcaatcagcattgatgataaatggttcaaaagtcatatacagatggcaacaagcagtcagcaatccagtcttccacgctatcctggtttttgtaaatttttcatacaccttgatggtccttaactactcatgtattgggttccaggtactgagcttcaaggaaaccctagcatcctaccagagcgtatattatatcggcacaattgttcccattgtagttgtcttgctgggttatgttatcaagccagccaggccagtgaagccaaaggctcggaaggcagaatgagcaacaagttgacctggtcaagtggtcattacatataggagcgacgaagaacatttaatgacgataatgacgaactagtgtccagctattctactgtggaatttcgcaggagaatgtgatgactcacctcttaaagttctgaactcccttgtgattgatcaaacattaaaacgtggcactcccgttggatttttcttctatgttatgactactactacaactacataggatatcggccttgcgccttcggttgttgagttctcttctgaccgactgtcattcaaagcgatgtattttttatcaccttccctggcctggagccaaatggaggtgtgaatgggcatcatttcttggttcacatccaatgtgtccttacca

SEQ ID NO: 118 - DNA, 2994 bp, Oryza sativa
tcgtgtaccatcaccaccatctccacctcctcctcctcccccaaccaatttcctctaccctcctccgcttccgccgagtcaaaatccaagcttgtcccctcaaaatctcaccttgtgcctccaccaccccaattcgaagctgttcctgaccgattcttcggttcttggaggaggaaaaagggggtttcttggggttttggtttgggggtccgatttggggttcggaatcccggattgattctttcttgctcggcatttcgattggtttggtggttcttggcttgtttgagcgagcggaggtttgggattccacgggtttttttctccgagtaattttggtcaaagtttgggagacagagagagctactccagtttttagttagttcgatggtggcgaggatgatgcggtggccgcgcccgccggcggcgcgcaagttccgggtccggctggtggtgcggcgggcggaggggctccagcagccatgcgccgcggcggcggagcacgcggcttcggcggaggcagaggcgccgccgacgagggttgcggcggaggtgaggtggaaggggcccaaggcgtcgcccctcagctcgctgcgccgcaccgcggtgcggcgcaaccgcacgcgggaggcggaggcggaggcggccgcggtggttgcctgcgccaccgccgccgacgatgccgctgccgccgcgggcgccggagacgcggcgggcgtggtggtggctgcgtgggaggaggagttcgagagcacggtgacgctcgctgccgcgtcgcaccgggagcacgccgcgttccagccatgggagctcgccttctccgtgttcactgctgccaacagaggaccaaagatcaagccatcaattcttggaactgcttcccttaacctagcagattatgcatccgccgccgaagagaatattgagataattctcccattgtccgtgccaaatggttcagctgagtcagctccctcgctacatctcaccctgggtatggtggaattaagggcttttcaggaaacatctgatgcttcacaaaggtctgctatggccgctccattatccccatcctctggtgattctgctccagtaggaaaagatgaggtttcagttatcagagccgggctgagaaaggtgaaaatcctcactgatctggtgtcgacacgaaggtccaagaagacatcccaagatgatgaaagcagtgaagaaaaatgctatgttaacagtgatggtgctgaatatccatgtgacatcgagtctctggatgacgatttggatgacagggcacagcaagatgaagttggggattcaactgtcaggaagtccttcagttatggctcactgcagtctgtcaactatgtcggcggcctagtttatgctcatgcaaagattgatggggagcatgaggactggatctattatagtcaccgcaaatctgatgccggttaccatgtagagggaaagccatcatcaactgttgaggaaaccatgctgccaactgtaaaacggagtatccttccttggagaaagaggaagttgagtttgcgatcactgaaggcaaaaggcgaacctctgttgaagaaagcatatggagaagagggaggtgatgatattgactatgatcgacggctgctaacctcttctgatggatctgtttcagagggatcaaggggtgaagatgggtccattaatggtatggtttcagaatttggtgatgacaacttcgttgttgggaattgggaattgaaagagatagttagccgtgatggccatctgaagctctcttcccatgttttctttgcatcaatagaccagagaagtgagcgggctgctggggagagtgcttgcacagcacttgtggctgttattgcggactggttccaatcaaaccaggatataatgcctatacaatcacaatttgacagtttaatccgtgaaggatcattagagtggagaaacctttgtgagaatctgatgtaccgagagcgttttcctgacaagcactttgatcttgaaactgtccttcaggccaagatccgccccctcacagtttcttctagcaagtcttttattggattcttccaacctgaaggtgccgatgacatgcacagatttgatttccttgatggagcaatgtcatttgatagcatctgggctgagattagcaaagcagctgagtactcatcaagtgataaccctaatctatatatagtgagctggaatgaccacttttttctgctcaaggttgagcgtgatgcgtattacataattgacacccttggagaaaggctctacgaagggtgcaaccaagcctacattttgaagtttgacaacgacaccatgattcataagctacctgagaaagcaccatctagtcctaactcaagtggaccgctgaaggattcttcaaggagctcctcggttgagcaggacagtgaagatggcactgaagagaacatactggtttcaaagggcaaggaatcatgcaaggagtatatcaagagtttcttggcagccatcccaatccgggaactacaggttgacatcaagaaaggcctgatggcgtcgacgccattgcaccaccggcttcaaatagagttccactacactgcatcatccccaaaggagattacctcagcccctcaaattctaaccatcgaagccccttttgagttctcatggcctgagccaccaccggcaatggagatcgcgctagcaccagctgttgctgttgtatagcttcctgatggtgatctgtcctgacatcagtccactgcatgcatacttgctggagattttgtgtcctttatgtttgcgctcgtatcctgcctaatatgaactaactactataggtttttgtccaggcctaggagctttctgcctgcattttgtataaataggtgtttgctcctacatatttttctcaagtgccggatttgtaaccatcaagaaccttgtgttactaatcaatgagtaatgcacatgtgttag

SEQ ID NO: 119 - DNA, 660 bp, Oryza sativa
taccactgtacagggtagtagatctttcgtacgttggagccggccggatcgacgaccatggggtgcgacgacaagtgcgggtgcgccgtcccgtgccccggcggcacgggctgcaggtgcgcgtcttcggcgaggagcggcggcggcgaccacacgacgtgctcgtgcggcgaccactgcgggtgcaacccgtgcaggtgcggccgcgagtcgcagccgacggggagggagaaccggagggccggctgctcctgcggcgactcctgcacctgcgcctcctgcggctccaccaccaccaccgctcccgcggccaccacctgatccatccatccatgcgcccaaaaatgcccaacgagacgtgtttatacgtgtggttaagcgtgtgtacgtgcgccatgcttagtactcatagctgcttagctaaacagcacagctgataaataaaaagggcttgctgcttgagtcgagtcgtatcccgttgtctagttctggctagactcgcgcatcacgcatgcaacggacatggtgatacgcgagggatggagagttcggagttgggagacactgtgtactgcagtaccaggttgataagtgtgtctgtacttgtgtaaatatgttttacatgaataaaaaggttggtaactttgtcatgtttatcaa

SEQ ID NO: 120 - DNA, 882 bp, Sorghum bicolor
gagccaaccggcccaaccctctcagatcgtcagtcctcgcctaggtttaggcttccggccgccgcagcctccacgccacgtcgccgggagcgaaaggagatcaccggaagaggggcgcggagatgagcgggagcgcgttcaacgcgttcaagtcgcgggtgccggtggcgtggagtccccggctgtacatcactctggtgcggggcctcccggggacgcggcgcctccaccgccgcacgctcgaggccatgcgcctccgccgctgccaccgcactgtcgagcaccgcaccacgccgtcgctcctcgggatgctcacccaggtgaagcgcctcgtcgccgtcgagacggaggagatgtacaacgcgcggaagcaggccgaggcggagaggcgcgcgcccagacccccgctcgtcgtctcccaccacccgccgccgccgacaccgaagccggcagcagccgccgcggagggtgccgctaccactgcgcagtagcctttgggcattggaagcctttcatcacagttcagcggcataataattaacttgcttgtgtttgggtctgctggtctccagacgatagcattggatgatctagcaaccgatatgatctcaagatcgttgtatggtccgacttgcattgggcctgtattttagattgttatatggactgaggtcatagttttccggcgcctttggctacaatcaagttcagtgatttggtttcaattactaatttttctgaaaatgctctttacgatgtgtaggcttcttgtgtagttgaaccataggagtgctggcatctatatttgctcagttatgattgttgatgttggccattagcaaaaggttttgtaacattgcttgggttctgggagtgaaaaca

SEQ ID NO: 121 - DNA, 1165 bp, Sorghum bicolor
cccagattctgacaacgccttcccaacccgcatcgacagcgcgcacttggattcggcgacgccggagcgcggaggaggcaagcgccgatccagagacgatggccgccgcgggctcctcgccgtcatcctcctcaagcaagcggttggaagggaaggtggccctcgtcaccggtggcgccaccggcatcggcgaagccatcgttcgcctcttcacggagcacggcgccaaggtctgcatcgcggacatccaggacgaggccgggcagcagctgcgcgacgccctgggaggcgacgcgcagggcgtcatgttcgtccactgcgacgtgacgtcggaggaggacgtgagccgcgccgtggacgcggcggcggagcggttcggcgcgctggacgtgatggtgaacaacgcgggcgtgacgggtgccaaggtgacggacatccgtgccgtggacttcgccgaggtgcgccgggtgctcgacatcaacgtgcacggcgtgttcctggggatgaagcacgcggcgcgcgtcatgatcccgcagaagcggggctccatcgtgtcgctggccagcgtggccagcgccatcggcgggctgggcccgcacgcgtacacggcgtccaagcacgccgtggtcgggctcaccaagagcgtcgccgcggagctcggccgccacggggtgcgcgtcaactgcgtgtccccctacgccgtgcccacggcgctgtccatgccgcacctgccccagggcgcgcgcgccgacgacgcgctcacggacttcctggccttcgtcggcggcgaggccaacctcaagggcgtcgacgccatgcccaaggacgtcgcccaggcggtgctatacctggccagcgacgaggcgaggtacgtcagcgcgctcaacctcatggtggacggcggcttcacagccgtcaaccataacctcaggccattcgatgattagctcagcttgtttagcagcattattatcactcttgttctgctgctactcttgagactttttctttttgaactgtaacaagtgtctgtaagactaataaaccgcatgttacatgattggacattctaagcgacaatgccgaattcgcgtatggtatatggttgctgaatgtgctaacaaatgagttttcagcagtgcctaaacaggcaggcagtgatcag

SEQ ID NO: 122 - DNA, 957 bp, Sorghum bicolor
cacagacccatctccaaaaggccaaaaccccaaaaccctcgttctcgttcccccattgccattatccgaacccaagccgccccaggggtccgaccacagaaccgagcccaaaaatggcggccgcctcctccatgctcaccgccgcgtcgctctccttctccccgctcccagctccgcgcctcccggccgccgcctccttcgctccgccgcgccgcgcggcagccgcactcgtcgtgcgcgcggcggccgcctcgtccaagtccccggccgcggcggagacggccccgaagaagaagagggcgaccggcatcacccagccgaagcccgtgtcgccggcgctgcaggcaatcgtgggcgaaccggttatcccccgcaccgaggccctcaagcgcctctgggcctacatcaaggagcataacctccaggatccttctgacaaaaaggtggtcatctgtgatgagaagttgaaggtcctgtttgctgggcgggagcgagttggattccttgagatcgccaagcttctcaaccctcactttgtgaagtgagaaggcactcccaggagttgagttggcctatggatggtcacttgtgatcttgacagtgcgtgggttggtttttggtagactcagaccctgagttagctcgacttagtagaatgctgtagctcttgcagacgatgttagtgtgtgcgcccttcgtggtggtctggtggtagttatataataaatgactggttgttcctagtagccttcagctcgtatgcagttagcctgtgctgtgggaagtaatgtgttctgctgttgtttaagcattgcccagtcaacattggcagattagtccttgtccttgcaatgggtatataaggatattgtcgtgcgatttctcattcgacatggattggtaattggttgtttcattctgatttatctggtgagctatcaacttattagtagagtg

SEQ ID NO: 123 - DNA, 1564 bp, Sorghum bicolor
atctcagctggaccatcatgtacaatcgcaactagtatatatcatcaaatgccatgcgtgtgtgcaagtgtaagttgtgcacacacaacaatatagggcgtgtcttgtcttaagccagcacgcagctccgatgacaagctgcttcaacggcggcgccggctggccggagcccgtggtgcgcgtccagcatgtgtcggacacctgcggcgacacgatccccgagcggtacgtgaagcctccgtcagagcggccctgtctctcaccagcagcagcctcctccggtggcgtcggcggcggcggcggcggtggcccgaacatcccagtcgtagacctgtcaatgctagacgtggacgcgacctcccgcgctgtggcggcggcgtgccgcgagtgggggtttttccaggcagtgaaccacggcgtccggccggagctgctgcgcagcgggcgcgcggcgtggcgtggcttcttccggcagcccgcggtggtgcgcgagcgttacgcgaactcgccggcgacgtacgagggctacggcagccgcctcggcaccgccaagggcggccccctcgactggggcgactactacttcctccacctcctgccggcgtcgctcaagagccacgaaaagtggccttccctcccttcctctctacgggggacgacggaggagtacggcgaggaagtgctgcagctgtgccggagggtgatgcggctgctgtccagcgggctggggctggaagccggaaggctgcaggcggcgttcggcggagagggtggcgaaggggcgtgcctgcgggtcaacttgtacccgcggtgcccgcagccagagctgacgctgggcgtggcggggcactcggaccccggcggcatgaccatgctgctggtggacgaccacgtcaagggactgcaggtgaggagccccgacgggcagtggatcatcgtcgaccccgtccccgacgccttcatcgtcaacgtcggcgaccagatccaggtgctgagcaacgcgtcatacaagagcgtggagcaccgggtgacggtgagcgcggcggaggaccggctgtctatggctttcttctacaacccgcgaagcgacctgcccatcgcgccgatgccggagctggtggggcccggccgcccggcgctgtacccggagatgaccttcgacgagtaccgcgttttcatccggcaacgcggtttggccggcaaggcgcagcttcagtccctgcaggccaatcaaaccgccgccgccgccgccgccgccggctcgtcgtccacctgcagctagcagctactgagctagctatatatatatacgtatcatcatcggcaaggccagctggtttcagttagctgtgctgtgcttaatcatcgatcgttggatcgatcgatcggtgaataataatttgatgtttaatttctacagaaatataatgctgtggtgtacattattcatcccatgtaactgatcagcagtaaaataagtgtgtggaactctctcgttgctacttggtctcttactctggagttcaagagagaagtcatgtaaaccaggataatgatccaaatc

SEQ ID NO: 124 - DNA, 1658 bp, Sorghum bicolor
cgtgctgccattacatataccgcacctgcattttccttccctcaccagctgcagctccgaccaagctagctgccttcatctatcgagtcaccggtcacatcacagctgatatcgaggcgacgcgccggtcgccggcgaggtgctccatccagctcccaccaaaaaccactaatagccatggcgcggctcctcctcctcctcggggccgccatggtgctcttggcgtccgcggccacggcgcaggactgcctgtccgcgacgttcagcggcgggcggaccttcggcaagtgcaacagcatgccgacgctcagcgccagcctgcactggacgtaccacccggagaacggcaccgcggacgtggcgttccgcgcgccgtcggacaccagcggctgggtcggctggggcatcaaccccactagcggcaacagcatggtcggcagcagcgtcttcatcgcgtcgcaggacagcagcggcgtggtgtccgtcctcatgacctacctggagaccacaagccaacccgcactaaccaacaacaccttcaagttcaacgtgcccatcggccccgccgccgagtactccgacggcgcctacaccatctacgccaccgtagagcttcccgggaactccacgcagcagtacacggtgtggcaggccggccctaccagcaacggtgccatcgcccaacacccgctttcgccatccaacagggcaagcacccagagtctggacttcctctcggggtcaagcaccgccgcgtcaaactccaagcttcaccgccgtaacattcacggactgctgaacgcgattgcctggggcatcctgatcccgatcggcgccatcatcgcccggtacctgcgcgtgttcgagtcggcggacccggcatggttctacctgcacatcgtctgccagtgctccggctacatcctgggcgtggccggctggggcctggggctgaagctgggcagcgagtccgcgggcatcacctacaagccccaccgcaacctcggcatcgccatcttcagcctggccaccctgcaggtgttcgcgctgctgctcaggcccgacaagaagaacaagtacaggctctactggaacatctaccaccactccgtcggctactccgtcatcgtgctcagcgccatcaacatcttcaaggggctcgacatcctccagccggccagcgggtacaagaccgcctacattgtcatcctggccacgctcggcggcatcgcgctctgcctcgaggccatcacctggcccatcgccatccggaagcgcaggcggaacgccgccgacaaggcggccgtcggcaacggcaacggctggcagcagggtgcgtagggagtaccagatatcatcgccgggcgtgtgcatagcacagtgcgtgcgtgtgtgtgtgtgttttgatgcgagggaggaatgtgacatcgatgtgctgatggcgttgttcagagagatttgttgcagtgtgtgtgttctttattgttactactagtagtctagtaccgctgggctctgtagaaggtgtagctcctttttcttctggtttattttactagggttctataatggcatttgtacacatttcttcttcttattattattgatgtacgattactttgattagtgtatggtttcgatcagatgacggcttcctt

SEQ ID NO: 125 - DNA, 2722 bp, Sorghum bicolor
atccaaatggtgcttctgtcaactgtcaggtgggacggggggacgggggcgtggtgacgtcggaagctgccgtgcggccgcagtgtcgtttcccgcaacgcaacgaccagcggcagcgtggcgatccgcccccaccgctcttccctccgctccgccctcgcactatttctagcaccgccggagccgggctggacacttctcatctcccatctcctctgcttcccagtccccgcccgccgtgagagcccgccactgctgcatctcaagggtcagaggttgtaccgatcatcgctgtggccttcgccgccggccgccggcgcatcaaccaccgcgccggcacgggcgcatgcaggtgacattccgctctccggctctctccgccggacgtgggtgctcccccggaacaaaacgcctacctactctctcggcaacgtttctggaagttcgttgaggcatcaaagaattgcctgccctgcgccgtgcgcgtgtgccgtgtgacggcgcggccgggatgggcaagatgaactgcttctccggcctgctcagcggcaagaggaaggcatccaagggtaagaacaagggcgcttacgtcaagaagggtagtggcaatgattgtcccaaggtgaagccggtggagttcatggacatggcggacactgttgtcgacgacgtcgtcagcagaggcggagacagcagcgttcctgcgtctgcatgcaacagtaggtttgtcgttcacgcagccgcccagctgccacgccatgccagtggcgagaatggcgacaaggccgcagctaagaaggagtcgtccgccgccgacgacgacctcgtcgccggcgttggctcctccggtcacagcagctacggaactggcaacagcgatgccaagagcaccgagccggacgacggcgagcgctccagccttggccgcatgtcgccaacggcatcgccgaagctgatgcgctcctgctccaacatcgagacgacgaggtctgtcgtcccggcagggtccgacctgccggcgaagtcgcgctcctacaacgacctgaagatcctgcctcccggaaggtcgaccgccgcccgcagcggcgcgatcgacgcgagcccgacggcgtccttcaggacctcgtgctccgccgaccgcgtcatgctgaagaagcggtcgtcgaggcaggtgctcccgtccaggagccggaagctgtggtggcagatgttcctctggagccaccgcaacctgcaccggccgggcgcgagcgcgaccatgcccacgctgctgccgccatcgccggggcaagaagaagaagaagaagaaggcggtgccgcgcaccagcacgacgggtacacgtccgacacgctgggcgcggtcaccgcggacgccaagaacaaaggcgtcgccatcgaggcggaccccattacgagccagtgggtcgcgttctccgccgaggcctcgccgctggaccgggtcagcgcgtgggtgaacagcctcggggacggctcgttccacgccgtcgacgaggacgatgccacggggcacggcagcggcggcgaaggcgccgctcgcccgcgacggcagcggtgctccgagatcgtggagctgtcgacggcgacggccggcggcaagaggaacccggaggcgaagcggcgcgcggcggacgaggctgcccaggcgagcggcatcgtgcagacgctcaacaccttctcctccgtcgcccacatcgccggcatggggctcaagaccgtcccgacgattgcggctttctcgaccctccgtgccgtcaatctgtctggaaacacgattgttgaaatcagcgctggatcgttgcccaaaggcctgcattcgctggatctgtcgaggaacaagattgcaatcatcgaggggctgcgggagctgacgaggctgcgggtgctcaacctcagctacaaccggatctcacggatcgggcatggcctgtcgagctgcacggcgatcagggagctgtacctggccgggaacaagatcagcgacgtggaggggcttcaccggctgctgaagctggccgtcctggacgtgagcttcaacaagatcaccacggccaagtccctgggccagctcgtggccaactacggctcgctgcgggcgatcaacctgctgggcaacccggtgcaggccaacaccggcgacgacacgctccgcaaggccgtgtcgggcctgctcccgcggatcgagtacctcaacaagcaggccgtcaagccgcagcgcgcgcgggaggtggccaaggacagcgtcgcgcaggcggcgctcgggaacgccggctggaactcgcggaggcggctcacgcggcgcctcagccagagccccgggtcggcggggaagggcggccggggcagggacggcaacggcaacggcagccgcaggggcagcaggagcaggtccatgaccaggccccagagctcgagcttgccaaggagatgagaggcaaaacgtgcgacgtacgtactgataaaaaaaaatggtcttcggcttgaagagggagaagaaacaactctatgcgtttaaactgcatgcaatgcaatgttgtgatgagcttgagtttgacgcattttcccgaaccttttttgacagcacaatctgttgccagttagcgatgtctgtagcttctagtagtactaccgtccaaggaggacgtctcaaatggaaaaactgtttagtggctaccatttgattgcttgatcttgtttgttttct

SEQ ID NO: 126 - DNA, 1455 bp, Sorghum bicolor
gcggcgacacccacacgccaccgttgcttcttcctgcttctcctcccggcacaaggcacagccaccatcaccatgtgggtgacgtcgtcgatgccgcaggtgtgggacgaggaggccgcggccaagggcggcggcgcggcggcggtgacccccgcgccggcggcggccatgctgggctcgctggcggggtggctgtcgcggaccgtgcagccgcagccgcccccgccacgggtgtgcggcaccgagggaggaccccccgtgacggcgcccaggctcaggctccgcgacggccgccacctcgcctactgcgagagcggcgtgcctcgcgaccaggccaggttcaaggtcgtcttctcccacggcttcaccggctcccgcgaggacagcgtccgcgcctcccaggaagtggcggaggagctgggcgtgtacatggtgggcttcgaccgcgccgggtacgggcagagcgaccccaaccccaaccggtccgtcaagagcgcggcgctggacgtggaggagctcgcggacgcgctggggctcggccccaagttctacgtcatcggcatctccctcggctgccatgccgtctggggcgccctcaagtacatccccgacaggatcgccggcgcggcaatgatggcgccggtggtgaactactggtggccagggttccctccggagctggcggcggaggtgtacgcgaagcaggaggtaggggaccagtgggcgctgcgggtgtcgcaccacgcgccggggatcctccactggtggatggaccagagctggctgcccacgtcgacggtggtggccggcacgacgccgctgccgaacgcgcgcgacgccgagatccggcgcaacatgcaggcggacggcacgttccagcagaagcgggagcaggcgacgcagcaggggatccacgagtcctactaccgcgacatgaccgtcatgttcggcaagtgggagttcgaccccatggcgttgccggagccgccgtgccccgtgcacctgtggcagggagacgaggacggcctcgtccccgtcgtcctgcagaggtacctcgccggcaagctcgcctgggtcaactaccacgagctccccggcaccggacacttcctgtcggcggtgcctgggctcggagacaccgtcctcaggacccttttcggtcagaagcagtagcaacaaacagttcattacgacgacgtatggacggtgctaagcttaaagtatactagtagtgtcagtcgtggcgcattagttcatttgttattgtaaggccgatggttgtcgctgattagcgatgataatggtgatgtagatgcaggatctttaaagtcaaatactatcagatatatacaaatactagtcatacggtgatgtgatactgtttagggtgtgaacgagcataacgcaacacataggagtactaaagtattttttttgaaacgataagaaaggtgt

SEQ ID NO: 127 - DNA, 993 bp, Sorghum bicolor
gcgaagagataagcccgggtaaagccggtgagccgcaacagtcgccgatgtcgccgccgccgtcgcctctcgtggtgctccccatcctcctcctcctcctcctcctcctcgccgctgcatccccctccctcgctgcggccaatgcggcaggcgccgttgcccctgctccggtgccgacgccgtggccggagcagttccacgcggtggtgttcaccaacctcaccgagagcggcggccggctgcagctgatcgacctctactacgactggcccaggggccgcaacctcaacctcatccgggaccagctctccggcgacccgctctacgacgtcgagtggaccaacggcacctcctactacttcgactccgggtcctgccgcaccatccgtttccccgtgggcctcctgccgcccgactggctcgccgccggcgccgtctacctcggccgcgagcacgtcgacggcttcgactgccacctctggaccaaggtcgacttcgtctggtactacgaggaagtcgccaccggccgccccgtccgctggaatttcttcaatgggatgcagcagcatgtgatgagctttgaggtcggaggagtgctggaagactccaagtggcaggcgcctgcttactgcttcaatggcggcaatgccgacaccaccaatgtggctgcaggtggagttgatagcgaagccggtagggttgatgtgatgaacagcatgatcaggttcgccggggctccagctgcagctgtagctgcatcatttgaccaatgagaattttcttttttttgatgaattggctgatgagaggctttgccaacggtgatccacgtcctgttgattctgttatgctctgttaatcgcattgtgctttgtataaccctgattgatttggggtaacagtcactctacatttcctggaactggaaatttgatgagtcgtagctgctactattttcttggagaatgcaaggttcatgatcgttgctgttcc

SEQ ID NO: 128 - DNA, 1649 bp, Sorghum bicolor
gtttaccggttaacccacacaaattgccgccaccaccactggacacgacatcgtacaaccccagcctcattccagtggggccgcatctcagatctctggtggtggacgacacccgccggccggccagcttctccggccaaccgttccccgcgcaaaacttgcactgacgaagcctggtaccttctcatccggcggcggcggggccatggggttctcgctgtaccccaccaagtcgtcgacgcgcatgccgtggagcaccagcttcttccgccacaagttccccgccgccgccgccgccgcgccctccttctgatcaggctagctccggccgcctggcgacctccgtgccgtgcttcaacaagaggacaagaggtggaggagcatactgcatacatacagacgttcagtacatacatagagtttctttttttttttggttcgtgttagtccttggtgcatggactacgctcgtagcatgatcagcagctccgctgtgccattccgtgctgccggcgacggcgatggcggcggacaggtgtttctctttggcggccgcggcggcggcggattccttcgaggattgccgttggtgggtggcgccagcgctgctgccggtgcggcggcggacggccggcgcaagcgggcgtttcagctaacgacggcgcacgaggagccgcagctggagctgggcgacgacgagctgtgcggcggcttcgactacgagctcctccacgggccgcagcagcaggagcggacgaagcggcggctgacggcggagcaggtgcgggagctggagctgagcttcgaggaggagaagcggaagctggagcccgagcggaagagcgagctggcgcgaaggctcgggatcgcgccgcgccaggtggccgtgtggttccagaaccgccgcgcgcgctggaggaccaagcagctggagcaggacttcgaccgcctcagggccgcgcacgacgacctcctcgccggccgcgacgcgctcctcgccgacaacgatcgcctccgctcacaggtgatcacgttaactgagaaactgcaagcgaaggagtcgtcggcgtcagagccggaagagtttacagttgccactcaagagacagcctatgctcttttcgaagaagacaagctctgcctctgctccgagatcgccaccggcagcactgcagcggcggcgccagggagcaacgacagcccggagtcctacttcgccggtgcgtgctcgcctccgtcgtcgccagaggacgacggctgcggtggcgccgacgaccgcaccttcttcctcccggacgccctgctcgccacgggcgtggaggagagcctcgagcgcgctgccgaagaggacgatggcgctgggacgcagctcaacaactgggcatggttatggaacgatcagcagtattagggaatgcacgcatgatattattgcagtgcaaatttggtctcgagctttgctgatgttgatacggtgtattctgctaattggccaggtggttgatttatgcctccacattgttcactgacatttctcacatcagtaacgtttgaggtgtaaaatggccaaagctgggccggatatgtaactaaatggagaactaaattactttgaataaatgggccaaggcccttgttttgactctcag

SEQ ID NO: 129 - DNA, 1708 bp, Sorghum bicolor
gcgtcgtctcacgctcacgctcacgctcccctcgcctgcgtcgcctccgatcgaatcaggtcggttgctctcgtgcccgatcccgtgtcttgtcctgtcttggctcccagccaggaatagcgcaacgagacgagatcggagggcgacagggcgtggccgcgaggggaaatgggatcggagggacgggcctggaacggcgccgccggcagcagcggccatggcggcggcggcggcggcgtagaggcgaaagcgatcaccgcggctctgtcggccgcggaggttcccaggatggcggtctccgtcgacatctcgctgccgctcccggagatgtcgcctgacatcatatatctctgcaagcaattggtcattgggtggtgtaagattgacagctcccgcttctccatcgagaccgtgtccggaggcatcaccaatctattgctcaaggtttctgtcaaagaagacgacggcaatgagtctgctgttactgtccggttgtatggaccgaatacggacttggtgattgatcggaaaagggaattgaaggcgataccgtatctctcagctgcagggttcggggctcagctacttggaatatttgggaatggagtagttcagtcattcatctatgctcgaacactgtcacctgcagacatgagagatcctaaaatagcagctgaaattgccaaggagctacataaattccatcaagtagacataccagggtctaaacaaccgcaattgtggaatgatatattcaagtttttgaagaaagctgcagcattgaagtttgaggataacgagcagcagaagagatatgaaaagatctcatttagagaaatacaagatgaagttcaagaacttaaggatctcttggacactatgcatgcgcctgtggtttatgcacacaatgacttgctttcaggaaatctgatgctcaatgatttggaagggaagctatattttattgattttgagtatgggtcatacagctaccgtggctatgacattgcaaatcatttcaatgagtatgctggacttgattgtgactataatttgtacccagataaagatgcccagtataacttcttcaggaattatctacgccctgatagacctagtgaggcacaggcacaagatatggaagtactttatgtggaaacaaacactttcagactagcatcgcacatttactgggcattatgggcccttattcaggcaaaggtatccccaattgactttgactatcttggatacttcttcttacggtatggtgagtacaagaaacagagggagccctgcttctccttggcacaaagctttctctccaagccaagaaatgtctagagcctgagaatctgttcatgagtttatactgttgtgcgcatatactcggggcgggtacgccttgtgatcatctgctgctactcagaaactctattatagtgttggtagcagccccgcattgttgtatccgatgttaggttcgtcattgcctgataggaaagtcgcatgatccgtcctcgggagcacagggtggcaagatctgttatatttgtaataaacacaatcctggagggtcctgccctgtgcaatttgttgtgcacataagcattccgtgtacattcttgtgacgaactgcataagtatttttttactaaatcatatattgtttttcatgactgggtagtcctttggatgtgcgcgtaca

SEQ ID NO: 130 - DNA, 1392 bp, Sorghum bicolor
tgttgtttagaagctgctgccagaggcccagagccatgccaaactggccaaccatattgttggtatggtcatatggagaaacctgcgagttgcttctctctcgggttcggcagatgccatgcctgctgtattcctctttgtggcgatctctagctgcgacctgtgactgtgagagcccatgccaaactggccaagcatggtatggagaaacctgctggagttgcttctctctcgggttcggcagatgccatgcttgctgcattcctctttgccgcgatttccagctgcgacctgtgactcagagagtgaatggcgcacctgctctgtctcagacttcgctggggcctggccagggagccagacagcaggcagccagtcatggcgcgtacaagggactcaaaattcccgccaaatcagcaggcagccactgcgtacaagggactcaattcccgccaaatctgctgaaatcccgaatccgtggtatatcccaacaaaaagtgggtcacactccgcagcaaaaccatactcctcgtcctcgtctcctcgtgcctgacaccacttccactggtcctcttcgctcttgtgctcacggaaccacggccgtctccctgacgcggagctcgcccgcagccgcaatgtcgtggctcctggtcgtcgcggtgcttgccggcttcgcgcttggtccgtccgcgggcacggaccacatcgtgggcgccaaccatgggtggaaccccaacatcaactactccctctggtccggcaaccagaccttctacgtcggagacctcatctcgttccggtaccagaaggggacgcacaacgtgttcgaggtgaacgagacggggtacgacaactgcaccatggccggggtcgccggcaactggacctccggcaaggacttcatcccgctccccgaggcccgccgctactacttcatctgcggcaacggcttctgcctgcaaggcatgaaggtcgccatcaccgtccacccgctcccgcacaacgccacctccaagggctccagcacccgtgggggcaccggcgcacaggaagaggccgccgcggcggcgcttggggccaggagcgccgcgtggctggcgacgctcgcagtcgccgcagtgtctgctatctgctaggagctttattccaagcattctctgagcattgttctactgtagtattttgtggtttgcttttgtcgccatgtcatttgtgttttttaactcctctgcaagtaaatctgcttgagaagccaagctaactttctgacaactcatcaatgcatttcacaaaaccccagtttatgaaccaacatgccatgtattacaggttgcgacggctctgaacactagaaagaaggaaggaacaaaccctataagagattgtcgaata

SEQ ID NO: 131 - DNA, 2050 bp, Sorghum bicolor
actccattcgttcgcctctgagctcgcagacgttctcagggagctcgtgaacactcggatctccgtcctcggcagcttttctgcgagtagcagcttcttgcgaggcagagtcttgcgtcttcctgcttgaggtttctggttgggtcgcgatggccggcggcgtggttgtgaacgccggagggggaaaggactaccccggcaagctcaccatgttcgtgctcttcgcctgcatcgtcgccgccaccggcgggctcatcttcggatacgacatcggcatctccggtggcgtgacgtcgatgaacccgttcctgatgaagttcttcccgtcggtgtaccacaaggagcaggaggcggagcggaaccagagcaaccagtactgcaagttcgacagccagctgctgaccatgttcacctcctcgctctacctcgccgcgctcgtggcctccttcgtcgccgccaccgtcacccgcgtggccggccgcaagtggtccatgttcggcggcggcgtcacgttcctggtcggcgccgcgctcaacggcgccgccaaggacgtcgtcatgctcatcctcggccgcgtcctcctcggcatcggcgtcggcttcgccaaccagtcggtccccgtctacctgtcggagatggcgcccgcgcgcctccgcgggatgctcaacatcgggttccagctcatgatcaccatcggcatcctgtgcgccaacctcatcaactacggcaccgccaagatcaagggcggctggggctggcgcgtcagcctggcgctcgcggccgtgccggccgccatcatcgccgtgggcgcgctgttcctgcccgacaccccaaactccctcatcgaccgcggctacaccgacgacgccaagcggatgctcaagcgcgtgcgcggcacggaggacgtggaggaggagtacaacgacctggtggccgccagcgaggagtccaagctcgtggcgcacccatggcgcaacatcctgcagccgcggtacaggccgcagctcgtcatggccatcgccatccccatgttccagcagctcacgggcatcaacgtcatcatgttctacgcgccggtgctcttcaagacgctgggcttcgccgacgacgcatccctcatgtccgccgtcatcacggggctcgtcaacgtcttcgcgaccttcgtgtccatcgtcaccgtcgaccgcctcggccgccgcaagctgttcctgcagggcggcacccagatgctcgcgtgccagatcgtcgtcggcagcctgatcggcgccaagttcggcttctccggcgtggccgagatccccaaggggtacgccgccatcgtggtgttcttcatctgcgcgtacgtggccgggttcgcctggtcctggggacccctcggctggctggtgcccagcgagatcttcccgctggagatccggtcggcggggcagagcatcaacgtgtccgtcaacatgctctgcaccttcatcatcgcgcaggcgttcctccccatgctctgccgcttcaagttcatcctcttcttcttcttcggcgcctgggtcgtcgtcatgaccatcttcgtcgcgctcttcctgccggagaccaagaacgtgcccatcgaggagatggtgctcgtgtggaagtcgcactggtactggggccgcttcatccgcgacgaggacgtgcacgtcggcgccgacctcgagatgccatccgccaacggcaacggcaaggtcggagcgggcaagctcgtcggcatgcagtagccatggcggcgcctgggcgtccctcgctgctgatgcctgatggtgggcaataatctactcatacagtactccattattcttggggtttagcgggaaatttgaaacttttaaggattcatcatcacttcactgtattataatcgtctcattaggtaggatgactggatgatgacgagcagtcaactagtcttctgtcttcgtctttttctttttctttttctctctgtgcggatgtggggtttaattatatttggaacagatcaaatcaaatatgaatatcaattgcaagttgcaactgcagaacc

SEQ ID NO: 132 - DNA, 7150 bp, Sorghum bicolor
atcgaatcaaatcagtttcagggaggggaaggcaaacccctaggccctaacccaccactcactccaccgcgacgagtcctccgccgccggagagcgcgaggaggacccttcctcgacctgccgcacaaccaaaggtataccgagtctctgctctctctcccacactgccgctcctcttctgccaccctattgcgctgcgttgtctcggctctccagattagatggctagggttttcagattcgataaattgtcctgctgattccgcctcaccttccgccgttgcagctcccatggccaacctcggcggcggcgccgaggcgcacgcgcggttcaagcagtacgagtaccgcgccaactccagcctcgtcctcaccaccgactcccgcccgcgcgacacccacgagcctaccggtgagcccgagacgctctggggcaggatcgaccccaggtccttcggcgaccgcgccgtccagaacaagccgcccgagctcgaggagaagctctccaagtcgcgcaccaagaagtctaagcgcgacgctgctgctgcggcggaccccgccgacctcccccgtcgcgacgccaagcgcaggcgccgcgccgcttctacccaggaggtctccgtcctctccctcaccgacgacgccgtctacaagccccagaccaaggagacgcgcgctgcctacgaggccctgctcagcctcatccagcagcagcttggcggccagccccttgacgtcctcgccggggcagctgatgaggtgcttgccacgctcaagaatgacaaggtcaagaaccctgataagaagaaggacattgagcagctgctcaaccctatctccagccagctctttgaccagcttgtctccatcggcaagctcatcaccgacttccatgatgcggcggccggtgacgctgccggtgtgccttctgccgatggcacggacaccaccctggatgatgatgttggtgttgctgtcgagtttgaagaagatgaagatgaggagagtgattttgatcaggtgcaagatgacctggatgaggatgatgaagatgacatggctgagttgaatggtcctggaggtatgcagatgggcggcgagttagacgatgatgacatgcagaacgccaaccaggggctggccgtcaatgttcaggacatcgatgcttactggctccagaggaagatatcccaggcatatggggatggggacattgatgcccagcagagccagaagcttgccgaggatatcttgaagatcattgctgagggcgacgatagagacgtcgagaatcgccttgtcatgctcttggactatgagaagtttgatctcattaagttgctgctgcgcaaccgtctcaagattgtttggtgcacccgcttagccagggccgaagatcaggaacagaggaagaagatagaggaagagatggcaagtgacccaagtttggctccaatattggagcagctacatgcaaccagagcatctgcaaaggagaggcagaagaacctggagaaaagtatcagggacgaggcgaagaggctcctcaacaatgatgctggcgctgatggtgccagggaccgcagggcagctgagcgggacatggagagtggatggctgaaaggacagagacagctgcttgatctcgaaagcctctcgttccatcagggtggtctctttatggctaacaagaaatgtgaactgccgactggatcgtttagaacccctcataaggggtatgaggaggttcatgtgccagcactgaaggctaagccctatgaaacatcggagaagattgtcaagatatctgatatgccagagttcgcacggtcagctttcgatgggatgacccagctgaacagagttcagagcagggtctatgatactgctcttttcaaaccagacaatatccttctctgtgctccgactggtgctggcaaaacaaatgtggctgtgcttaccatccttcagcagatcggtctgcatatgcaggatgatgggcagtttgataataccaagtacaaaattgtctatgtggccccgatgaaagcgttggttgctgaagtcgttggaaacttgtcgaatcgtttggcaggttacaatgttactgttagggagctcagtggagaccagaacttgaccaagcaacagattgatgaaacacagattatcgtcacgacacctgagaaatgggatattgtgaccaggaaatcaggggacagaacctatacccaaatggtgaagctgttaatcattgatgagatccatctgctacatgataacagagggcctgttctggagagcattgttgctaggacagtcaggcagattgagacgaccaaggagcatattcgtctggttgggctctctgcgactctaccaaactatgaagatgttgcattattcttgcgtgttcgcaaagaaagcctcttctattttgacaacagttaccgaccttgccctcttgctcagcaatacattgggatcactgtgaggaagccactacagaggatgcagttgatgaatgagatctgttacgagaaggttatggctgccgctggtaagcatcaagtgctgatatttgtacactcaaggaaggagacggcaaagactgccaaagccatcagagatacggcgttggcaaatgacacagtcagccgctttctgaagaacgagagtgcaagccaagagatccttggcactcatgctgaacttgtcaaaaacaatgatcttaaagaccttttgccttatgggtttgctattcatcatgctgggatggcaagagttgaccgtgagcttgttgaggagctttttgctgacaagcacattcaagtacttgtatccactgctacccttgcatggggtgtcaatttgcctgcacatactgttatcataaagggtacgcagatttacaacccagaaaaaggtgcttggacagaactaagccctctggatgttatgcagatgcttggtcgtgcaggaaggcctcagtatgatacacatggagagggaataatcttgactggccacagtgaattgcagttctacctgtctcttatgaaccagcagttgcctattgagagtcagttcatatccaaattggctgatcaattgaatgcagaaattgttctggggactattcagaatgctcgtgaagcatgctcgtggcttggctatacttacctctatattcggatgctccgcaatccaacattgtatggtttgccagcagatatcttggagagtgataaaacgcttgatgaaaggagagctgatttgatacattccgctgcaaatctactggataggaacaatctgataaagtatgacaggaaaacaggatactttcaagttactgacctgggaaggattgccagttattactatatcagtcatggaactatttcaacatacaatgagtacctaaaacctacaatgggtgatatcgaactgtgccgactgttttctcttagtgaagaatttaagtatgtcggtgtcaggcttgatgagaaaatggaactggctaagcttttggatcgtgtaccaatacccgtgaaagagagcttggaggaaccaagtgcaaagatcaacgttctgctgcaagcatatatttctaggttgaaactggaaggcctttctcttagttctgatatggtctacatcagacagagtgctggccgtctcttacgagcactatttgagattgttttgaagaggggatgggctcaactagcagagaaagcgctgaatctttgcaagatggtcgataaacaaatgtggagtgttcaaactcccttgcggcagtttactggaattccaaaggagatcttgatgaaactcgagaagaaggagttggcttgggagaggtactacgatctgtcctcacaagaaattggtgaactgatccgctatcccaagatggggaggcagctgcacaagtgcatccaccagttaccaaagctgaatctttcagcccatgtccagcccattactcgtacagttttgggttttgagctgacaattacacctgattttcagtgggatgataaggtacatggatatgtggagcccttttgggttattgttgaggataatgatggcgagtacattcttcaccatgaatatttcatgcttaagaaacagtatgttgatgaagatcatacattgaacttcacagtgccgatatatgagccactgcctcctcagtatttcattcgtgttgtgtctgacaagtggcttggttctcagacaattctccctgtctgctttaggcacttaattctaccagaaaaatatgctccaccaactgaattgcttgatctgcagcctctgcctgttagtgcattgagaaatgcaagatatgagggcctctatagtgcttttaagcatttcaatcccatccaaactcaagtattcactgtcttgtataacagtgatgacagcgtgttggttgctgcaccaactggcagtgggaagacgatatgtgcggagtttgctatactaaggaaccaccagagggcagtgtctggtgagagcaacatgcgggttgtttatatagctcccatcgaaggtcttgcaaaagaaagatacagggactgggagcggaaatttggagagtttgccaaggtagtcgagctcactggtgaaacagcagctgatttgaagcttctggataaaggtgagatcataatcagtactcctgaaaagtgggatgcactgtctcgccggtggaaacagcgaaagcacatccaacaggtcagcttattcatagttgatgaacttcatctacttggatctgataagggacatgttttggaagtcattgtatctaggatgaggcgcatttccagtcacattggcagtaacatacggatcgtagcactttcagcatcacttgctaatgctaaagatctcggtgaatggattggtgccacttctcatggccttttcaacttccctccagcagtgagacctgtgccattggaaattcatatccagggtgtggatatagcaaactttgaggcaaggatgcaagcaatgacaaagcctacctacactgccatcacacagcatgcaaagaacagtaaacctgccctggtgtatgtaccaacaaggaagcatgcaaggttgactgcactggacttgtgtgcgtactctagtgttgagggtgctggaacaccatttcttcttgggtcagaagatgagatggatactttcaccagaggtgtcgaagaagagacgcttaagaatacacttaaatgtggtgtaggctatttgcatgagggtctaagtgagcttgatcaggaacttgtaacccagttgttccttggtgggaggatccaagtgtgtgttgcaagcagcacaatgtgttggggaagaccattgcctgctcatttggttgttgtcatggggactcagtattatgatggccgggagaatgctcacaccgattatccaattacagatctgcttcaaatgatgggtcacgccagcagaccacttcaagataactcagggaaatgtgttatattgtgtcatgcacctcgcaaagagtactacaagaagttcctttttgaggccttccctgtcgagagcaatcttcaccatttcttgcatgatcacatgaatgctgaggtggtggttggtgttgtagaaaataagcaagatgctgtggattatcttacttggactttcatgtatcggcggttgacaaagaatcctaacttctacaatcttcagggtgtaagtcacaggcatctgtcagatcatctttctgagctagttgagactgtcctgaatgatcttgaatcaagcaagtgtgtggctatagaggaggacatgtacctgaagcccctcaaccttggccttattgcttcatactactatattagctacacaactattgagcgttttagttctatgctgacccagaagactaaggtgaaaggactcctagagattctagcatctgcttcagaatatgcagagcttccgggtcgtcctggtgaggaagaattcattgagaggcttgttcgccaccagaggttctctatcgagaaacccaagtatggcgatccacatgtgaaggccaatgctctactgcaagcccatttttcaaggcacacagtggtcgggaacctggcagctgatcagcgtgagattctcctttctgctcataggttgctccaggcaatggttgatgttatatccagcaatggttggcttagtcttgctcttagtgcaatggagctgagtcaaatggtgacacaaggcatgtgggatcgggattctgtgctgcttcaagttccacacttcacaaaggacttggctcggaggtgccaggaaaatgaagggaagcccattgagagtatctttgatcttgctgagatgggtgtcgatgagatgcgggatctcttacagctatcaaactctcagctgcaagacattattgaattctttaagcggttcccaaatgttgatatgacctatgaggtccgtgagggtgatgatataactgctggtgacaatgtaaccgtgcaggtaactctggagcgtgacatgactaatgtgtcatctgaggttggtccagttcatgcgccaaggtttcccaagcctaaggaagaaggctggtggctggttattggcgacagctccacaaaccagttactggcaatcaaaagagtggcactccagaagagggcgagagtgaaacttgagttctctgctcctgcagaggctgggagaaaggattacatgatttacttaatgtcagactcttacttgggctgcgatcaggagtatgagttcaccgttgatgtcaaggatgctggaggggattgatgatgaaggctgtgacaccaggtcgcatagaagcagtagaacttcgagtgtgtattgttacacgatattagtattttggaacattatgtgttgtaacctctgaacttgtggaatctgtagcttattttggatgttaactggtgcactttgggagttgctgtcttatcctattctggtattattgtaaggataacgcttggttatacttgagccagagtattttggatcaacttgttgcttccataagcttgctgctgctgtaatgtttgattttagtgacatgcagtaaaatgttttaacctgttgttgc

SEQ ID NO: 133 - DNA, 1107 bp, Sorghum bicolor
cagcccacgcccacgacgcgcggcggggacggcacggcgacgctcttcctcctcctcctcctcctcctcatctcgccgccccgcaagcaatggcggtggcgcggctgcgcgcggcggccgccgcccggctgccgccggcgctctcccgcggagagaggcggccgctcgggacggcggcggaggtggccacgaccgcggggccaggggccgcgaggtgggagctcatgggggcgcgggagtactacgactaccggcgggccatctacggcgacatcacgcataaggccatcctcgtcgacgccgccggcacgctgctcgcccccaccgaacccatggcccaggtgtacagaacgataggccagaagtatggagtggattattcagaggatgagattctgatgcggtatcgccgggcttatgcgcagccatggggtagatcacgtctgaggtatgttaatgatggaaggcccttttggcaatacatagtgagttcatccactggctgttcagatctacagtattttgaggaactgtatcagtactatacaactgaaaaggcttggcatctctgcgatccagatgctggacgtgtttttgaggcattgaggagggctggtgtcaaaacagctgtcgtgtccaactttgacactcgtcttcggccacttctacaagcactgaaatgtgacggctggtttgatgcagttgctatatctgctgaggttgccgcagaaaagccaaaccctacaatattcttgaaggcttgtgagctgttgggagtgaaacctgaagaagctgtgcatattggtgatgaccgtaggaacgacgtatggggagcaagggatgcaggctgcgatgcctggctttggggcagtgatgtgtactccttcaaggaggttgcagagaggatcggggttgaggtgtagtaagtgttctcctgagccgtaataggagtcatccgagcttgtacatagtgtcaacgccacttaccaagggcgtcttgtacatatttccaagggaaataacaagagcagtttctctctgtgtgcgactatgccaggcattttgtagcaaatactgatgtttatgtatacatttaaatgttcagtt

SEQ ID NO: 134 - DNA, 1748 bp, Sorghum bicolor
acacccccactgccaccacaagcagccggcgcgtgtggtgcatctctgatccccggcacgtcggtcctctgtatttaaaggccacctaccttaaccagggtgctccgcctccactcccgagctcgtcactccggcaaccgagcagaagcaggccggtggttccggtgacctcccgatggcgtctctcgctgccgtcaagaaggtgctggtgctggtgccgatcacggcgggctcggagcccgtggaggcgttcgtccccatcgccgtcctccgccgcgcgggcgccgacgtcaccgtcgcggccgcgggtgccggagccggcctgcgcgtccacgccatgtacggggtcaccgtcgtcgcggacgccaacgtcgccgactgcgccgacgcctcctacgacctcgtcgccctccccggaggcgtccccggcgcggacaacctcggcggctgcgcggcgctggagagcatcgtgaggcgccaggcgctcgggggcggcctgtacgccgccatctgcgccgcgccgccgctggcgctggcgcgctggggcctgctcgacggcgtcaaggcaactgcgcatccggcgttcgtggacaagttcccggcggaggtggccgccgtggacgcgaacgtggtggtcgacggcagggtagtgacggggcgtggcccggcgccggccatggagttcgcgctcgctctcgtggaacagctctacggcaaggacaaggttgacgagattgccaaaccaatgatggtcagatatgaacccgggtacgccttcaaggaactgaacccggtccagtggcagtgcagcggcacgcccaaggtcctgatcccggtggccaacgggagcgacgagatggaggtgctcgtgaccgtcgacgtgctgcgccgggccaatgcggacgtcgtggtggcgtcggccgagggcggcgacgccgaggtcgtcgtcgtcgcgcgccacggcacgaggatcgtcgccgacgcgctgctggtcgacgccgtcgccgccggccagcagttcgacttcgtcgtcgtgccgggcggcatggccggcgccaagacgctggccggcacggaggcgctcgtggcgctgctgaaggagcatgcggcggcgggcagggcgtacggcgccatcggcgccgccacggcggaggtgctggagccgcacggcctcctcgagctcgagggcaagaaggcgacgacgacgtgcgcgtccatggcggactcccgcgagtgcgggagcagggtggtggtggacgggaacctggccacgagcagcggccccgggacggccatggagttcgcgctggccgtcgtggagaagctgctcggcgccgaggcggcaagggaggtggcggaagccctgctgttcgtctgacgacggaccacgggcggagatgagctgtgcctgtgctatttgatcctttgcagtagagatcatggaacgtggccggaccttccttgtcataacatcatctgagaatttggtatctcgatcgtgtagtgtagtaaaaattctatacaagtatcgttacttatatagagaggtgggacttgggttaagccataccgcctcaggatggtcctcttgtgatttttgccgctctttggaccatgatatctaggcacgtaagacgtgtcaaggtgtcgttgtggtgctacgtttttttcaatagcccaagcacagctcatggtacccaaaaaaaagtctttatatcgtatcattaattttttagttttctttgttc

SEQ ID NO: 135 - DNA, 458 bp, Sorghum bicolor
actcctaatcagcgcttaatcagcagcagcagcagcagccagcagggaaggatgcaggcggtgggcatccggcgtggtctgaccatcgacccggcgggggaggaggagcccgcggcggcgcgcgtggggcggctggtccgggagagccccgtggtgatcttcgctcgccccggctgctgcatggcgcacgtgatgaagcgactgctgcaggcggtgggcgcgcacgccaccgtcatcgagctggacgccggcgccgccgaggaggaggagctcgcggcgggggccgagggcgcaggcgtcccggcgctcttcgtcggcggcgaccccgtcggcgggctcgagggcctcatggcgctccacctcagcggacgcctcgagcccaggctcagggagctcggcgcgctctgcgcctagctgtccgcttgcttctccgccgtcgatccatgtgtccggtcagc

SEQ ID NO: 136 - DNA, 1726 bp, Sorghum bicolor
gctccgacacatcatagacagatagcagaacacacgcgccgtgcacgcttgcgcaaacccaaggattgccgctctgttcttggtctcctcctcgggtgaccgcaggggcaatggcgattaacggggaggaggcgccgcctctgctactggacgaggccgcgcgcccgcgccgcgtcgcgctcttcgtcgagccgtctccgttcgcttacatctctgggtataagaaccggttccagaacttcattaaacatttgcgagaaatgggggacgaggtcattgttgtgaccaaccatgaaggagttccccaagagtttcatggtgccaaggttattggttcatggagcttcccatgccccatgtatggaaaagtacctctttcgctggcactcagtcctaggatcatttcagaggttgcaaagttcaaacctgacattattcatgcatcttctcctggaattatggtttttggtgctctagctattgccaagctactcggtgtccccctagtcatgtcctatcacacccatgttccagtatacataccaagatatacatttagctggcttgtagagccaatgtggcaagtcataagattccttcatagagctgctgatttaactttagttccatctgttgctatcagcaaagattttgaaactgcccaggtcatatcagctaacagaatacgcctttggaacaaaggtgttgattctgcaagcttccatcctagatttcgcaatcatgagatgcgagtcaggctaagtgacggcgagcctgaaaaaccactagtaattcatgtcggacgttttgggcgtgagaaaaatctggattttttgaagatggtaatggataggttgcctggtgtaagaattgcatttatcggagatggaccatacaggtgtgaactagagaagatgtttgaaggaatgccagcagtgttcacaggaatgatgcagggtgaggagctctcgcaggcatacgccagtggtgacgttttcatcatgccatcagagtcagaaacgcttggccaagtggtcctagagtccatgtcatcaggagtgcccgttgtcgcggcccgtgccggcgggatccctgacataatcccagaggaccaggagggcaagacgagcttcctgttcacccctggcgacctggacgactgcctcagcaaggtccagcagctgctgacgaacagggagttcagagacaacatggggcggactgccagatccgagatggagaagtgcgactggcaggcagcatcgaagacgatccgcaacgagttctacaacgccgcgatctggtactggcgaaagaagcgtgcggagctggtgaagccgctgcagtggctagcacagatgttcctgccggcgcctgaggtccgcagcatcaagcagtgctgaggcctctctccacttgtgggacgatggtgttgcttgcagccatgatccagacaagtgatggatggatggaaagcaagacatgcatatgcactccttgtaaattcctggtgtatagtgctgtgtcgataggtgagatagttccccgtttttttatggaaattggaattgggttgtgattgttgtggcaattccatcgattacatgtgtgttgtgtagcaaatcagaattggaatgtgctatatatcttgatggaaattgtaacctgtaaatcatgattaggccattaattaaatgcatgagtatgcttttgtgctcaaaatcaa

SEQ ID NO: 137 - DNA, 1192 bp, Sorghum bicolor
gagctgccaaaaacgggggccaagacagatggtgcttctgcgcgtctgccaccgcttcggccgccccccgcgcttcccctccttcctctccatggcggcgccccagcaacctggtaaaaccctgccgcgcccctgtccttcgcctcccctctccgggtcggcgcccaagaggttcagggcgatggccacagacgtcgcggcggcggcggtggatcctccagccgccaggggctgccccgctatgaaggcggagttcgccaagcacgccgagtacctcaacgccctgaatgacaagagagaaaggcttgtgaaagctagtcgggatgtgacaatgaacagcaaaaaggtcatctttcaggtccacagaatcacgaaagttaacagggacgaagttctctccaaggcagaaaatgatcttgctgcagtggttaatcaatacattgcaaaactagtaaaagaattacaaggaactgacttctggaagctcagaagagcctacacctttggtgtacaagaatatgtcgaagctgcaacactgtgtagattttgcaagactggcactctattaagtcttgctgaaattaatgattctttactagcactaagtgataaatctgttgagcccttacagttaaatgtgcttgactatcttttaggggttgctgatttgtcaggagagcttatgaggctcgcaataggccgtatatctgatggggaagttgaatatgcaaaaactatctgtgcttttgtacgtgatatttacagggagctgactcttgtggtacctctaatggatgacaataatgagatgaagaagaaaatggaggtcatgctgcaaagtgtagtaaaaattgagaatgcttgcttcagtgttcatgtgagaggttcagagtacattcctctgctaggatcatcaggagacccagattattcctttttcggtgcctcagactttgaccaatgaatgttttgaagcaagaagaactaattgagtgttaaaggagcttagatcgatttaaggagagtggttgcgttaggtgtttgatttttattgccagtttatgttgcacatcttggagtctgtaaatcttgccctaaggtggtaacctgggagaataatgttgcaagactaccctttttatggtgcagcctgtttgatctgtgctaataacagtgttcgtaatagctgaaa

SEQ ID NO: 138 - DNA, 1154 bp, Sorghum bicolor
attaaacactactacaccaaacgacgaatctaacttcagttgcctccaaagtccatacagagagattgacagtgtgtgagagcctgagacgatggcgaacctgttcctgaagcaggcgaagcagtacgtggcgacgcggccggtgtacccgccggagctcttcgacttcatcgcctccaagacccctcgccgcgacatggcctgggacgtcggcaccggcaacggccaggccgcagcatcgctagcgacgctgtacgaggccgtggtgggcacggacacgagcgcgcagcagctcgcctacgcgacgcgcctccccaacgtccgctacgtccacaccccgccggacctgccgctggaggggatccacgccaccgtcgccgcgccggcgtccgtggacctcatcaccgtcgcgcaggccttccactggctcgacctcccgcgcttctacgcgcaggcgcgctccgtgctgcgccacggccacggcgtgctcgccgcctggtgctacaccgagccacgcatcgacgccgccgtcgacgccgtgttctggcgcctgtaccacgggtcggagaactactgggcgcccaaccgccggatggtcgacgacgagtaccggagcgccgacttcccgttcgaccccgtcgagggggagacgcacacggggccgttccagttctccacgcaccggcggatggacctggatgactacctcatgtacatcacctcatggtccgcgtaccagacggccaaggataacggcgtcgagctgctcgacgaggacaccgtgcaggagttcgccgcagcatggggcggcgacggcaaggaggtgaagaccgtcacgtaccccatcttcctcaggattggcaaggtaaggtgagggcgccacaataatgagatgcacccaaaacaaaattgtggatatatttccgacgagccgacgacgacgaatgatcgatcatctaggaatcgatgctcataaactttttaaataacggtttatttattttattcaatttgcaaacgtttgttcacgattgtatttcaaattgtaatgcagttttctgttcgattttttgtttagtgtcttcttgatagtgtaaatttcaatgtgtacactttgataacagaatatccaaatatactcccttcatcccaaa

SEQ ID NO: 139 - DNA, 2958 bp, Sorghum bicolor
tccccttcccaatcccaccctttcccatatccaaccacctcctcctctctcactccctgtctgccatcccgagcgattctccgtgcgaccaagccatggcctctaacggcggcggcagctccccaccctccatatcgtcgccggatggtcgaccgtcgagcccactcccggtcaccaactcgtccccatcgcagcccacccgccgctccggtgggcggcgccgccgcggttccgccagcccttatgcttcgtccccttccctcgggggattcgagacgccgccgcaccccggccgccgcacgccgtccggtgccggggctggcgccgccaggcagcagcgtcagaactggactggccggttcccgccgacgccctccaccccaatgtccaccgatgacatcccgccgtcctccgaagccggggacgacgagaccgacggtggtggcggcggcggcgtcgacgccaccccggtcttcgtttggggcaccaacatcagcgtgcaggacgtcaacgccgccatcctccggttcctgcgccacttccgcgacccgcgtgacgccggccgcgtcgacccggtcatggatgagggcaagtacatgcgcgccatccaccgcatcctcgagctcgagggcggagagtcgctcgacgtcgatgcgcacgacgtgtttgaccacgacccagacctctacagcaagatggttcgctatccgctcgaggtgctcgccatcttcgacatcgtgctcatggacctcgtcgcacgcatcgagccgctcttcgagaagcacatccagaccaggatctacaacctcaagtcgtccatttgcttgaggaatctcaacccatctgatattgagaagatggtatctatcaagggtatgataattagatgcagctcggtcataccggagctcaaggaggctgttttccgctgccttgtttgtggtttctactcagaacctgtcatggttgatagagggagagtaactgagccacacgtttgtcagaaagaacaatgcaaagccacaaattctatgactctagtgcacaaccgatgcagattttcagacaaacagatcataaagttgcaggaaacaccagatgagataccagaaggtggcactccacatacagttagtgtcttgatgcatgataagctcgttgatgctggaaagcctggagacagggttgagataactggaatatacagggctatgagtattagagttggaccaactcaaaggacagtgaagtctatattcaagacatatattgattgccttcacataaagaagacagacaagtctaggcttcatgtggaggacaccatggatattgataattcgaatgctagcaaatctactgaagaggattttcttagtgataaggttgagaaactaaaagagctttcaaagttgcctgatatctatgacagattgactagatcattagctccaaacatatgggagttggatgatgttaaaagaggtctcctttgccagcttttcggcggcaatcctttgaagcttccttctggggctagcttccggggtgacataaatattttacttgtgggtgatcctgggacgagtaaatcccagcttctccagtacatgcataaactgtctcctcgtggtatctatacaagtggtagaggaagttctgctgttggtcttactgcttatgttaccaaagatcctgagactggcgaaactgttctagaaagtggagcacttgttttgagtgacaaaggtgtttgttgcatagatgagtttgataagatgtctgataatgcccgaagcatgttacacgaggtgatggaacagcagacagtatccattgcgaaggctggaataattgcatctttaaatgcgaggacatctgtcctcgcatgtgccaatcctaccgaatcacgttacaacccaagactttctgtaattgacaacatacacttagccccaacactactttcaagattcgacctgatttatcttatcttggacaaggcggatgaacaaactgataggcgcctggcaaagcatattgtttcgttgcattttgagaatccaaatttagaggagctcgaggtcttggacttgcagacattagtttcctacataagctatgcaaggaagtatattcagccacagttatctgatgaagctgcagaagagctaactcgtggctatgttgagatgaggaaaagagggaatagccctgggagcagaaagaaggtcataacagcaactgctagacaaatagagagtttgattcgtctcagtgaagcattagcccgaatgcggttctctgaagtggttgaggtgcgagatgttgtggaggccttcaggcttcttgaagttgccatgcagcagtctgcaacggatcatgcaactgggacgattgatatggatctaatcatgacggggatatctgcaagtgaaaggcagagacgggagaaccttgtttctgcaacccgtaaccttatcgtggagaaaatgcagcttggaggcccctcaatgcgtatgattgagttgctggaagaacttaggaagcagagctcaatggaaattcatctgcacgaactccgcggtgctcttggcaccctgatgactgaaggtgcagtggttatccatggagacaacgtgaagagagtttgatgtttaactgccatgagcggtgatgcttctataagctcaatctgccacttccttgaacagacaaggttgtgaagatttgatcaattgtagcacttagccctaacttatgtggtctgttgtctaaactggtccagatttgtgtaactccctaaatagcagtagtgctagctgtagattttttttaaatgaatatcagaattttgttttcttgccatggtttgagtttactgctgcaaggtaacttctatcatatgcgtatgcagttccagttcagatttgaaatggcagcacctcctttcatcac

SEQ ID NO: 140 - DNA, 1192 bp, Sorghum bicolor
agccatcgatccaccgcaaacaagctcgacgacacaaagcagctagcatcgtagccagccagccgccctaaaaaccagccagctaaacccatggccgggatcgtggtggtgttcgacttcgacaagacgatcatcgacgtggacagcgacaactgggtggtcgacaacctgggcttcaccgagctgttcgagcgcctcctccccaccatgccctggaacacgctcatggacaccatgatgggtgagctccacgcggccggcaagaccctgggcgacgtcgccgaggtgctgagggcggcgcccatcgacccgcgcgtgcccgccgccatcaaggccgcgtacgcgctgggctgcgacctgcgcgtgctcagcgacgccaacgccttcttcatcgagaccgtcctggagcaccacggcatccgtggctgcttctcccagatcaacaccaaccccagccacgtcgacgccgacggccgcctccgcatcgggccctaccacgccgccccgcacggctgcggcgtcggcacctgcccgcccaacatgtgcaagggcctggtgctcgaccgcatcctccgcgaggcggccgccgggacgaccgggaggtcgacgaagcgcgtcatctacctcggcgacggccgcggcgactactgcccgtcgctgcggctggcccgggaggacttcatgatgccgcgcaggggttaccccgtgtgggacctcatccgcgaggaccccgcgcgggtgcaggcggaggtgcacccgtgggccgacggcgccgacctggaggagacgctgctgcgcctcgtcgggagggcgctcgtggaggaggccgcgctgccgccgccgctcgactgcaagctcgagtccaccatgcccgttgccgcgcaggacggcggcatgcccatcatgccgctcggcgtcaagaactgatgccgtcttgtctctggttgagaatctgatattattgccggttcgggttcgttgtgagagctcgagcaagtgcgggcgaggcacggcgtacgatacgatggattaatagtagcgtttgttaactgtattattgactaattttgtgtgcgtgtggtgtattccctccggatcgagcctgtcactgctgaattggctatggctcgttgtatcttctttgctaccgacaaaagataaaattaatggatgaaatcccttacgatttacg

SEQ ID NO: 141 - DNA, 709 bp, Sorghum bicolor
cacacaatccccacacagcaaccaaggcaaaccagcacgatgcgtcgcgagggccggcagcacgggtgggtgttcaccgtcgaccccagcctggtcgacgcggagggcaagcagtgccgttcccgcgcggtgcaggtcgacggcgcggcggcggccaacggcgggttcgtcagggcgccgcggaagcccaccaaccacaccaagcccgccgtcggccgcgcctacaaggcgctgatcggcaagggagaggctgggtccggcaggggcaggcacaagttcaagcacgacgaggccaagatgtaccacctctacctcgagggcgccgacgacgcctacgcggatgcgatgctggagttcgactggtagtcctactgacatgggtgtgtgaatgcggtgctggatcggagttcgacgggcctcattgccaggaagtgcagagatcgatgttaggcttctgtgtctcaatccaaatgtgttttgtgatgtgagtcgttgttgcgtcagcagtgaataaaaaaaggcagggatctggaatgtatcccaaattgggaatcaatcttgatctccaaagttgaaatttgtaaaagttttagccgtacgagtttccgtttttgggtcctgttgttttcaaatgtaatagcgttcatgcagttaaagactgtttactgttattttctgtcacaaagcgtattgtcaaacaatatcctcg

SEQ ID NO: 142 - DNA, 1840 bp, Sorghum bicolor
gcccggatctcctccccgctcgcaccgccgcagcgcgctcccgcaggccgcgtcaccggcggcccggcccttgctgcccgcctgcccctacggccctaccacgccgcgctcgccaccggagagggccaatagaataaagaaagcgaagccaatgcaggtcgccgtcaacaccagcactgtcggcgctcaccagcacccaacaaagtcctccttcctccggccatcccctccttgccgcgtctacttccacgcttctccacgtccgaagaacctgagggcgattgccatggccaccaagtcgcagcttcaggagcaactggtcatcactcggcccgacgattggcatctccatcttcgtgaaggcggtgtcctcgaggctgtagtgccacacagcgcgaggcattttgggagggccatcatcatgcccaacttgaagcccccggtgaccacaacggcgcgggcggtggaatacagggaggagataatgagggcgctgccgccagggagtagcttcgagccgctcatgacactgtacctgacagacaacacaagtccagaggagatcaagctcgcaagaaagagtggtataatctttgctgtgaagctatatcctgctggagcaactaccaattcccaagatggcgtcactgatatatttgggaagtgcttgccagtcctcgaggagatggtcaggcaggaaatgccattgcttgttcatggagaagtcacagatccacatgttgacacctttgaccgtgagaaggttttcattgacaaaatattggcaccacttgtacaaaaacttccacagctgaaaattgtcatggaacatatcacaaccatggatgcagtgaacttcatagaatcatgtgaagaaggtcatgttgctgcaacagtgactccccagcatctcctcctcaataggaatgctttatttcagggtggcttgcagccacacaattattgtttgcccgtactgaaaagagagactcataggcaagctattgtatctgctgtaacaaatgggagtagacggtactttcttggtactgacagcgctccccatgataaacagaacaaagaatgttcctgtggatgtgcaggaatatatagtgctcctgttgccttgtctctttatgcgaaggtatttgaagaggctggtgccctagataagctagaaacatttacaagcttcaatggccccgatttttatggcctcccaaggaacacttcaaagattgtcttgagaaagaatgcctggaaagttcctggaacttataaacacagttcaggggagattgtgcctatgtttagtggcagcacccttgagtggcttccatctgatcagcctaaagagtaaacagtatgcattattgtacccagcagttgggggaatcaataggtggagtttttctagttctttttcctttttctgttagaatcagcatagcaaactattcagccataagcagcaattcctgaaggcaattgaaagcaactgcgaaagatttgcttgtcgagttgttattggattgcagtacaattctggaagtagttaaaaggtcacattgtatggttatcaagggtagtctactgctctagacaccatagcatccatggtttcaaaggcgacgaggcgtccacgtgagagctgggtgtgcctggacacctaggtgacaaggtgccactgttccccaaggcgagctgggtatgcctggtgcctaagtgacgcctttgaaacgggtagcatccataataatgtaatgaataaatatctgcattgcagttacatcgtcatatactcttgcagtccctttaacacaacattttcctcttatta

SEQ ID NO: 143 - DNA, 1210 bp, Sorghum bicolor
ctcgactcgacgtgtccatcctctcactcgcccctagaagccatcacgaattggccacctccgatgtgaggcaacctcaaggagaaggaagctcatcaatctcgccgctggcctcctcacctctgcttttgcgtcgctgcgttatcgtctctgcatccgagtgtcgctatcttcctggtgcctggtgctgcctgtgttcacgagctggaacttgtccgagcttcagccaagtcaagctcgagcctgtctagccaagcagaacggcacggtggtgctggtcgacgcctcctctgaggaacacgtgccggtcgacgcttcctcttggcggacggtctcgagtttggtcgggaggatgggtggcgggagctgctgcgtctgcaaggaggcgccgcccaagtacaagtgcccctcctgccgcacgccctattgctctgtcacatgctttaaaaagcacaaagaggaatcttgccaaaagacatcgcctcaggaagaaattagcaagtcaccactgcaggaggaagttacagcactgaacaccacatgcattgcagaatctccaaatacagtgggccctacaaaagctcttgaagttgaggacccaagctgggttgttgacaacaatagactaaggtctttagcggaactgaaagggatccaagatgctctcagggatcctgaactgcagaaaatgatacttaaaattgatgggtctttggaaccagaaaaagaattggagaaattgatggaaggtcaagcttttggccagttcgctgataagattcttgacattgtcagcccacaagaataatcgcctgccctgcctgtttggtgggattgatgctggagtaaatagaagcatccaggcaaacaagcgaaagtggacgagctgatctctggttttcctttttccaggatggggtagactttagaacacatcttgagtcgcctgtttttccatgacgggggtagactttggaacacatattgtgtcgcctggtgaaaggaaattgctgtagctgaaaaatctctcttgccaaagatagatatttcttctgtggttgcattatgcgtttcacttcagagtgtcgataatcctagctgtattttagtgcagtagacagcgactctacattgactactgaatcttgagaagatgacgcttcttccattgaccaatatagcggccatatttccgcaacatgcttctgac

SEQ ID NO: 144 - DNA, 2120 bp, Sorghum bicolor
agaaatacagagacctccctggcagggagaaatgttaaaagacggtagcaaggagaaatgttaaggagatgggtaagaagggaaattggttcactgcactcaagaaggccttcacctcaagccccaaggagaagccaccaaatgtgcatcagctggtagcgcagtacccgtcttcgcacgggcacggcagggacaagaagcgatggggaggcttcgggcggacgcggtcgcacgcggagccggcgtcgccggcggcgggcgcgctgatcaacatcccgctgtaccgcgagccgagcagcatcgagaagatcctcggcgacgcggagatggaccagcagcgccagtactacgccgccaccagggcgcagtaccagatcacgccggcgaggcccaccaccgccgtcgccgctagtgctgccgcgccgctgccacagccggtggtgggaacagcacgtgagcgtgagcgtgagcgcgagcgcagcagagaggacaagccggccgccgtggtgctcccgctgccgccgccgtcccctccaccgctgatcaggaggttcgaccatgacagggagcagcagcagaagctccagcagctgcagctgcagccgcagagcagggccgagacggagtggcggcggcagccgcagccgcagccgcagccgaggcggcaccgcgcggcgaggcagcgcgccgcaccgccggaccgcgcgcgcgccgcggccgtggcgatccagtccgcgttccggggctacatggcgcggcggaactaccggtcgctgcgcgggctgatccggctgcagggcgtgatgcggggcgccagcgtgcggcggcagacggcgcaggcgatgcggtgcatgcagacgctggtccgcgtgcaggcgcaggtgcgcgccagccgcgtcgaggccatggagcggcgcaaccggcagcaccacggcgccatgctcagggacggcggcaggtggcgcgccggctcacaggacggcggcatttgggacgacagccggctgacgcgggaggaggcggacgcgcggacgaagcggaaggtggaagccgtgatcaagagggagagagccctcgcctacgcctactcccatcagctgctgaaggcgacaccgatggcggcccacgcgatcctagcggacctgcagtcggggcggagcccctggtggtggacgcccatcgagcgccaccacgagccggggagctaccgcccagtggagcccgccatcagcaagccccggccggcgctcgcgatcgcccaccgcgagacgacgccaatggcgatgacggcggcgacgacgccggcccggtcggtggtctcggcctactccaaaacaaggaccacgaggcccgtgaccaaggtgggagcccccccggcgccgtcgttgagctacgtggggagcatccgcgacgacgagagcctgacgagctgcccggcgttcggcggcgtgcccaactacatgacgcccacgctgtcggcgtccgccaaggcgcgggcgcgggcgcacctgcagcagcagcagaaggcggcccaggagaagcccaggttctcgttcgggctggggcagagcatcgggagttgggccaagagcccgttctggaaggccggcggcggcggcgggctgccgtcgtcgagggtggccacgccggcggcgtcggtggccggcgggcggcaccggtcgacgcggtcgatcagcgggctcagcgtggactccaccgtgtccatgccggccgggatcggcaggaggccgttcaagtagatatatatatacacgtgtcggactcacggttgcttgcattgcatcattcttcttgttcttccatctcctttcgacgcatttgtgcttggaatttgtacgtacgtgattgggtggtgtggcttgttgtgggttaccattgcgtttgctgattcgctgctctttgctagctccctgtttgctggcctcctttgtccccagccttattttggtttttgaggggccagtgagctgtagcgtgtaaactcggcgactccatcgaacaaacctacatgcgttaagtaagttcttgatttgtcaattagcatggatgccgatgcatatccattttagttgatcgcaccactcaaggaaagtaagggg

SEQ ID NO: 145 - DNA, 2062 bp, Sorghum bicolor
cggaaatatcatctgattgcttcgatctattcccagccacccacttcccaccggcacccaaacattcccacgtaacgttaatctccggccgcgatacgataaataccctcccgggaattatctcttctccggcgagacggcagcgagctgagctgagctgagcacgacgaagcccggaccccctcactcaccacgcccggccatggaggactggctcttctactccctcaccacgctcctctgcctcctctgttcactcctgctgcgtgcgcgcaccccaggcagcaaggaccgccatgccgactcctcctccgcgctccctcccctgcccccgggcccgacgccgctgccggtgctgggcccgctgctcttcctcgcgcgccgcgacttcgacatcgagcccgtcctccgccgcatcgcgcgggagcacggcaaggtcttcaccttcgcgccgctgggtccggcgcgcccgggcatcttcgtcgccgaccgcgccgccgcgcaccgcgcgctcgtgcagcgcggcgccgtgttcgcctcccgcccgccctccacggcctccagcgccgtgctcaccagcggcggacgcaacgtcagctcctccccctacggcgccacgtggcgcgcgctgcgacggaacctcgcctccggggtgctcaacccgtcgcggctccgggccttctcccccgcgcgccgatgggtgctcgacgtcctcgcctcccgcgtccgcgccgacggccgccacggggagacccccgtcgccgtcatggagccgttccagtacgccatgttctgcctcctcgtctacatgtgcttcggcggcgaccgcctcggtgacgacgcgcgcgtccgggacatcgaggccacgcagcgggagctcctcgcaaacttcctcagcttccaggtcttctccttcctcccgtcggtcaccaagctcgtgttccggcgacgctgggagaagctcgtgtcgctgcgacgtcggcaggaggagctcttcttcccgctgatacgagccaggagggaggccggcgccgacggggactgctacgtcgactccatggtgaagctgaccatccccgaggacggcgggaggccgctgacggacggcgagatcgtgagcctctgctccgagttcctcagcgccggcaccgacaccacggccaccgcgctgcagtggatcctggcgaacctggtcaagaacccggcgatgcaggacaggcttcgggacgaggtgtccagcgtcgtcgttggcgccgacggcgaggtgcgggaggaggacctgcaggcgatgccgtacctcaaggccgtggttctggaggcgctccggcgccacccgccgggccacttcgtgctcccgcacgccgtgcacgaggacacgacgctagatgggtaccgcgtgcccgccggcgcgcccgtgaacttcgcggtgggggacatcgggatggacgaggaggtgtggaaggcccccgcggagttccggccggagcggttcctgcccggcggcgagggggaggacgtggacctcaccggcagcaaggagatcaagatgatgccgttcggcgccgggcgccgggtctgcccggggatggcgctggcgatgctgcacctcgagtacttcgtggccaacctcgtgagggagttcgagtggcgcgaggccgacggcgaggaggtggacctcaccgagaagcttgagttcaccgtcgtcatgaagcggccgctcagggccagggccgtgccgctgcggtcaccgccgcccgccgtcgcagctgcttgatgcagggttgctagtacgtactgtacgtagcatcatggcaacgaattggcagttgagtctgcttctcattgctcgtgtgctatatatatatttatatataacgaaatacagtattaggtacgagtaatcacatttctcttgttcttttgggcgctttggtacagacagtagtaaggtaatggcgtaatgctgcagctgcactagtgtgattgtgtgtacatataaaataataagtactgtaagtaaatattttactccattattgaattacaaaaatgataaagtatc

SEQ ID NO: 146 - DNA, 1012 bp, Sorghum bicolor
aattctcattgatctggaactgcaaaatttagggttttgtttgcctcacccacgccgtcggctcctccccctccccacctccacctctccccgcgaaggatcggcggcggcggcgagcgccttcccttgtcgaagtccacccggcggcagagcagagcctcgttgctgaggagggggagatggcgggcatgggagatatgccgatgaggccggcgcgtccgggcccgccgatgcagcaccgcgggccgccgccgatggcgcgcctccgccccgaaccaatcgaccgtgagaagacctgtcctctgctgctcagggttttcacaagggttgctggtcaccatcaaaatgaagagtttgctgtgagagggaaggaaccaaaggatgaagttcagatttacacatggaaggatgccactctccgcgagctcactgatcttgtgaaagaggttgctcttccagcaaggaaaaggaatgcgaggctttcttttgcatttgtatacccagacaagaatggtcgttttgttgtcagacaggtgggttcgaccttcgcatatggtcatggaagaggtgatgatgccaaaactcttgcagagctcgggttccagattggtgattacttgagcgttgcaatcatgtagacggtgcccacaatgaattcagcgactgtaccagatgtaactgctgtgatgtcaaaaggctttagttgcaacaatcaagggttgaatttctgttagcactaggaagtggaaccaaaattgtctgtaatactggtagtatcaaattaattacctagacacttcgaacgagcaactgagcaaggcttctggtatggttgcttttgcttgtataatatggcacttatctgtgcctctgtggtgcctgaagtttccaaatctggacaacgtgcgttttcaatggagaatgttaagttgggctgactgatatttacacccacacagaatcaggtgagatgatcataacagctgcagtgtagtcttaattttcttggcca

SEQ ID NO: 147 - DNA, 1948 bp, Sorghum bicolor
cccactgcttaaatccctctccttcctctccccttcccctccaggcctccactcccaccacctccacctcgtctcccaccaccgccgcgcgcgagccctagcccgatctcgccggcggcaggcgccagatcccgccgcccgttgcgccccgggacgcgccccgccggattcaccgctcctcgcgctgcagcacgcctgggccaggacaagagggcaactctgggggcacaaagtaattcaccttggttacaggttactgcgtggcatgtagtattgtattattggtggaggctgtcaccacaaggcatatgttgtgatttgtcgatggcgaggagatgaaacaagtgtgggggcggagcagcaaggacatgacagccatgccccctctgcgccaccgaggcgctgctaagaagcccatgtggatcatagttctattgtcattggtttgtgttgcccttatgggggcctatgtatacccaccacggcgctactccgcatgctacttctttgcttcgagtgtctgtactccgttcaaggattggctacctgctgttgctcgggagcgaaccgatgaagagatagtttcatccgtggttattagggatcttctttcgatgcctatggctgtgtcaaagaacccaaagattgcctttatgttcctgacaccaggtacattgccttttgagaagttgtgggagaaatttttacagggtcatgatgggcgatattccatctatatccatgcatctcgtgaaaaacctgtacattctagctctctgtttgttgggcgtgaaattcacagtgaaaaggtagtatgggggaggatttcgatggttgatgcagagaagaggctgttagcaaatgcattggaagatgttgataatcaaattttcgtcttgctttctgacagctgtgttccactacatacatttgattacatatataattatctgatgggaaccaatgtcagcttcattgattgcttcctcgatcctggcccacatggaactggaaggtattcgatggaaatgcttcctgaaatagaacagagggacttcaggaagggtgcccagtggtttgctataacacgaaggcatgctttattgattctggcagacaacctttactacaataagttcaagctgtactgcaagccagcagagggacacaactgtattgctgatgagcattatttgccaaccctcttcaatatggtcgatcctggtggaatagctaactggtcggtgactcatgttgattggtctgagggaaaatggcatccaaggtcatatagagctgcagatgttaactatcaactcttaaagaacataacgtctgtcaatgagaatttccacattacaagtgatgataagaaagttatgacacggactccatgtatgtggaatggaacaaaaagaccatgctacctttttgctagaaagttttacccagaatctctgaacaacctgctgaagctattctccagttacacataggcttgagttctacatgatttttttccccatttggcctaggtgattcccctaggatttcttttttctgctttatgtaaattgtgaaattgatacttagaggcttaacacacagttacagatccagggccagtgatgtaattctgagtcccttggtagggctgaggtgctgtttgtttagtatttacgctgccctcactgtcattcgtggtgccctctgtatgactgtatgcttctgttagcccttcacttctctctctctgctctctcattcttagattcctagctcccatttcctgagtaacaggggttttgtcagttcctactgttattataagattaattctttttcagacacgaagagattatgaaatcagttacactttatagtttaacctggccttgctttgaattccagtgacagttttactcttctgatgagtatggcagcatgg

SEQ ID NO: 148 - DNA, 562 bp, Sorghum bicolor
cccgtcgtctctctccttgcgcgtcgataaaccacgcacactcctctcccagtcccccccttctccacgccccctgctcgactgctcccgtgatctgatctgatctgatcggcgatcaactcggcatggcggactggggccccgtggtggtgggcgtggtgctcttcgtgctgctgtcgcctggcctgctctgcgagctcccgggcacgcaccgccacgtcgacttcggcggcttccacaccaacggcaaggccatcttcgtgcacaccctcatcttcttcgccgccttcaccatcctcacgctcgcgctccacgtccacatctacaccggctagtactagtctatatgtatgtgtggtggtcgatctgggacttgcagaggtcagatcagaaccagatcggatcatgccgtcgttgctgctcttgttcctcttcaactcgatcgattcgacaagtgcttgtactgccttcctcaatcctagctattattactcatatctatcatgtaaaggccatatggccgtcggtctgtagctaacgcttgcaggaactagtgcctgcc

SEQ ID NO: 149 - DNA, 1850 bp, Sorghum bicolor
gccgatcgacccagcccaggctgcctgcctgcctgccatctcgaggtcgagggatccagcgagcggagcggagcggacgcggacgccacccgcgcccgcacacctacgcgcaggcgcatacaccaacgacgccgaccacttccagggagggaaaccacacaaccggacccgaccccccgacgcccccgaggcgagggcgagggcgagcggtgagccggccggggcggggaccaagggggatcccctcggcggcggcggccatgggtgcgccctccccggcgatgtgggccgggctggtgctggtggcgttattggccgcatcggggccggcggcgacagcggcggcggggctgccgaggttcgccgaggcgcccgagtacaggaacggggaggggtgcccggccccggtggcgggcgcgggggtctgcgacccgggcctggtgcacatcgccatgacgctcgacgcgcactacctcaggggctccatggcggccatctactcgctgctcaagcacgcctcctgcccggagtcgctcttcttccacttcctcgccgcggagggcggcggcgcgccggccgtcgccgacctccgggccgccgtgtccgcctccttcccgtccctgcgcttcgagatctacccgttccgcgccgacgcggtcgccgggctcatctccgcgtccgtgcgcgccgcgctcgaggcgccgctcaactacgcgcggaaccacctcgccgacctgctcccgcgctgcgtcccgcgcgcgatatacctcgactccgacgtgctcgccgtcgacgacgtgcggaggctctgggagacgcgcctgcccgcagccgcggtcgtcgccgcgcccgagtactgccacgccaacttctcccgctacttcaccgaggccttctggaacgaccccgtcctcggcgccagagtctttgctggccgccgccgcgcgccctgctacttcaatacgggcgtcatggtcatcgacctccggagatggcgcgttggcaactaccgccagcgcatcgagcgctggatggagatgcagaaggagaaaagaatctacgagcttggctccttgccccccttcttgctcgtcttcgccggcgagattgaggctgtcgaccaccggtggaaccagcacggcttgggcggcgacaacgtcttcggcagctgccgccctctccataacgggcccgtcagcctgatgcactggtccgggaagggcaagccatgggaccgtctcgacgccggcaagccttgcccgctcgaccacacctggaggtcgtacgacctctacattggcgagaatgattcatcatcagcatcagggccgtcccggtcagccttgtcatcatcggcggcatggtagaagttcagatatacacacaataattctttgatttggggatgccgtggttcttggccggtaatggaattgccttgcaatgcattgccactgctgccacagctgctgctgctgctgcaagtcagctgccgccttcggctgtacaggggaggggcggtatacagattgcagcagcagcaaggggatgaagacagtgaatagggggggagcaaattcttgttcattttgcactatgattcggattgattcattaggctctggtttggaggttgtgactatcatgggttggaaggaaaattacttgattggtggtgtacaattcttggataggataaaggtttcagtttttggtctattagttcagaattgtttcatttacatgtctattcagtacactcgtataatatggatttaattaaattgatttggaacaattcgagtgcatcctggtcttgtgcctttgctgaaatccttctatatgtgaat

SEQ ID NO: 150 - DNA, 1185 bp, Sorghum bicolor
ttgtggctgccacaccgcgccatcacatactgacatacacatacctcctcctcctccatcctctgtccacaccaaaagcagaaggaagggagagatctgggaggggtgagagagcaggaggagaaggccattgccctcttgaaggctcgagaccttctccgtccatcctcttccctctttgctttgcctctcctagactctctagtcgtccggtccggccatggccaccatcctggagaacatccagaaggcgaggttcctgccgaccaggccgctcaaggacgagctgcccaccttccagggcggcggtggtggcaaggaggagagccacctcatgggcctgaggaagcggctgtcctccttctcgggcaagatccagcccatctcctccgcgtcggccgagtgggcgttccggcgctccaagtcggcgccctccctcggcgccgcgttcgccgcggggggcggctccctgaggcagtggtggcagtggggcgtcggctggctcctgtccaagaagcccgggttcgcgggcgacctcgagatgaacgaggaggaggtcgccgcgctgggccgccagagcaggggcagctggggccacatcctctacaagatgcgctccggtgtccggcggctcgtcatgtccacgcactcgctccctaccacgcacaagcagtcgtccctgccgtcgtcggcgtcggcggtgcacaacaacgtccagtgcaagccggcggcggcgttcgcctacgcgcagcggcagagcttccaccacaccggccacgccatggcgcactaaggagcgccgtcgcggttgcaggtgctgtttgcagccgatctcctccagattcagaagtggagatggcgagaggcacgagaagaagaagaagattcaggttccaggtgcgtgagatcgatggtgaagatatcgctgtaccgtccgttataagtgaaaactagtagctcggtgaatcgatgatgaatgaaatggatcttcatgtaggttttaccatcctgtgctgtgtagatctagtgccccatgtagaggtgaacaagtgttatatgctctcgttctttatattcttttgggttcttttggacgatgtaaatgtacaatgtttggttgattttgtactgtttttgcctccagcagtaaataaaactaatgcaaattgtgcccctctgttcttg

SEQ ID NO: 151 - DNA, 1534 bp, Sorghum bicolor
agtacaaacctactacaagtattgctaccggtactgatcacactcctacgctacctacctgccagtgtcactactactcctcactagcacgcttgcagaggttgcagctccagcgagcaacaaggatcgatcaggtccatccatggcggcccccaggaaggtcctcatgctctgcggcgactacatggaggacttcgaggccgccgtcccgctctacgccctctccgccctcggcatcaccgtcgactgcgccgcgcccggcaagcgccccggcgactcctgcctcaccgccgtccacgacttcctcggcttcgagctctacacggagctcacgggccaccgcttcacgataaccgccgacttcgcggcggcggcggcggacccgtctcgctacgacgcgctggtcatcccgggcgggcggttcacggagcagctgagcgcggacgcggccgtcgtggacctcgtcgcggcgttcgcggcgctgcggaggcctctggtgctcacctgccacagccagctcctgctcgccgcggccggcgggctcagcggcggcacgcgctgcacggcgttcttcagcttgcgccccgtcgtggagctggcggggggcgcgtgggtcgacccggatcccttcgagctctgcgtcgccgacggccacgtgctctccgccatcgggtggcccgcgcacgcccagatcctcgccaagctcctcgacgccttgggcgcccacgtcgtcgccgccgacgccgggcgcggtggccagcgcgtcctcatcctctgcgccgactacgtcgacgactacgaggcgaacgtgccgttccgggcgctggcgggcgtgggctgccgtgtcgaatccgcgtgcccgaccaagcgcaagggcgagaccgtcgtgacggcgatctacgacgccgccggcacgccggcggtcacggtgagcgaggagaggcggggccacaacttcgtggtgacggcggactgggcggacgccagcgccgacgacttcgactgcgtcgtcatccccggcggccgcgcgccggagctgctggtgacgcacgacagggcggtggcgctcgtgaaggagttcgcggacaagggcaaggtggtggccagcatcggccatggccacctgctcctcgcagcggcggggctgctcaggggcaggaagtgcgccagcggggtgcccatgcgggtcgtctcgaggctggcgggcgccgaggccgtggaggccgcggcggccgtcgttgatgggaggctcgtgacggcggcgagctggacggacctcgcgcagttcgtggctcgcgtcattgacctcctcggcatctccgtctccttctgaatgcctgttgtgtctctgctcttcaactctgggagcactgaacactctgctctgaatgttttgttcttatttcattgttcatgaggtctgagaatggcacaataagttacatcagtcttttttttgtgtgccacaataaaatgcatctttctgaataaagcgcatcaccgaatttcgtaagagttgattgattgtgctgca

SEQ ID NO: 152 - DNA, 669 bp, Sorghum bicolor
agctaggcgctataccaaccatgagcgacctgttaacctacatttccaaggttatgtgcatcaaggcaagatcggaggcaacacaggccggcgatgacggcggttgcccagcggatgagtgccgcgtctgcctgtcaaagattcggctcgccgaggctacccggcgtctgccatgtcggcatgttttccaccgggactgcgtcgaccgatggctcttgtcctgcaagcggacctgtccgctctgccgagtttatgtgaccgatgggaacaagcagccggtggcggcgaagcacaccagccgtgaagcacaggcactcgccgacgacctggtgatctggttctccaccgtgctcgtccccggtttctgatgccaaatcccctcttttgttcgctcgatcgaatgcttggtgtgtattcttttatatatttcaacacatgtacgtacctatgttatacttatcgatctttagaacagtttttagaaaatgtgtgtattgtagcatcttgttggatgaattttattcgaacttttgcacttggagctgattactgcaaataagaagtccgagaaaatgttgtcggcatttattgtactatatatggtgttgtttgtgtgtacaaatgttagcataaatgtagtttgttgcacgagtgttcactgattcgaaa

SEQ ID NO: 153 - DNA, 1301 bp, Sorghum bicolor
gatggagtacgagtctaccacgcttcaccatttccagaaacaaaagccggacaaagctacggaaggaggaagaaggcttgtgcagaatcagaacccagcaccatggcgggatccgcgttcctcaacgccctcgtcctccgcgcgccatccccatccccgtcgctctcgtgctcgtcctcgtctacgcgccgcagcgccggcgccttcgcgttcccgaacccaccgcgcctcccatctctgcgttctgcgcgccgcgtcgtccttgcgcgggcggcggcggcgccgccgggcgcgggcggtgaccccgagcccgaggacgacgagtgggggccggagcccgagggcgggtccgctgtcacgggagcgaccgcggtggcggaggcgcctgaggcgccggaggcgagagaggtcgcggagctcaaggcgcagctgaaggacgcgctgtacggcacggagcggggcctgcgggcgtccagcgagtcgcgggccaaggtgctggagctcatcacgcagctcgagacgcgcaaccccacgccggcgcctaccgaggcgcttacgctcctcaacggcaagtggatcctcgcgtacacatcattttcccaactgttcccactattggggtttggcaatctgcctgagctcgtgaaagtggaggaaatatcacagaccattgattctgagaacttcacagtgcaaaactgtataaagttttcaggacctttggctacaacctcagttgccaccaatgcaaaatttgaaatcagaagccccaagcgcgtgcagatcaaatttgaagaaggcattgttggtacaccacagttgaccgactccattgtgctaccagagaagtttgaattgtttggacagaacatcgacctgagtccactgaaaggcatatttacatctatcgaaaatgcagcatcctcggttgcaaagaccatatctgatcagcctccgctgaaaataccaatcaggacaaacaacgctgaatcatggttgcttacgacctaccttgacgaagagctcaggatctccagaggcgatggcagcagcatctttgtgctgttcaaggaaggaagtactcttctaaactgagacccaaatcccgagtatatgatctttgaagatgaaccttgaagtagttatactgctgatgcttttcttttcttgtagtaatatactccgtcccaaaataatatactcttagactaggaccggtttaatccccaagttatataaactctgtatatatcacccaagacactacatgcaagttatccaatttcatccaatgctattct

SEQ ID NO: 154 - DNA, 756 bp, Sorghum bicolor
acagctctcgagaaacctccatccagtcgagggcaggctccatccttcctccagactccagaggcaccacagacacacacacaccaatggctcccagcaagctcgccgtggtcatcgccttggtggcgtctctcctcctgctcaccaacatcaacaccaaggctgctccgggtccgggcggctacccgccggctcctccgctcggccctccgccgcaccagatcgtcgaccccgccaaagactgcgggggcgcgtgcgacgtgcggtgcggcgcgcagtcgcggaagaaccggtgcgcccgggcgtgcctcaagtgctgcagcgtctgccgctgcgtgccggcgggcacggccggcaaccagcagacgtgcggcaagtgctacaccgactggatcacgcacggcaacaggaccaagtgcccgtgagtgcggctgcggggtggcagcggcggtcagcgtgttccccggccgaaagcagcctcagttccatgggcgcaccactgccacgccacgtcttgtatgatccgaccccgtccgcgccgtagatgtactagctatctactccgtagtagtctacagtagctagctcctggttgatgatgctatgctgtgttgtttgtttgctggtagtactgctctatccttgtgatgatgtcgatgggctttctgtaaaaagggcgtgcctttctcagtttctgtagcagtaaaatccatctgggttggatcaatgtgcccattttctagcttgtttgccaat

SEQ ID NO: 155 - DNA, 1349 bp, Sorghum bicolor
atttcctttcgtattatcctcttgctctgttcgtccggctcttcgccctcgcggcctcgccggcgcgcgggactactaatccaaattggcgacgaccctgccgcccgccccactgcagattcggggagcgcaccgcccgctccaatggcgattagagtcccgtccatggagcttcaccgctcctcgccgctgctctccggtggccgagggaggaatacatgcccacagaagaagcccttccttgtccaagcaaagagactaggggggttggagaaagcgagtacgaggttaggaacacaagagtctggacaaccaaagaaaagagcacccctggttcgtggaactgttagcccacctcttccagtaccaggaaacatacctcggcctccttatgttggcacaaaatatgtaccagagatagcaaaagaggtacaaatgcacgacaacgagagcattgtccatatgagagctgcttgcgagcttgccgcccgtgttcttgactatgcaggaacattagtgaaaccctctgtaacaacagacgaaattgataaagcagtgcacaagatgatcatcgatgctggagcctatccatccccacttggatatggtgggtttccaaaaagtgtatgcacctcagtaaatgagtgcatgtgccatggaattcctgattcacgcgagctacaggatggagacataattaacattgatgtcactgtctacttgaatggttatcatggggatacctcaaaaacatttctttgtggagatgtcgatgaagcaagtaaacaacttgtgaaggttactgaagagtgcctgctcagggccatatcaacatgcaaacatggtaccagcttcaagaagattggcagaagaataagtgagcatgctgaaaggaatgggtttggtgtcgtggagtgttttgttgggcatggagttggcagagtatttcactcagaaccaattatctatcaccagcggaacaacaggccgggtcagatgattgaagggcagacgttcacaatagagccgatcatatccatggggagcatcgactgcgacatgtgggacgacggctggactgccgtgacgacggacggcagcttggcggcgcagttcgaacacacgatactgatcaccaggaccggagctgagatcctcacgaaatgctaggagaagtgttgcttgtgcccgttagctgttgccacggcaatctgtatccgtgctgatgcctgacgtggtcgattgtctatttgtctcgctaattggcgtgctacgaaatactgaagaaaaggctgagagattgcaatggcaggtttgggcaaggaggacaacttctcgacgtcccgatc

SEQ ID NO: 156 - DNA, 1293 bp, Sorghum bicolor
ctccctccctcctcccgtccgttgctcctgcccgcgcctccaccagtccgtcgataaagctgcggcattgggacggcgggaggtacaaggagctttccgctcattgcttccccatctcgtgtaggctctccactccgcactcccacgcctgataccattccgccgccgccgccgcctctgaacccacggtgcggcggagatccagccgggcctggatcggcctactccgacactgctttgtgaagataaacaagactgcttgctgtctgctgggaagtggactaagctcacggctgatatcatctgccttgaaggaaccagtgggagaaaagggagtggacagggcccaatcagaagcatggacaaaactgccaatgtggtattggatattgaaggtctgcctcaaccacctgataaatgctgctccggaagtccaaaaatgattagggccttatcacgcaagggttcaaataggatggaaaggaggggcagtgatgagctggagcaagaggatttggcgaaaaaacttatcatcaaagttgtgccgtctcaactggagcagcccctgggccagatcaaggctctggttgctccacattgtactccctgcacacctgttcttattgattctggggaaggaaggagcaaaaggttcagccgattcacgtctatcaaccctcggaaaatcctcctcttattcgcaacgctgtcgagtgtggggacgacaatactgatctacttcacactggcaatcaacagcaaagcggaggcgtagtcgtttgcagacaccaccaccatttgcttcggcggcagcagcagtacattccgagcttgagtttttctcgatttgtttgtggggggaagaagaggaccagatcagatgcagccagtttcaggtgtctccgtgtctgtatccgtgactgagtgagagacactgctaactgcttgagggggtgctcgcgcgttgtacttgtaatttgtattgccttcagttcacccccctcacctcccaaattcccgtcttccttgcgtgtatgtatattggtttggttgctgtgactttttttgagtctatggagatagaggagccattggtgtttggtgtgctgtcctgccgcgtggtgcagtgagctggggtcactggctcagtgatctctgccggttggtcgctgatccagagactcctttcttttgctgcgtcgtgccccaggccccagctgtaaaaaaagttgatagccgaataattggggaagttccctgtggagacctgctccaaaccgggtgcctgtgctg

SEQ ID NO: 157 - DNA, 1485 bp, Sorghum bicolor
aagtgccaactgccaagtgctcaacaccacgcgaagaaccccccgtcccaatccggcacggcacactcgccgccatgctccccgccgccctccttccctctccgccggggcgcctcctcgcttccatccctctccgctgccacgctccgacccagcagccctccaccgccgccgccgccgccgcccgcggcctcctcctcggcggcgcgcgctccccggtcgtcaagcgcgtcccggacggtggcgggtggctcctctggcaccagtccggcccccgtgtcgcgctctccacctctatggacggcctccgctggagcgcccccgtatcccccgacccactgctgcccacagaggactggtgggcgttcgacaccgcctctgttcgcccctccgacgtcctcctcatctccggccccgcggcgtcatcccgccgcttcccgtcctccgccgtgtactggctctactacacgggctccaccgacgagcggttcggctccccgtttccggacgccgacgtccccgcgctccccggcctcgctatcagccaggacggccgccactgggcgcgcatcgagggggaccaccacactggcgcgctgttcagcgtcgcggaggatggggaggaaccccgagggtgggagacgcgctgcattgtcgcgcccaaggtggtgatgcacgcagacggggacctgcggatgtactatcactcgttcgacgaaacgtcgcagaggcctgcgatcggtttggccaggtccagggatggcatccggtggaagaagacggggaaggtgcttgaggccgggcgtgctggatcctttgatgaatgcggggtacgacatggacatgtggtccgtgaccgtgctgccgggcggtatgtcatggtgtttgagggtgttgatgcagatgggagagtgagcattggaatggccgtttcagaggacgggcttaaagactggaggcgctccagcgagattccagtgctgtgcccttctgacgatgatgacgggtgggatggcgctggggttggttcaccatgcttggtgcaaatggatggggcctatgattggaggctgtattacatgggtgttgggagggacggcgaggcttccattgggatggcgcattcagagggtcaggctcttctgaaattcgagaagtgtgatgctattctcatgtaagatgtaaggtgaggtcttagtagtttcaggggatgtacatgtggatatgttttgacctttctgggggtgttcaattcacattcacttgaaacaaaacaaaatgttacgatttaaaaacttttacctcagcttattgcattagtattgtactgttcttatttgctatatctgcgtcttccataaaaaaggtggtcctattgaagtccattagttgataaatggtggttattaaaaaaaacctttggatcattaagtttgttagggagaacaaatgaaaactgtaggaatgtagattctgactcataaa

SEQ ID NO: 158 - DNA, 1112 bp, Sorghum bicolor
ccccgccactccctcccgcgcgcgcgccgtgcggtcaccgcccgaggccacggcaccgccggccccggcctccccggccgccaagaggaaaggcaaggcctcctcctcctcctcctctccaccgaggtcgcgccgcgcgctcgccgtcgcgatggccgcgtcgctactcgtgctcgccgtggcggtcctggttgccgttggccccggcggcatcgatgggggcgcagctgctcccgtggaggtggagggctccgaggtgacctacgggagtgtgatcaagctgatgcacgagaagacgaagcaccgtctgcactcgcatgatgtgccctatggctcaggcagcggtcagcagtctgtcaccggctttcctgaaggcgatgactcaaatagctactggatcataaggcctactccagattcatcgtctaagcaaggcgatgccatcgaaactggtggcatcatcaagttgcaacacatgaggacacggagatggttgcacagtcacttgcacgcttcaccgttatctggtaaccttgaggttagctgtttcggtggggatgaattgtcagatactggtgactattggaggctagaaattgaaggaggtggaaaagtatggaaaagggatcaaaaggtacgacttagacatgtcgacactggaggttatctgcatagtcacaacaagaagtacaatcgccttggtggtgggcagcaagaggtctgtggtgtccgagagaagcgagctgagaacatttggttggcagcagagggtgtttatctcccagttaccggaagcaagtgaaaaagcagttaccagttttaatgttaattagtataggatcagatattttacccgctttcatccgttcttgttttttcttgagaaaaatgaacatgggacctgacccctagtcatatgttgaagttggaatgtttgatatcgatgatgtcgacaaaatcaggacagtgcatgcttgtaactgatacttattatccatatatgaccttgtagagacccagagatgcaagtgtcactttgttcacaactagagatgccgatcatcttccggatgtgacgcagacagtcctggcaaatctttttgagttttttt

SEQ ID NO: 159 - DNA, 1630 bp, Sorghum bicolor
aacacacagagctatcagcattcaacactcatcaacagccaacagctagcgagagagagagagagagagagagagtacagacgagagggggacagacagacagagacgatgaaggtcgacgtggtggggacgacgctggtggcgccgagcgaggacacgccgcgccgggagctgtggctgtccaacctggacctggccgtgcccaagacgcacacgccgctcgtgtactactacccggcgccggcgccggcggccgccacgggcacggacgacggaggagaccgggcggccttcttcgcgccggagcggctggaggcggcgctggccagggcgctggtgccgttctacccgctggcggggaggctgggcgtcggcgtgggcgagggcggacgcctgcgcatcgactgcaacgcccagggcgcgctcttcgtcgtcgccagggccgacttcgccggcgaggacgtgttcggcgacaccgacggcggctacgagccgtcgccggaggtcaggcggatgttcgtgccgttcgtgccgtccggcgacccgccctgcgtcatgtccatgttccaggtgacgttcctcaagtgcggcggcgtggtgctaggcacgggcatccaccacgtgaccatggacggcatgggcgcgttccacttcatgcagacctggaccggcgtggcgcggggcctcgacgtcgccgaggcgtgcggcccgctgccgccgttccacgaccggacgctcctccgcgcgcgctccccgccgacgccggccttcgaccacccggtctactcgccgtccctgctcaacggccggccccgccccttcgtcacccgcgtgtacgccgtctcgccgaagctcctcgccgacgtcaagtcccgctgcgcgccgggcgtgtccacctactgcgccgtcaccgcgcacctgtggcgctgcatgtgcgtggcgcgcgggctggcgccgtgctccgacacgcggctccgcgtcccggccaacgtccgccaccgcctccgcccggcgctcccgcggagctacttcggcaacgccatcgtgcgcgacctcgtcgtcgcccgggtggaggacgtcctggaccgcccgctcgggttcgtggcgcaggccatcaaggacgccgtggaccgcgtcgacgacgcctacgtgcgctccgtggtggactacctggaggtggagtcggagaagggcagccaggcggcgcgcgggcagctcatgccggagtccgacctgtgggtggtcagctggctcgggatgcccatgtacgacgccgacttcggctggggcacgccgcggttcgtcgcgccggcgcagatgttcggcagcggcacggcgtacgtgacgcagcgcgccaacaaggacgacggcatcgccgtgctctttgggctggagccccagtatctgcagtgcttcgagaaggtgttctatggggagtgagtcgtgagattactacacttgactaatgactagtgccatccgcgtttcaccgtgagcaccgaccaccgagtgtggtggttacagtagctgagcctgatgctctggatgtgtgctgtgtgcatataaaaaaaaaatcgctccgatttctgtgtcactctagtctcctcgtgtcttcttctcggtggtcagt

SEQ ID NO: 160 - DNA, 670 bp, Sorghum bicolor
caaccaaagcaagcaggaacactcacctagctactctctcgcttactagaaggtccaagaacactagagcgacaatggcgccgtcctcctcctcctcgtcggcggcggccgtgctcctcctggcggtggcggtggccgccatgctcgccgcctcgtcgacaccggtgctcgcggacctgacgcacgccaactgcgccaagaacaagaaggtgacggtgcagaacctgtgcagccacgacgtgacgctgacgctggagccgctggcgaacagcccggcgctgttcgccggcgcctacacgctgcacccgcacagccacgccgagttcccggtgtgctggtggacggggcggctccgggcgggcgccgacgccgccgtggtggagttccacgtcggcgtcgacggcgggtccttctacctggccccgaacgcgcagcccgggcagcgcgtcccggtctccgtcacgccgcacgggtcgccgctccaggggagatgccccgccgtcgggtgcgccgtccaggggaggtgctccgtgcaccaggtgcccagcggtgactgccggaacgtgcaggagatgaagatcatctactgcaacccgcacgtgtgatctatctatcctccattgttatgcatgctagctgcgactggtgatgtcgtcgtcgtcgtatgcgt

SEQ ID NO: 161 - DNA, 3108 bp, Sorghum bicolor
ctcctcgtcgctcgctccgggcgtgcattgcatctctcctcgtatattcccgtcccaatctccaactccctcctcaaatcccgacccgctccgacacaaatccgcgcttctaatcccgattccgccgccaaaatccaaccttgcgccgttctcgtccccccccaattcgtggatcactgggccggccggttcgggcgcggagatcgagtctcccgtggcgctcttgttgtagccgagctgggattttcggtggcaattgggggcgtggagcacgatctttctgtgggagtttggatttccggtcggaggttgttggtagtgtggtcgccgggagcctttttttttgccggaaggcatcggtttcttcgccggaggggcgggctgtttgaccgaccgccggtacggtgatggtggcgaggatgatgcggtggcctcggcccccgccggcgcgaaacttccgcgtccgcctggtggtgcggcgggcggaagggctgcctccgccgccttcgcccctctcgcctgaggggtctcccgaggccgaggcgaaggtgtttgtagaggtgagctggaagggccccaagatgtcgccgctcacctcgctgcggcggtcccagcggccgcccaggaaccagacgcggaaggaggcgctgccggccgtcgccacggccgacctcgaggatggcgccgccgccgctcctgctccggcggcggtgtcggcggtggcctgggaggaggagttcgagagggatgcggcgctcacggcgacgtcgcaccgtgaccccgctgtgttccatccctgggacgtcgccttctccgttgtcagcgaatcaaataaaatgtcaaagagcaaacttgttctggggactgcttcactgaacctagcagattatgcatctgccgctgaagaggaaatcgagataatcctaccattgtctgtgcctagtagtgcaatggacctggccccatcactccatcttactttaagcctggtggaactaaggatatctcaacaatcgcctggtgcttcacagcgttctgttattgccccattgtcaccttcctctggtgactctgttccttctggaaaagatgaggtttctgtcattaaggtggggctgagaaatctgaaaatcctaagagatctagtatctacacggaggttcaaaaagactaaccaagattatgacggcagtgaggagaagtattatgttcacagtgatggtgcagaattttcttgtgatactgactctcttgatgatgacctggatgatagagagcaggatgatgagtttgggggttcagcagtcaggaagtccttcagctatggctcactgcagactatgaatgtcggtgccctactttatgcacctaggattgatggagatgacgagggttgggtacattacagccaccgaaattctgatgtcagttatcatgttgagcaagtgccatcctccacagctgaggagcatgcttccatcccattgcggcggaagaggagcctacttccagctcgatggagaaagacaaaattaccaaaggctaaaggggagcctcttttgaagccatatggagaagagggtggtgatgatattgactatgatcggcggctgttgaccccttctgatggatctgtttcagagggatcaaatggctctggtaatagtatggtgtcggtatttggtgatgatgattttgttgtggggaactgggagtcgaaggaagtatttagccgagatggccacctgaagctttctacacaggtgttctttgcatcaatagaccagagaagtgaacgggctgcaggggagagtgcttgcacagcactggtggctgttgttgcagactggttccaagcaaaccaagacctgatgccaatcaggtcacagtttgacaacctgatccgagaaggctctttagaatggaggaaactttgtgagaatgagacctacagagaacgctttcctgataagcactttgatcttgaaaccgtccttcatgcaaagatccgcccactcacagttgcacccagcaagtcgttcattgggttcttccatcctgaaggtactgaggatgtatctggatttgacttccttgatggcgcaatgtcattcgataacatctgggatgagataagccgagcagcagagtgctcctctggaaaacctaccatatacattgtcagttggaatgaccacttttttgtcctcaaggttgatgttgatgcttattacatcattgatacacttggtgagaggctgtctgaaggttgcaatcaggcatacatattgaagtttgatgacaccaccaccattcacaaagtgcctgctgaaaagaaggaatcaaatcctgataccgatggacgccacaacaaggattcctcagagatctgctcagctgagcaggacagtggaacggacactgaagagtgtgagcttgtgttgaagggtaaggatgcatgcaaggagtacatcaagagcttcttggccgctatcccaatccgggagctgcaggctgacatcaagaaaggtctcatggcatcaactcccctgcaccaccgcctccagatcgagttccattacacggaatcttgccctgccgagatcagcgtgcctgctccactgtccccattcgaagccccttttgagttctgttggcctgagccaccatcacccccacctgccactgaattcgctgtaacctatcctcctgccatggaggtcgccataacccaggccgttgccgttatatagctgaccttggttgctgctgtgactagggcagtggctgcgtagtttataacatatagagagctgcgcttttcagagcgaattgtgaagtggaccagatcgaagatttggcttcgtttctagtttgctcgtttgctgtccaaagtccaactaagatgaactgactagtatagcttaactgtcttttggtctgcgtgtgtgtgtttgttttgttcacttcttccaggcttttggggagcttccattttgtaaagaaagaaaggatgtttgctcctgcacatctttacctgtgaagtgagtttgctggacttgtaatcctggctacattatcattatgttaattatgtcctgttctctg

SEQ ID NO: 162 - DNA, 1687 bp, Sorghum bicolor
gatcgctgattctgatttggactgcaccggtgcaaggcctcctgcgctgcctgcctggcaacgcacgccggagagccgcgacgccccccgtccacctcctctcccctgcgttgtcttctccgtctctctctctctctctctcttgtcgccgccgccgccgctggctggattaatcggtcgatcgcgcctgccgatgcatgagttgctgagctaatcgagctgaggccgcccgccgcccttgaagaagacgaaggcgaagacgactcctcccaggccggcaggccctccttctttcttgatcgaattgaagcagcatctcccatgctgatcggcatgccgcagggagcagcagcaacagccgtggacagcaacggcaaggacggcggcggcggcgccaaccccactagcacggcccggccagcggcggcgctgcccctgaagctcctccgccctctcctcctcttggcggtgctgggcacggggttcctcgccgtcgtggtcctgttcctcggcggcccgacctactcggccatgctcccgcggctgtccctcgccccggacgccgtgctgcctgcgccagcgtcggcggggaaggcgccgctggaccggtggaagcgggcgcccgcgtccgcctggcacaacatgaccgacgaggagctgctgtgggcggcgtcgtggcggcccagcgtccggcggtacccgtaccgccgcacgcccaaggtggccttcatgttcctcacccgtggcccgctgccgctcgcgcccctctgggacaggttcttcgccggcgccggggacgccgccctcttctccgtctacgtgcacgccacgccgggttaccgccacgacttcccgccggcgtccgccttccaccgccgcttcgtgcccagccaggtggctgagtggggcaaggcgagcatgttggacgcggagcggcggctgctagcgaacgcgttgctagacccggcgaacgagctcttcgtgctgctctccgagtcgtgcattccactctacggcttcccggcggtgtacagctacctgacgcggtcgagggcgagcttcgtcggcgcgttcgacgaccctgggccggcaggccgtgggcggtaccgggctgggctggcgccggaggtgcggcgggagcagttccggaagggcgcgcagtggttcgagctggaccgggaactcgccgtcgacgtggtcgccgacgagcggtactaccccaagttccgggagcactgccgcccgccgtgctacgtggacgagcactacctgccgacggcgctctccatcgaggcgcccgcgcggatcgccaaccgcagcgtcacgtgggtcgactggtcccgcggcggcgcgcacccggccacgttcgccgggaaagacgtcgacgaggcgttcctgaaacggctcacggcggcgcccgcgaagcagaactgtacctacaatggccagccgtcggaggtgtgcttcctgttcgctaggaagttcgcgcccagcacgctgcggccgctgctcaggctcgcgcccaagctgctaggatatggctgactgtcactgtcactgtcactgctctgctctgaatctgaatctgaattttctcacagggaaccatactctgctttaacaactttctactagtatgactaaacagatgtggttgattggtataaaaagctgctctagaccccat

SEQ ID NO: 163 - DNA, 870 bp, Sorghum bicolor
cagcaatcaccaatctcgcctctcgcatcgcaatcgcaacacccaagcaaagcaaagcctcgcggagaaggaagcaaccggccgatcggaatggcgatggcaccgtgcgcaccggtctcctccgttcccttggccgcccgcccggcggcgacggggtctccttcgtctgtccgtccgcgcgccgccgccgccgccgctggggtggtccgcgcggctggggcgacggagggcggcaggtggtgggcgccgctgctggggtggtcggggaaggccgactacctcgaggccccggcgccggcgccggcggtggcgcaggacgacgaggcgggcgcgcgcggcaggcagttcgtgggtggcctgacggaggagaaggcccggcagctgcgtgcgcggatggcgcagaccgagtccttccacgacgccatgtaccactccgccatcgcctcccgcctcgcccgctccgcctaaaccggaagcccgcccggccgggaagcaagtcgccgacgtcgccgtagatctagagctccacccattgtcgtcgtgtgttgtatatacctaccagtcgtttcctttccgtttcgggggtcggggatgtgtttgtttcccctcctctccccccattatcgtcgtcgtcgtggagcaggagggtgagggatctgccggttttacgaggcgcccccctcccctgctctgctctgctctgctccgtgctccgataggatccggagcccgccgtcctgaaaccatttccgatctgcgctggaatggcgcagatccgcgaagcgtttatgcattgtactactgctacttgatgatgaaattggataatctattattgctgttgctaaattttcaatgctcccctgccag

SEQ ID NO: 164 - DNA, 852 bp, Sorghum bicolor
agcttggccgcgcgagagatggagaagcaggcggcggcacaggcgcaggcgcaggagcaggagcaggagcagtggcagggcgcggtggaggcgactctgccgtcgacgccagcgtccgcggcgtggccgcacatcgccagcttctgcgcgctgcaccggtacctcgcgagcatcgacgtgtgcgagctcgcggaaggggaggacggccggcccgggtgcgtccgctacgtggcctccctggcgccgggcaccaccacgggggagatcggcatctgggcgacggagaagctgctggagatcgaccacgacgcccggcggctcgcgtacgccgtcgtcggcagcagcttggggttcggcagatacgtcgctactatgagcatcgtcgctgctgacgacgaggacgacgcggggtgcaggctggtgtgggcgttcgagtgcgaccccgtgcaggggtggagccgggatgggatgctcgcctacctcgacgccggcgtcaagggcatcgccgcgcggatcgaggaagcccatgccgccgccgccagcgccagtgccggaggagacggcggcgtcgctgcttgacaactccatctgcgggcgggtggaatctcaacagtcgccagatgcatttctatattgaattgttattacgtcgtcaaactaattaatgcattgttaattgctactagcttgcttgtttgtctctccttcattgtctaccggccggatttgtatgtatatgtatgtcgcgtcgcgtcagagtgtcagctgaatgcatgtacgaattaacgtgaaagggactgtgcttgttggctcatgcttgtttttattctggcgatgtccatgtcgatgcat

SEQ ID NO: 165 - DNA, 2182 bp, Sorghum bicolor
ctccctccctctcgcgctctctcggcttcctcgcttgcctgtctccctccctccggactccttgctcgctggttcgctccgggtctccgtccgtctccctcacctgtcaccacacccacttccaccttcccgtcgttcctgtccgtcctcggtccgctccaacggctcctcgtggcgtggtcacaagggaagccgcccatccagaggtggaaagagcttaaccccggtgaagactggaatctgagccacccgcgctccgatctgtcttccgaaggacgcggagggaggaaggctccggatcgaggatttgcgtctccttccggtccggcacgccttgatgtataaatcggcctttgcttctttgtaggcacactcaaaagcagcgtttcccctgtagggtggcgtgatctccactgttctataagtggagcagccacgaaggctgtcggaacctccttcgctgttatatattggcaggctagagccccaagtttcctgaaggctttgctgccctgttctagttggcgaagatgtcgttccgcagcatcgttcgtgacgttcgggacagttttggtagcctgtcaaggcgcagctttgaggtgactatcgctggcctttctggactcaccgtgcatcatagggggaaatctcagagcacggtgcatgaggtctgtgatacggatctcataatccaggagagccgttgggctaatctccctcctgagctcctccgcgatgtgatccggaggctggaggccagtgagagcacctggccaaatcgcaagcatgttgtgtcctgcgctgctgtttgtcgagcatggagggagatgtgccgggagattgtgctgagcccggagttttgtgggaagcttacattcccagtttctctaaagcagcccgggcctcgagatggaatgattcaatgtttcataaagcgagataaatcaaagtccacatatcatctctacttgtgcctcagcactgctgtacttatggagaatggcaagttcctcttatcagctaaaaggaaccgcaaaacaacctgcacggagtatgttatctcaatggatgctgagaacatatcgagatctagcagcacatatattggaaagctaaggtcaaacttcctcggcaccaaatttatgatctctgacacgcagcccccttataatggggctgtagtccctcatgctggccggacaagccgaagattcaactccaagaaggtctcccctaaggtgccaactggtagctacaacatagctcaggtgacatatgagctaaatgttcttggcacgagaggccctaggcggatgcactgcgtcatgcactctatacccgcctccgcagttgagcctggtggcatagtccctggacagcctgagcagattctgccccgggcattagaggagtccttccgcagcaccacctccttctccaagtcatccatcatggaccggtccatggatttcagcagctcccgtgacttcagcagtgcccgcttttctgacattgccggaggcgccgccatagctggcgatgaagagggacagaacaaggagaggccgcttgtgctccgcaacaaggccccaagatggcacgagcagctgcagtgctggtgcctcaacttccgtggccgtgtaaccattgcctcggtgaagaatttccagctgatcgctgcgccaagcccggcccctgcccctgctgccagggctccaaccccatcgtcacaacctgttccgcaggaccaagataagatcattctccagtttggtaaggtggccaaggatatgttcactatggactaccgctacccactctcagccttccaggctttcgccatctgtttgagtagcttcgacactaaactggcctgtgagtaaatatagaccccgtggaagcaatggaacaacccggagctggcaatgcacaaggggagagatgcatttagccctaggattttagtttgatgcttttgcaatttgttgttttctctctgatggttgtattctgcttcctgttaacctggaaccggacctctaggctctaagcatgtatgttttcacctgctggcaccatggtaggtgccatttcgtgtaatgtgcataagattcagcccttaacgtgaatgaattgttacagtgttgattttccaaaaatttttggaactaaacaagggcct

SEQ ID NO: 166 - DNA, 567 bp, Sorghum bicolor
cttcacttcaccttgctctcctgactagcactactttgcttcaacagatcataactctggccagtgatctccggtgcgttgctgtagtaagcttgtgcgcagctcgagagcggatgccgccgctggcgccgacgacgacgtcgtcgtcggagccggaaccgccgttccggccgcgggagaagatcctggagaagcagaggtacttccagagcgtccgcaggccgacgtacctcaagggccgccacgacgtgatcacctccgtcgccatcccgctcgccctcgcactctccagcatgtacctcgttgggcgcgggatttacaacatgtcccacggcatagggaagaaggaatgagctctcgtagatgatggcgatcgcgctacgtcggtgctactgttgtctctgatattactgtgtgtgtaatgtaaatatagtgagtactcgaaggccatgtatattattgtgtccacgtccatgggagagtggtgccttgtgagtttgacagaggagtttgggtgcaacaggagcttgtattgatcagattaagaatctaagccgttgagcaaat

SEQ ID NO: 167 - DNA, 1726 bp, Sorghum bicolor
cgcctccgctctccccccaacccctcgtttttcctctgcgcatttcctcgtttccagctgccttccaggcaacgacgcctcgcctccccgcccattccattcccggaccgaatccccctcgaaacggtcaaagccaaaaaccaaccgcgcgcggcggcggtaacgagaacgagacgcgcttgctgaatcaggagtaggagagtcgccggcgagcagcaatgccttactgcgaggtgggcagttacgccgacggcgacaagtgggagggcgtccgcctcttctaccgccgctacggccgcggcgcgaccaaggtgctcctcatcatcggattggcggggacgcacgactcgtggggcccgcagataaaggggctgaccgggtcgctggagcccgccgacgacgaggccgtgcggccggacgaggaggccggtgtcggcgcggccggagcggcggaggcggcccccgcggaagcggacgaggccgccggcggcggcgatggcatcgaggtctgctgtttcgacaaccgaggcgtcggccgcagctccgtgctccccaacaaatcctactactcgacggcaatcatggcgacggatgccttggccttgatggatcatttggggtggaagaaagctcacgtctttggccactccatgggtgccatgattgcttgcaagctagcggcaatggcacctcacaggctatgttcgctggcattgcttaatgttactggaggtggctttcaatgcttcccgaagctagatgggcagatgctatctcttgcattccgtttcttaagggcaaaaactccagaggaaagagctcttgtggacttggaaacacattatacgaaggaataccttgaggagactgttgggtcagttactagaagaatggtcctctatcaagaatatgtgaagggcatatcatctacagggatgcaatctaattgtggttttgaagggcaagtcaatgcatgctggactcacaatatgactactaaggaactagatacaatacgatctgctggttttctagtttcagttattcatggaaggtatgatattattgcacaattgtgccatgcaaaacgtctagcagaaaggcttcttcctgttgcaagaatggtagaacttcatggtgcacatctagtgagccatgaaagaccagatgaggtgaacaatgcacttatggatttgataaaggccaccaaatctgcgatgaaacctgaagagtggtcagcccagcctgagaacatatcggaaaccggggcactcatttctgcgagacccattaccgtcacgatgcaaacagatgaaggggtgatagtcatggggtttgagcacatgaggaacattgtaaaggtaatgaagccagtaagggttgcagcagttgagtcataagatccgaaggcatgtaaactattctcgagaccttgtgggagtcgagatgatactttcacttctccccggtacctcggagatgatgattttagagtaccatctccaacagatataaactgttctgacgaaaggcctgctcctgatagcagaataatacgagacagaaacattgagaaaaacagtgcgcgcctggacagaagtgtctaagggcacggttggtgtatgtacctgtacctgtaagagtacctgtaacttgctgcgctggtgctgtccaccatgctcctgtatcataccgagatttcaaatcgattctttgttacgttgct

SEQ ID NO: 168 - DNA, 832 bp, Sorghum bicolor
cacaagtctcagctactactcctagctcccaaccgaaccgaggagaaggacgccgtgcaggtgcagctcgggcgcgcgcgcggcgagcgccaggaaggagaagaagaatgtaccaggccatcccgtacagcgccggccggccgtggccgcagcccgcgccggcgatgggcgtcgaggcgacgacggcagcagcggaggagaggctgctggcggctgtgcggcagcagcagccggcgccggaggcggaggcggcggcgagggaggaggaggtgcggcgtgcggtggcggagtgccccgtgctcgtggtgggcaggcgcgggtgctgcctgagccacgtggtgaagcggctgctgcaggggctcggggtcaaccccgccgtgcacgaggtcgccgacgccgaggcggagctcgccggggtcgttgacggcggcgacgtcgcgcttccggcggtgttcgtcgggggcaggctcctcggcggcctcgaccggctcatggccgtgcacatctccggcgacctcgtgcccatactcaaggacgccggcgcgctgtggctctgatgtgaagaccaagccgttgttgttgcctctccatcgtcagcacttctttcttttttggtttccctgtccttgcttggaattaaacgatgatgtgttgttaacttatttttatttactcctagatcgactagatagacaggcatgcacataggactttaattcttttagttgaaaaaaaaaggttattactaggagaaatggagtgcgcatgtaagcgatttcctataatatagtatatatatttgtattttccgcatcatgtgaatatgaaagag

SEQ ID NO: 169 - DNA, 1658 bp, Sorghum bicolor
aactgctgcaggctgacggctgcacctacccccagcggccttgccgggaaggaagcggcagtggagccggccggcagctgcagctgcagctaccccgaagccccgcgcccccgccaccgccatggcaatccacctccgcgcccacgccttcgcggccaacccgctgcgtggcgtctccgccgccaccaccgccgtctccccctccgcggccgccgaggttctccgctcccttctcgaccccagctccgccgccgccgccaatccccagccgtacctctccaagatcctccctttccgccggggccgcccgcttgcgcgctccacggaccctcctcccgcgtccgcccccgccgcggcgccggcctggtgccttgcgtggctcccgccgtcccgcgtccccgggctcgccccggacgccttcgtcttcctgggcgcgcatgtcgagggcggcggcaaggaggccgccgcgtactgggcggtcgacgtcagcgagggcgagggagcgacggtcggtgggccggcggacggggatgggccgtcggcgtttgtggacttgaggacgctcatggtggccacggactggagcgacaagcacgccatgggggagctcgccatcgcaggacatgctcgagcactgctcgaatggcacagcacggcaaagttttgtggagcatgtggagcaaaggctgttcctactgaagccggaaggcgtaagcagtgcagcaacgagtcctgcaagaagaggatataccctcgaattgatcctgttgtgatcatgttggtcattgataaagaaaatgatcgggcgctcttaagtcgccagtcaagatttgtgcctcgtatgtggagttgtcttgctggtttcatagagccaggagaaagcctggaagaggcagtgagacgagaaacctgggaggaaactggtattgaagttggacaagtcgtttatcacagttctcaaccatggcctgttgggccaaatactatgccctgccaactaatgatgggcttctttgcttatgctaaaacgttggagataaaagtggacaagcaggagcttgaagatgcccagtggcacagccgtgaagacatcaagaaagcgttgacgtttgctgaatacgaaaaagctcagagaacaaatgctgccaaggtcaatcagatttgcaagggtgctgagaaagggcagagcctctctggtgacttcaaagtcgaaagtggtgagcctgctccaatgttcgtcccaggacccttcgccattgctcatcaccttatctcagcatgggcttttgagggagtaccaaagctgcctagttccttctcaaatctataagcctggaccctagtgttcagacacatcagatggcaggaactggatccctgggttggaggctcatggattatctctgtgttgttgtgagtgtaattctgatactattcattgccggttgtaataaaatgtcaatagagttaggtacagaagatttcccggaggatttggcatcaacggatatgtatatccttttttttttttacattttatcctttttgtatcacacgtaacattgcaaagatacaatgatatacaacacaaattgtactcatgcatttatacatatatatattcagatatctgggttcaatatccgaatctttcctct

SEQ ID NO: 170 - DNA, 1205 bp, Sorghum bicolor
ctacaagaagccgtccgcgccgcgcctttctccgctcccccgcgcggccggcgagctagggaggagacagagagatggacccggagaagcagcgccagcacgacggcgacggcgacggcgatggcgccgccgcggcggaggcggacatcgagcggctccccgtcgacctcctcgcgcacatcctctccctcctgtcttccttccgcgacctgtccatggctgggggagcgagccggaggtggcgctgtgccgtggagcgggcactggcgtcgcggcggcggctgagcttcgcgggccagcgcaccggcaacgacaccgccgcgcgcctcatccgcgccgccgtcaacctccgcgacctcgacatttcacgaagctgctggggctgccatattaccgacgaaggcttgatcaagatttcctccgcggattgcgtcggcaatctgacctccatatcgctctggggattggccggcatcaccgacaagggcgtcgttcatctggtttcaagggcttattctttgcagcacctgaacattggtgggacattcatcacagatgaatccctgtatgcggttgcaaacagctgcacaaatctgaagagcatcatcctgtggagctgccgccacgtgacggaggccgggctggtggcgctggtgaacaagtgccggcggctggagtgcatcaacgtcggcgggatgcgggtgccgccggagagcttcgtgggcctcctctccatcagccccgccctccagatcaggtccatccaccgcatcctcaacgccggcgtcggcgtgcaggtctcttgatcggatgatccatgcatgcattatccatggatgataaggatcatatgtgtcagtcagttacagtatcaagccataaacccacatttgttgccactgtgtttttcatggaaaaagaattgtcagaagggattcatcaaattatggatcaacatatacgtgtgtgtgtgtgttcctgttgtcttattgttgttgtaaagaaaaaaaggatacattgtcttgattctatcttttgtacatgtatacatgtaaataaattgtaccgatacttttcatctaaaaaaattgtaccgtcactgcaccactggaagtgctaggaactataggaagtgcgtgtgagttgtgtgtctgtgttgtgacactcatatatatcagcatcatatacttgttaaggttcagtta

SEQ ID NO: 171 - DNA, 1168 bp, Sorghum bicolor
acctggaacagagacaggcaggccgcagcggccatccctcgcctgagagatggggaggcagccgtgctgcgacaaggtgggcatgaagaagggcccgtggacggcggaggaggaccagaagctcgtcggcttcctcctcacccacggccactgctgctggcgcgtcgtccccaagctcgcagggctgctgaggtgcgggaagagctgcaggctgcggtggaccaactacctgaggcccgacctcaagcggggcctcctctccgacgacgaggagcggctcgtcatcgacctgcacgcgcagctcgggaacaggtggtccaagatcgcggcgcagctaccggggaggacggacaacgagatcaagaaccactggaacacacacatccgcaagaagctgctccggatggggatcgaccccgtcacccacctcccattgcaggagccgcccgctcctcctcctcctcctcctcctcctccggagcaggagccggacgaccaggaagaagaaccgcagcagcaagagcagcaggccgggaagctcatgcaggagggcggcgcgggggaagacgacgtcgcgccgatggtccagccgcacgagaccatcatggcgccgccaccaccgcccacgacggcggcaagcaactgcggctctgctgctgtttcctctgcctccgccgggtccgcgtccgtggtctcgccgtcctgttcctcctcctcggcctcagcccccgcggtgaccggcgtggaggcgacggagtggccggagcccgtgtacctgttcggcatggatggcatcatggacgccggctgggccggcctcttccccagcactggcgctggcgctggcggctgcttcggcttgggcggcgtcgatccgttcgaccagtaccccggcgtcggcgtcggcggcgccggcttcgatcaagatgacggccactggatgtgacgcgcgcgcttgatcgccgtccttccatctcgcttagcaagttactcctagcatcatagcgccatagcctagcttgtagcctccatgtgtttcttagctctctttggactgtgcatgcgtggccatggccgtcgatcgatccatccttgcattgctcggtcgttcaactttaatccagtgctgatataaaacaggaattgacaaattcgttcgggtgcgaaa

SEQ ID NO: 172 - DNA, 863 bp, Sorghum bicolor
acaccagtcgaggcagtacaagttctccatcacctgctttccttttcttttgccgttccacatcgattcgtctcctctctctctctctcccctccgctcttatccccgctgcgcctcctgactttcctcttcgtcgtctcctactcttctcccacccgcaaccgccgcagagagagagagaaaggggaagaagctttccccagcgcagcagcagccgccgccgccgccgccgccgccgcagcggatcgggacctctgctctgcggaatccatccatggcggaggaatcaggccgccccttgccaaagtttggtgaatgggatgtcaatgatccagcttctgcagacggatttactgtcatattcaacaaagcaagagatgagaagaagggtgggaatggacaagacactgattcaccttccaaggacaccaggactgagagggtggaatcttatgctgcaaaaccaagcacgaagaaatggttttgttgtgtgacagccagccctacgcaatcctgaggaagacaagtgcatgcgctttggaaatactgtccctttaattttctatacatactatccataagacaatgtagaggtacccatgcctctcgggctccaggatgggtatctcgtaaactctggcgtgcgtgtatgtatggtgtgagagttgtcggcatacatttgaaaagtggactttctggttgtaattctagtcctgtctcttttttcatttgttggtgtatgtactagtgccttagtgcgggtccaaatttgtgcctaaggcctactttggtagcccattttcctggagggatctcaacgttttccctgggccaatttcctccgtgccaatcttccacgggcc

SEQ ID NO: 173 - DNA, 1394 bp, Sorghum bicolor
cctactcgtgctaaaacgcaaaaccccaaagcagctccacgatcgaacaagcacactagtctctcgatcgatcaccacaaaaaccaacacgatcgatcgatctcgaaaatcaaatcagcgcaagaaagatcaaggtcgatcgagcagcagcaaaactgatcatcgaggagatcgaacgagagatggcgatggagccgaacatggcgcgtcgcctgtggcacgtggtgcgcgccgtgctgttcatgctccgcaagggcatgccgaagcggaagctggccatggacctgcacctcctcgtccaccgcggcaagatcgccggcaaggccctcggcaacctcatgaccgcccacgggcacaacagccaccacgacagcaaggctgaggcggcggcggcggtgcctccgcagcagcagttctcgtcgtccggccgcggccgccgcgcactcgacccgtccctcgccgtctacaacccgcgcgaggtggagttcagctgcagcaacaccccgtcctacccgtccctccacctcaacctcatccccaccggcaagcgccgccgccgcaacaacaacagcagcagccgccgcggcacccaccgcggcgcgaacggcgccgagcccggctggtacaactacgacgcggccgacattgccagggtcttcgagatcctcaacaacaacgacggcggcggcgacaccagctcggaccaacaacaacaacaaccgtctcccctcgcgctgatcgcgacgccgtcgccggcgatgtgggcgagctttggacgcacgcccgcgcacgcgaggaagctcaggatcaccgactcgccgttcccgctcagggacgacgacgcggccggtggccaggtggacctggaagccgaggagttcatcaagaagttttacgagcagctgcgcacgcagcagagcctggccaccgccacgccggactactacggcggcgggtatgcgccaccggtctctggaatcgcctagaagccatgaagccatatatatatatatatatatatatatgcatccacattccacacacacacatatatatgtgtatatatgtgtccatagggtattagcttggatgaaccttaattttgttcataaggtgtgaagtgtgtgtcgtctgtgctaaactccatatactacatattagtagcagtgtttgtgcatgcatgcatggataaaagcatgttcgttgagagagcaagctactcatagagctagtctagagcttggtcttggtgagggagagagatgttgcacaacatcatgtttgcaagctagatccatgcatgtatagtatatatgtgtacacggtatgtgtaaattttgttttggcgcggcatgtattttgctgccagtaataagatatatatgttgcaaata

SEQ ID NO: 174 - DNA, 1076 bp, Sorghum bicolor
ctgcattgtctgtgtcggagagactcatcaccagagaggagatcgaggaggtgacgtgaggtgaggtttgcagcttgcaagtcggtcggcgtcatggcatacaacggccgtgaccagcggtacggcggcggcatcgctacgccggggtacgcaccgccggtgccgtacgggatgtcgcaggtgaacatcgagggcaacgggtgcggtcggccgctgccgccgcagccgaccgtgaaggtgtactgccgcgccaaccccaactacgccatgaccatccgcgacggcagggtggtgctggcgccggcgaaccccaaggacgagtaccagcactggatcaaggacatgaggtggagcacgagcatcaaggacgaggaaggttacccggcgttcgcgctggtgaacaaggcgaccggggaggccatcaagcactcgctggggcagtcccacccggtgcgcctggtgccctacaacccggacttcctggacgagtccgtgctctggaccgagagccgcgacgtcggcaacggattccgatgcatccgcatggtcaacaacatctacctcaacttcgatgccctccacggcgacaagtggcacggcggtgtccgcgacggcaccgacatcgtgctctggaagtggtgcgagggcgacaaccagcgctggaagatccagccctactactgaaccaactgatcgatgatgagatctatcgatgatcatccatcgtcgcgtcgatcgatcctgtcgtcatgcatggagacgacgtgcatgtacgtatggcctatgtatatgtatctatatatgtacgcatgtatacgcactagcagaataactgagcctcgatcatctcctatgccgtctgctcgtctttctgcacgcatgtctgtcagcatgtgtgcatattagataaagcagcaggagcgagatgaggggtactcatggtcatgtatatgtaccttgcaacaataagtagcgatacaacacatacttattatggaagtactcctacatacataataaagttgctcgggtgtattaacatatacgtatatgcctattataattatgattaattg

SEQ ID NO: 175 - DNA, 774 bp, Sorghum bicolor
cccaatccaaatgggacggtagagatcaccttcgcctcacgtctcgtctccgaagaagaagagattagatcctaggttactcctcgatctgaaaataaaaggctaggctgccggccgggataagatgatgatggagaagcagatcaggggggagcaccagcaggaaggagcagggcggcggcggcagcagcagcaggaggaggaggtggtggtggtgcacagccaggtgaggcggatcaagcaggaggaggacgagcgggcgaaagtgcacgagacgtaccagcaccagcacgtctccgagatgcgcgtcgtcctccgggacctcgacaggcagcgctcccgctccccgctcggccgcgtcgcccgcaccgccatctccatcggtggcgactcctagtctggctctggcctatggaattcgttcaagccgatcgatcccctcggggaggcggggtggagaaggcgggcgttctcggtcggcggcgacgatcggcgtcgtcctctcgccctcgctcttccctcgttagggttgattgatcgatcgatcgttgttaggatctgtttcggtcgtcgtcttgttcttggcatggtcggagtgctcgttgagatgcacgcaacatttttattctattgtttttagggtgatataatggatcaatcatgtaaataccttttttttcatcattcgatcgatctacaggggtgatgaacaagtcttctctatttaattaggtttcggggagaaaatatggaatgatttcttctttgagggca

SEQ ID NO: 176 - DNA, 1023 bp, Sorghum bicolor
aggagtccacggaattgaaaacccaccgcaccatttcaacctctcttccctaacctcgccgcggcacagcggtttcactgctcccctcacctccgctcccgaacggccggtctttgcatggcagcagcagctagttccaaggggcgggcgatcgctggaagcttcgtcagccgcgtcctggccggcaaggccgcttccccgaggagggccgtgcacgcctcggcgtacgacaagaacctggaggaccaggtgcggccggcgttcgtgccggacgatgtgatcggcggcggcgccgggaaccccgacaagtactggagcccgcacccgacgaccggcgtgttcggcccggcggcggtggaccccaagctggccgctgctgctggcgcgccggacgctgccgccgcgaatgctgcgggaggcacggtgctggaccagaaggtgtggttccgcccgctcgaggacgtcgagaagcccccacccgtcgcctgagcggcgctagctgtgccagcccacactgctgaattgctgataaggagagcctggcgctgatacacctatcactctgctcagctgggctccctccctgcttatcactgcagtatagtagcagtgcttgatagcggtgtggctgtgctaataccagcattatcaatataagtatataaatactggttttatagtagtgtagtagtagtatcaggcatggcgtgcatcagaactggctgtgatagtagcaacgtgatgctcgtgcctgtaataagaacaagcaggagatgtttgcctgtgctgcttgtgcctgtgatgtaccggtgttgttatcagtgttataagtacttgggtcactggtttgtgcctgtgtttcttacccatgacgcagttcatatactccatccatcccaaattctccattcgcctgttccacggcggaacgtcgacagcgtcatggactccaggactcaggcacttgtgtgatctgttgccagcttcaactaagaatcagatcagttgtccataaaaaaaaaa

SEQ ID NO: 177 - DNA, 2702 bp, Sorghum bicolor
agcactggttgttggtaggtgcacgcaccccgccccctccccctcctcctgccgtcctcgatctcgtctcctcctcctccccaccctatccctcccggcgggcgggggaggaagcgagcgacgatggcggcgctggaggcggcgaggtcgtgggcgggctccgtcatcccgccggagctcgccgccgccgcgggcggagacccgctcgccgcgctggcggccaccgccgcggccctcgtcgcggggctgcttatcctcgccgtctggttccgatccggaggcggcgcgccgtccaagccggtcgccgcgccggtacgcccgccgccggtcaaggtggacgccgacgccgacgtggacgacggccggaagcgcgtcaccatcttcttcggcacgcagaccggcaccgccgagggattcgccaagtccatggcggaggaagcgagggcgcggtacgagaaggccgtgttcaaagtggtggatctggatgactatgctcaggaggacgaggaatacgaggagaagctgaagaaggaaaccgtggtgctgttcttcttagcaacatatggggacggagagccaactgataacgcagcaagattctacaaatggtttactgagggaaaagagaaggaagtttggctgaaggctcttaaatatggtatttttggccttggaaacaggcagtacgaacattttaataaggttgcaaaggtggttgatgagctactagaggagcagggtgggaaacgtcttgttcctgttggccttggagatgatgatcagtgtattgaggatgatttcactgcatggaaagaactagtgtggccagagttagatcaattgctccgcgacgaggatgacacaactggcgcatcgactccatatactgctgctattcctgaatacagagttgttttcattgataaatctgacctgtcattccaagatagatcatggacactagccaacggtactggtgtgattgatattcaacacccttgcagggctaatgttgctgttcggaaggagctgcacaaaccagcttcagatcgctcttgtatccatcttgagttcgacatttctggcactggtcttgtgtatgaaaccggagatcatgttggtgtatatgcagaaaattctgttgagactgtggaggaggctgaaaggctacttgacctttctccagatacgttcttctccatccatgcagatgcagaagatggatctcctcgtaaaggaggaggttccttggccccacctttcccatctccatgtaccttgcggactgcgcttctacgatacgctgatctactcaatccaccgaagaaggctgctttgcttgctttagcttctcatgcatctgatccagctgaagctgaacgacttagattcttggcttctcccgctggaaaggatgagtactctcaatggataactgctagtcagaggagccttattgaagttatggctgcattcccttcagctaagccaccactgggagtgttttttgcagcaatagctcctcgtctgcaaccacgatactactcaatttcatcatctccaatgatggctccctccagaattcatgtaacatgtgcattagtttatgggccttcaccaacaggaaggatccaccaaggagtttgttcaacatggatgaagaatacaattcctctggaatatagtgaagaaagcagctgggctcccatctttgtgaggcagtcaaatttcaaattacctgctgacccatccactccgattatcatgattggtcctgggacaggactggccccttttagaggcttcttgcaggaaaggttagcactgaaacaatctggaacagaactgggcacttcaatccttttctttggatgcaggaaccgtaatatggactacatatatgaagatgagttgcaaactttccttgaggagggggctctttctgagctaattattgcattctctcgggaagggccaacgaaagaatatgtgcagcataagatggtagagaaggccacagaaatttggaacatcatctcacatggtggttacttatatgtatgcggtgatgccaagggaatggctagagacgtacacagaatgcttcatacaatagtccaagagcagggatctttggatagctccaaaaccgagagctatgtaaagagcctgcagatggaaggcaggtacctccgtgatgtatggtgacacatcacccccaatcagccatagcttctagcgtgtggaattaaagctggctttgcgtgtatatgccaatccagtcgtcagctttggaaatgaagcgtgccattgattatatactgaaatgagttgatcagtgtaattctttgacatctaactatttattattatatgagatgggaggaactgagggagagaataagtgctgttgtagatttgtagaacttaaaaatttatgtatccctgacaagtttgtagccaaggggatacatcatacagtttgagatgaggacattatgtatactgtttgagacgaggacattatgtatactaagtactttagaaggccacctaaaacaaattttgcatctgtttttttaaaggcttgtgtttgtcatgctatccaagcttgttcgcttgtttgaaaagccgtgactgaagtactattatcgctgatttattatgagagaacaatattgatggctgatagaaaaagtatg

SEQ ID NO: 178 - DNA, 891 bp, Glycine max
aggatggagtagagcaacattaatacagcaaggcagcactgtgtttggaaatgtgcatcttttcttgggcccaaatgcaataattgttgtcctgttttctaccgttgaggcttctttctatcagctaagctaagcagtccaaagggcacaacacaacagagaaagaaaagagtaagagtatgggaggctcatggtcatggcagctcacatgtgccctcttgctactcttctccgccgtagtcaccgccactgaccacattgtgggtgcgaatcgtggctggaaccctggctttaactacactctttgggccaacaaccacactttctatgttggcgatcttatctcattcaggtaccaaaagaaccaatacaatgtgtttgaggtgaaccaaactgggtatgacaactgcactacagaaggggcagtggggaattggagcagtgggaaggatttcataccccttaacaaggccaagagatattacttcatttgtggcaatggccaatgcttcagtggaatgaaggtttccgttgtggttcatcctcttcctcctcctcccacctctgcagttgctgctcaacattcatcgccaaagtctgcttctcctgtgctcttaaaacgaggatttcgctcactgttggtgtctactgtttcagcttgctttggaattgtttggatttatcacttgtagagcttagtggctcattctttttccccttgttgtttgtatctttcatgtttgtttcggattcttgcctttcaaaagcttgcttgttggtgctgaattgtttctccctgtggctgtgtctaggttcccctttataattcagcctataattgtgttcctgagtcttgttagatgcaaaacaaaggaaatgggaattttcagg

SEQ ID NO: 179 - DNA, 1117 bp, Glycine max
gatattaaaaatggagaaaagtggaagacagaagatgaagcagtgtagtggtaactcttgtcaatctttccactttgacattgccgacgcctccagataaacaaccttaactttcccacaacaccacccatcattctttttctctctctagatttcatttagttgttgctgtcttcttctgtttgtgtgtgccaacacagagcgaaaaacatggctctgaaccaatcaaaagccgtgttgttgagggtgagtttggtggtggtggcgctcttcatagcagggtacatagtgggtccccctctctactggcatttcgttgaaggtttggctgcggtcaaccactcttcttctacttgtgccccctgcatctgcgattgctcttcacaacccattctttctattccacaaggactgagcaacacttccttcggagattgtgcaaagcctgatccagaagtgagtggagacactgaaaagaattttgctgagctattggcagaagaactcaagctacgggagaaccaagccgtggaaaatcagcaacatgctgacatggcattgcttgaggcaaagaagattgcatctcagtatcagaaggaagcagacaagtgcaattcagggatggaaacgtgcgaggaggctagggagaaggctgagttgacattagtcacgcagaagaagctaactgcattatgggaacttagagcgcgcaagaaagggtggaaggaagggcttgccaattctcatgcacactctcaagggaaagtacagagttcttagatacattacacggtctccatggaggtgagtggttgcataatactacaatagttttcaaatgctggtgatagcaaaagcaagtcatcgaggctcatatgtgttcacgaaaggtcaagtgtaaaatacaaatgttgttgtattttctatcattcttttttgggtatttattccatgtgtaacaccgtttaaagctagaaatcgtcaaatgttgggtaaaacttgcataaagaatattgagactatctttttgtattatttttttgcttctgatttgaaccaaggctcagactgttgcttcttcgttgtgtttaatcaattttaggtttgattgacaagg

SEQ ID NO: 180 - DNA, 2020 bp, Glycine max
aaatctgaagttgatatgatatacagtacctttttcttgaggaagatatgatataccatagaagttaaaatcatgtatgtgagtaaccccttagttttcagtgtcatctaacagagaggagaagagagtgccttgtaataatcatagcataaattcataaagaagagagagcataatagtgagagtgggagatggatcagctgttgtggagggtgttgcctttgctaacaatccttgtctcctttggagtgttcttctacttgcaggattcttacacagcacagttttatgctctcataaagttaccacgggataagtgcagccttcttccccatcgccacttctggatatccagcaaacgcattgtgaccccacaagggatcatttctggttcagtggagataaatgatgggaaaataatatctgttgtcgagggacatgctaaccaggggaagcctaagcaagaagaagtaattgattatggagatgctgttatcatgcctggcttgattgatgtgcacgtacatcttgatgagccaggaagaactgagtgggaaggatttgatactggtaccagagctgctgctgctggtggcgtaaccacagtggttgacatgcctctgaacaattatcctacaaccgtgtcaaaggaaaaactaaaacttaagcttgatgctgcagaggataaaatctatgttgatgttggattttggggaggcctaatccctgaaaatgcacttaatacaagtattcttgaggggctcttaagtgctggtgttcttggtatgaagtcttttatgtgtccttcaggaataaatgacttccctatgactactattgaccatatcaaggcgggattgcctgtgttagcaaaatataaaaggccgatagttgtgcatgctgaggttcaacaagattttgaaaaccatttggagcttaatgaggataaccttgatccacgtgcttacttgacctatctcaatgccaggccaccttcatgggaggaggcagccattaaacaacttgtaggtgttacgaaggacacaagaaaaggtggtcctttagaaggagctcatgttcacattgttcacttgtctgattcaagtgcttccttggatctgattaaggaagcaaaaagtcgtggtgacagcataagtgttgagacttgtccccattacttagctttctcatctgaagagataccaaatggagatactcgttttaagtgttccccgcccattcgtgatgcttataacagagaaaaattatggggggctgtattagagggacacattgacctattaagttctgatcattcaccaactgttcctgaactcaagcttatggaggaaggtgacttcttaaaggcttgggggggcatatcttctttgcagtttaatcttccagtgacgtggtcatatggtaagaaatatggactaactctggaacaattgtcgttattgtggagcaagaaacctgcaacattggcggggttagaatcaaagggggccattgcagttggaaaccatgcagatattgtagtttggcaaccagagctggagtttgacctggatgatgattatcctgttttcatcaaacattctgagctctctgcttacatgggaagaaggttatctggaaaagttttggagacttttgttagaggaaaccttgtgtttaaggatgggaagcatgctcctgcaccgtgtggtgttcaaatactagccaaatgagttagttaaatactggtttctttcagatgctagttacgttgggacctaaataagagatggaagtagatgctggcatcgaccactgacctagcattctccttctcatagactagtgcattaccaaatgtattattatcgtttgaatgtttggacaatgacataatgttgttcttttcttgaatgcgtatgtaggttacaattgtacaaattctcaagtccccctcttcgcataccatttcatgaaaagaatatgcatgtttcctaactaagaaacatcatgttgacat

SEQ ID NO: 181 - DNA, 1600 bp, Solanum lycopersicum
atcatatataccacacaataattaagagtcatacaagtcaaagctttctctcacataatactaattgacctcgaactctgaacttaggttctatttttaagtttgtgagtgtaaaaatggtgcaaccccatgtcctattggtgacatttcctgcacaaggtcatatcaatccatctcttcaatttgccaagaggctaatcgaaatgggcattgaggtgacattcaccactagtgttttcgcccaccgtcgtatggcgaaaatcgcggcttccacggcacccaagggcttaaacttggcggcattctctgatggatttgatgatggtttcaagtctaacgtggatgattctaaacgttacatgtcagagataagaagtcgtgggtcccaaacattgagggatgtcattttgaagagttcagacgaaggacgtcctgtcacgtccctcgtctacactcttctgctaccttgggcagctgaggtagcgcgtgaactccatatcccatccgcgttactatggattcaaccagcaactgtgctagacatatactactattacttcaatggctatgaggatgaaatgaagtgtagtagctcaaatgatccaaattggagtatccaattgccaaggcttccattactaaaaagccaagatcttccatcttttttagtttcatctagctcaaaagatgataagtatagttttgctctaccaacattcaaagagcaactagacacattagatggtgaagaaaatccaaaggtacttgtgaatacatttgatgcattagagctagagccactcaaagctattgaaaaatacaatttaattggaattggaccattgattccttcatcattcttgggtggaaaagattcattggaatcttcatttggtggtgatctttttcaaaagtcaaatgatgactacatggaatggttaaacacaaagcctaaatcatcaattgtttatatctcatttgggagtctattgaatttatcaagaaaccaaaaggaggagattgcaaaagggttgatagagatccaaaggccattcttatgggtaataagagatcaagaagaagaaaaagaagaagagaaattaagttgcatgatggaattagagaagcaagggaaaatagtaccatggtgttcacaacttgaagtcctgacacatccatctttaggatgttttgtctcgcactgtggatggaattcgactctagaaagcctatcgtcaggtgtacctgtggtggcatttcctcattggacagatcaagggactaatgcaaagttgattgaagatgtttggaagacaggtgtcaggatgagagtgaatgaagatggtgtggttgagagtgatgaaataaaaaggtgcatagaaattgtaatggatggtggagaaaaaggagaagaaatgagaaaaaatgcacaaaaatggaaagaattggcaagagcagctgtgaaagaaggtggatcttcagaagtgaatctaaaagcttttgttctacaagttagcaaaagttgttgaaaaattatgggaaattatttttctagttgtaattttcttttcttttttcataataaaatttagagttttat

SEQ ID NO: 182 - DNA, 1778 bp, Solanum lycopersicum
cttacatttcttattcatctacgtattgtttccttggaatttatcagttgttcaattcggtagttttagcgattgattgatcaaacagaagaagagtgagtgtatacgattttcttttaagttgcggaatgtcttttggcgagactagaactatagctccaaccgaaccgagtacggaagctgcaagaaggagacgcatggaaattcatcagtttcgatttgttgccagcgatatggcggtggctccaccgagtagtatggagaatggaaggaagagaaagaaattggagaaaactgtgtccgtaaaaagctatgatagtaaagagaagaagcaattcaagttggaaagaattgtttccctcccactttcgctgccgtgcactgatgtgggtgaaaagaagctagcagagaataaagaaaccgaaacgaacgctttggatttgacggaatctgcatctgtatcgtcgaatattgagcgccagggagtctccgactgtccgaaattcgggatgacatctgtatgtggaaggagaagagatatggaagatacggtgtcgatctacccgtcgtttcttcaggataaacatgaaaagtccagcatcttacatttcttcggtctctacgacggccacggctgctctcatgcggcgatgaaatgtaaagatagaatgcatgagatagtgaagaacgaggttgagagcgcaggagaagctacatggaaagagatgatgattcagagcttctcaaaaatggacaaagaagtagttgaatattcgaaaggagctggaggtacacaaactgcggattgtagatgcgaacttcagacgccgcagtgcgatgccgttggatccactgctgtcgtggccgtcctaactccaaacaaaatcgtcgtgtccaactgcggcgattctcgcgctgtgctctgcagaaacggtgtcccaattcctctgtccactgaccataagcctgatcgacccgatgaactcaatcggattgaagaagctggcggtcgtgtaatctattgggatggtgcgagagttcttggagttttggctatgtctcgagcaatcggtgacagttacttgaaaccgtatgttacatctgaaccggaggtgaccataacggagagaacagtggaagacgagtgtttgatattagctagcgacgggctatgggatgttgtgtcaaacgagacagcatgtggtgtggctcgcatgtgcttgcgatctgggcagaactctgaccaggcttgcactgatgcatcaatcctcttgacaaggctggctttggctcggcacagttcggataatgttagcgttgtcgttgttgatttgaaaagaggtctataggggattattaatttatatgttttgcatgtacatgtacttgtttcaattttagagctagccaaacaatatgattttcatttatcataggcaagatttttcgcggttggttcctgcgatgcaatgcaatgcaactctcctaatgaaagagaaactgcttgagctggagagcctctgttgtattactaagttggtgttctggacattcgaaacagatagcctacttttgatttttgcaggctttgttttctgctcaattggattgtttttattgtttaaaagtttttgcacatttattggagaagaaacttctacgagttaattccttcattcgctattgtttgtgatggtttcaatttttagaataactataaaaattttagagatgtatttttttatcatactaaaatataaaaattgtaatttatacta

SEQ ID NO: 183 - DNA, 1520 bp, Solanum lycopersicum
tttgaattcatccagcgcccaaactatcttcttcttcttcacctctctttcacacaaacccagaaaatgctctctgaatcctaaaattgaagctttaatctctccaagaatcaaactttaacaaccccaacaatgtctttaatcaagccatcatctcgttatgctaaaacttcttttgattcttcaagatcttcaactaaatctgacccttcttcttctacagacaaagctctaatcaaaatcaagaaaggttcaaatggggttactcaaactacccatcaatccaatttcagctcaatggtcaagaaatttgttgaacacaaatctgcttcttctaaattgatgaagcagcagcagcagaaaaagggtgatttgaaattggttattcctgtggattttatagctgaagatttgaagaaaacggcgaaaaggggcagtggtttgagttctctgcataagaaattgtttaaaggttcttcttctggtggtggtgtgaaaaaagaagaaggaagcacggtgaaggcgttgacggaggttaaagggaatacgaggacattaggaatggttcttagaagtgagagggagttgttaagtatgaataaggagcaggaggatcagattgttgagcttaagctaatgctcgaggagaaaaatcgagaggttgagaagcttaaggatttgtgcttaaagcaaagggaagagataaagtcactgaaaaattccatactgttcccggatgttatgaattctcaagttcaggatcttttggaaaagcaaggttcagaactcaaacaggcaaaacagctaataccaaatcttcaaaggcaggtcacttctctcaccggccaactacaatgcctagctgaagatctcgctgaggtcaaagcagataaatatgctataagagggagctatgactcttttggtagcccttccgaatatgatcaagaagaagcagctaattctctggaattcagctctgaggatcacacaattcccggtagtccagatgacatgtttctgaaggatgtaaacccctgcttaacaccttactatgccaagacaaaatccaaggaattcgatgacttcaactctcctgatgctaaagatttggttaaaaacaacattcaagtgtatcatgagtccagctacaattcctgtgcaaggaagctgtcaaaaagttcagattgtcgccaatgctccaatacaggcaacaaagcaactcgtgcagctcgtaggtctgatgaaagcaaatgtacttatggaaagcaggttcacagtaagttctactgagttgtcctctatcctgacaatgcttctcgagtgtcacaacgccttaaatccaatagcttgcccgttgacaacattctcaatgtcaattcctgttctgttcgatgtacttttcagaaatcaatctgcttgagttgcctaaaccaagtatgtaatcagcatacattttgttggtatgatctattaataagatgcatgtttggaggctaaattgtgttttcttaagattg

SEQ ID NO: 184 - DNA, 816 bp, Solanum lycopersicum
gcttaaacctctgttgtattaaagcgtgacagaccgtcggaggccggagtgaacaacaatggcggatgttcagagaagaggaagaccattacctcctcctccacccagaggtccacatggtccacctcctcaaaggattgctccacgccccgtaccagttgatcgcgaaaagacttgtcctctgttgcttcgtgttttcactaaggttggaggccatcacaatgttaatgaatttgctgtgaggggcaaggaacccaaagatgaggtccaaatctatacatggatggatgctactctgcgcgaactaactgatctggttaaagaggtagctccagaagcaagacgaagagatgcaattttgtcctttgcttttgtctatcctgataaaagggggcgatttgtcgttagagaggtggggactacattttcttatcccaatatgaggcgaccagataatggcagcaaaacattgagtgaacttaaatttcagataggagattacttggatgtggctatcatgttccagtgagcgttatgtcaccctgtaatggaattagaattacgcagacttgtattactttgtgtttcttcttaattcttcatatctgtatttttcttgataacctgacctattgttcatttttgctgtaaatctgagattatgtccagagttctctatgactagatctgtgatattacgatagtatgtcatgggatttaactgcattcttcttatgaattgtcaacacctttatgatactttgtgatttcctttagtgaactcttatgtcccaaaagtttgtggaactgtgattt

SEQ ID NO: 185 - DNA, 1088 bp, Solanum lycopersicum
catttatctctctactacaaatcttgaataagaagaaaaaaatcttgtctttgttctctatctagtccaaacccagatctacggttgaaatcttggattattaataatgtcgacagatgtgcattgtaatggaaatgcattcaagattttcataggttatgatcctcgtgaagatgttgcttatgaggtctgtcgatattcccttctgaaaagatcttcaatcccacttgaaatcatacccattaaacaatcagagttaagagaaaaagggttatactggcgtggaagagggaaattagaaagcactgagttttcatttactcgttttttgacaccccatttggctaattttgaaggatgggctatgtttgttgattgtgatttcttgtatttaggggatattaaggaattgagggatatggtggatgataaatatgctttaatgtgtgtacaacataattatgctcctaaagaaactactaaaatggatggggcagtacaaactgtgtatcctaggaagaattggtcatccatggttctttataattgtgcgcatccaaagaataaggtcttgacacctgagattgtcaatactgaaactggggcatttctccataggtttacttggttggaagatgaggagattggggaagttccgttcgtttggaacttcctcgtcggccataataaggttgttgaaggggatccaactacatttcctaagtccatccattatacgcttggtggaccttggtttgaggcttggaaggattgtgaattcggggatttgtggataaaggaactcgaggagtataagaaggcaacagagaagaaggtggattaaggcaatgtaggttattcgtattgtttgattcacacagtttttagttaaaaggtaattcattcgttatgtgctttttcagtcttccatattgtttcgatcgtgagatgtaatcgattcattacaaatcaaatactttgtattctagttttaatgattttggttcttcaatcatatcttttgtattgtaatcataatagattcatgaaggaaagaataagatcatcttgatctttgaatgatgtat

SEQ ID NO: 186 - DNA, 1157 bp, Solanum lycopersicum
gctgaaatttttcacttttcatatctgaaaaattctctgcagattcaaatttggaatagttgaagaagaagaagaggaagagaaaatgagaggaaacgatccgaatccgtttgatgaagaggagcctgaagtcaatcctttttcaaaaggtggctccgctcctgcttcgaagtcacgcttccctcaaatgattgctagtactcttggttttggccaaaaacatgatgcaactgatgacgtcccattggattcaatgaatggctccaacaagaagcaaaaagaattagcaacctgggaagcagatctgcaaaggagagaaagagatattaaacgaagagaagatgctgttgctggtgctggtgtgccaactgatgataggaattggccgcccttctttccaattattcatcatgatatagcaaatgaaataccagctcattctcagcggctgcagtatttggcttttgcaagctggttaggcattgttttttgtctggcgttcaatgttcttgccgtgactatctgttggattaagggtggcggtgttaaaatctttttcctggctgtaatatatgctttaatgggatgtcccctttcgtacattttgtggtacaggcctctgtataacgcaatgaggaccgacagtgcattgaagtttggatggtttttcatgttctacttgttccacattggattttgcatacttgctgctattgctcctcccattgtatttcaaggattatccttaacgggtatccttgcagcaattgatgtcttctctgaccatgtgctggttgggatattttatttgattggatttggtttcttctgcttggaagttttgcttagcttgtgggtgctgcagaaagtgtacatgtatttccgagggcacaagtgatgcacctgtttggacgtagcaacaaaacaattcttttccagagtaatgacttgcgtgatatagttgcatgttttctaggtttcaaaacatattcgtttcattgtcatttttgtatgtaatcacagtttgacctttgatcattagactactacattactatagtgccttcactgggattcgtttttgagtgatggtgtccactaatagtcatgtccaattgagacttgcagaaacataacaagagaataactacaaaaaa

SEQ ID NO: 187 - DNA, 4106 bp, Solanum lycopersicum
attgaaaaaaaaaaaagattttcagagcagttttataaagagagaaagcgaagtttgagtactgaagaagttgggttggtggagagatttgtgctggaaattgagttatttggattttgtggaaccgattggacggagcttttgttctttcttaactgtaattctatatacacacaaaagggaagcttaatttggacctgcatttgaaccaagctatgtatcctacgaatccttaccaaaggaaccaagtaccttacaatcctcattattatccccgtttcgaatcaaatcctcatcatcatatgaacattgatccaactagatctactttaccttatgaatcttggccttgtggtggtagcaactataggcatccttatccacctgagtgccacagttgctgtatccataacacttctccgagccagtgtgcgtttagccctccatatccttaccttccaccatctacctacaacaactgtagttatcctacatatcctgtgatgtatcctactcattatgttcctcatccccattttactatggagcagccccggtacgagtatgaaaagaatatgggcagagatcatcactgttgtggttgttcaaatcataaatgtggcagtaagaaaggagggagtagtgtcaaaatagaagaacatgaccaggacaagggaaacgattgtaacgactcattggttccttttgggttcaataattgtccttatccagttgtgtgcttaccacctgatgacatgaagaatagggagcgcatgaagcctgatggatccaattgtaaagagcaggaggagaatccacaacctttgaagccgcttggtgatttcaggccttcccagcaaccaaatttctggaagttatggccttctcattatgggaacagctcgggatcaccaaaggaaaacggagatttccctgaaaagcaacatcatgatgatgcaatcaggaagcagtttccatttccaataatatggatgccttatagacctgaggaagacagagaggaagttggtaaggagaccgagtctggcctcattgctgagaaggagccaacctccccctcaaaattaaccaaattaatgtcacatgattctgaagacaagagaagcagttctaaagaaaacgaagtgaatagtggaggtgatttccatggaaagggactgaataaagggtctgttgtgaaaaccattcctgtaaagcaagtggagcagaatgagatctttgatggaaaaaaagaggaggcttcccagaggcatgaaagtgatgctaaacagaagaaaatcactcaagaagctgggagaaaacagtcgacttctcctacaaagtcatcgaagttgcctcctgtttgtttaagggttgatccccttcctaggaagaaaagcagtagtggcaattctaggtctcctagtcctcctcgtgggaaagggaaattagtagaatcgcgcagtgacagctccaaacctcccatcaaatcaaatgagaaggagaatgttcaactagacaaatcatcaacaacaagcatgccaagaaaaagcacagaagtggagccaagtaaaagcaaggcaaaagttgttgaagttgcacaagggacagctaaagaagatatacttcatgatcaatgtactgttttccctgatctgaaacgccaggcaaggagcaaaattgctgagggtgatactggtaaagcagcaaataagccaaaagatgaacttgatgcagtagttgcgaaagctcagtccagcaatgaagcacatcagagaggtgaggccagacaagcagtaaatgaagaagtggatgcaggcaataagacgaaacgagaaaagaggagtaaaatgtccaatgatgaggcagctaccaagattcaatcagcataccgaggtttcaccttgcggagatgggagcctctgaagaaattgaagcagttagccaaaatagaggagcagatggctgagcacaaaaggcatattcagactttggagagctcagctgacaatggggtggacaacaaacaaagaactttcctcacagaagtcataatgggtcttctactaaagctcgacactattcaggggttgcatccaactgttagggaatatagaaaatccgtagcgaaggagcttgttagcctgcaggagaagctggatcttctaaactgtaaaaagcaaccagcagaaagtgaacagactgttactgccaaatctagcgaggacacaagcatggcggtggaagacaacccttccttgcagggtggccaggaggtgcagaagttggaaagggatgacgattttgtgaagggggatgaaggaataaagtttgatgcaaagggactttgtgaagagcagactctttgtgcaacagagctgctagccaactctcatgatgtgggcaatgcagtactagagggaaaagaattaaacaaggacgttgaagaggtgatggagggtgttttgggtagcagtgcagtgaagaccggagatggggcatcagtacaacattttgaatctgaagaaaaaacagataagttatttgatgagaacacaatagtagtggagaaattagaagagcatggagatggtgtggatgagttgggagaactccctcgaggagtccctgatgaagagaccagtattcaaggttctgctgaaatcagacaagacacagtagaccttactgcacttacccctgaagaaagagtctctgatacagagagtctagagcactaccaagcattgggtgaaacatcaattattttggggctggagaacacgcacagcagcaatggagtagaagaaaatgcagatattgtggaaagagatgcagcagtaccaattgacattctcgaacgagagaaagaagttacaaaaccattaagtgaagatgcaaacatgtccgaggtggatgacaaggttggtatggagaagaacggaaaaaagcttgatcaaggtggtagtgcatcagatggcttttcagtaccatcacaggaaaaggcaatcaccatagagcagcctacagatactaccaacacggaggaatcagaaacaattgaggttctgcaggagaaaatgcaaaatgcagttgacagagatattgaaatccttgattcaggaaaaccagtagaacaatcgctggaacctcaactatccattggtaccaatgatgaagctcgggagtacaagcagaaaatgggggagggacataaggaggtgcaaggtgaggaattgcaagcttgcgatgatgttgtcgtctctgatcatgacaatgaaggaaaagagcataatgtggtggttgagcagcggcatgtggagaacttcgagatgcaagcgaatgaaccagtaactgcctataatgcagcacctgtgatccaggaaccggtggatggaagtaaagctattgccactccaacgtcagaagctgcaactaccgagacagagatgtcaagggagaaagaactcggtctagcagatgaccacaacatacatccatcgatgtgtgttgccggggaagttaatcctgctgatgcttcccattcttttggttctacgcctattgaagtcccaggtaagaatgcaaatgagcttaaggaatggaagaaaatggacatgttaccggcatcgcctactgccagccaagtatcctgtgatagtgatgccctgtctgaaagcaacagaaaaattatagaggagaatgaaaaattaagggagatgatggagaagttaatcaaatcagggaacgaacagctgagtgccatatcgagtctttctggaagagttaaagagctggagaagagattgtccaagaagaagaagctaaaattgaaacgaaatagggtaccagcagctggatcagcctgtgtaaagccattgaatgactcacttagaaataggaatgtggggttggcaatgtaaaaacaaaaagcttggtcattccttttcatagaatagtaatttggttcatgtggtctgtttgcgttccattgtatgctatgtataaataaggcttcttctgctcagttgttgttccttgcaatagctactttgaaattactttgtttggcaccgaggctgacaataacaacgaacttcaaaatt

SEQ ID NO: 188 - DNA, 2289 bp, Solanum lycopersicum
tctttcacatatacacgcacaccactaatacattttcagacatatataatactcttttcaatccaaaatcacattattcaaacaacatggcactcaccacaacatttttctctctctttctcctaatcatcaccgtcgccggacaaacaactccgatggctgaagctccggcaccggcagccgacgactgtaacggtatattcttgcagtatgtgtttaattccggatctaaaatcaaacccactttgaaaactcgtcaaccctacaagtttcagtctattctcagtataactaacaacggacttgaggaacttaagttatggagggtttttgttgggtttcaacatgatgagattttggtttctgcttctaacgctctgcttgctgatggggaatcatttcctgctttagttggtaatggtactgtttttgctggatttccggctgccgatcttaagacagctgtggaaactgctggagatactacacagacgagtgttcaaatcaaaattgtgggtacccagtttggagttggctctcctaatgtacctatgccctccaatatctctttggaaaatgatgggtttatttgccctaaaccctctatgcaaggaaagagtgttatgcaagtatgctgtattaaagacgaaaatttcaagacaaatttgacgttgggtgagaaatttagtccacgccaagatggggatcttacaattatgtatgatatcctaagaacatatgattcaaattactgggctcaggttaccattgcaaaccataatccccttggtcgccttgataactggaaactaagttgggactggatgaaggatgagtttatttgggaaatgaaaggcgcatatccctctgttgttgatacttctgagtgtgtttttgggccacaggcaaaattttatcaaaaccttgacttttccactggtttgaactgtcagagaaggccgacactaattgatctgccgctggagaagaccaatgatacaaagttgggaatgatacctttttgttgtcggaatgggacaatcttgccacctgctatggacccaagcaagtctgtttcagcattccagatgaatgtctttaaaatgcctccagatcttaatcgatcctcattcactcctccacagaattggaagatcgaaggcagactgaatccagattacaagtgtggacctccagtccgtgtaagccccacccaagtccctgatcctagtggattgttacctgctacatcagtatttgctagctggcaagttgtatgcaacatcacccaaccaaaaggagctagccccagatgctgtgtttctttctctgctttctacaatgaatctatcattccttgtccaacatgcgcctgtggttgtccttccaatactgctcgtacatgtagcacgaaagccccagctcttctcctcccatctcaggctcttctggttccatttgacaatagaaccaagatgtcccttgcctgggctgaaattaatcatcttccagtttcaaacccattgccatgtggagataactgtggtgtaagcatcaactggcatttgttcacagactataggggtggatggtctgccaggatcaccatcttcaactgggaggatgctgcttttgctgattggttcactgcggtggaattggacaaagcagcggctggttttgacgcagtgtattcattcaatggaactatgttagatggggttaataataccatattcatgcagggccttccaggcttgaactatatagtagcagaagcagatggagctaatccagcgaaagatccccgagtacctgggaaacaacaatcagtaatctcattcacaaagaagaatatcccaaacatcaacgttgctgctggtgatgggtttccaacaaaattatacttcaatggagaagagtgctcattgccaaagctactcccaacaagcagttcatctagaatatcttcattcactgtcactacttccattcttgcagcagttgtggtttttatgttggtgcgacaatagcagtgagctgtggcgttttctcttcatttcatacctgccaattgattcattctttagcgtctgctaccaggttttaatgctggtgaccaatctttcaatcagtttgtcggattatgtattcagggacgagggtttttcggcgagttttgatttgtaactatttattactctggaattctcattccagacaatatttgactttaaagttaatacctgttatattagcagataagataagaatacctcagtttgttca

SEQ ID NO: 189 - DNA, 2016 bp, Solanum lycopersicum
aggagagagagagagtatcaaggggaaagaagggtctgaagaaatcaccgattttcaaggagaagaagaagaaatgggtacgcttcaaacttggaggaaagcgtatggagctcttaaagaccatacaactgttggccttgcccatgttaatagcgatttcaaggatgtggatgtggcgatcgttaaagctaccaatcatgttgagtgcccaccaaaagacagacatcttagaaaacttttggtttttacatcagcgatgcgacctcgtgctgatgttgcatactgcatacatgcacttgcaaggcgattggcgaagacacataattggacggtagcgctgaagacattgatagtaatccacagaacattgagggaaggtgatccgacatttagagaggaactattgaatttccaacagagaggacacgttctccaaatgtccaatttcaaggatgattcaagtccaattgcttgggactgctctgcctgggtacgaacatatgcactctttctggaggaacgacttgaatgctttagggttctgaagtatgatattgaaggagagcgccttcctaaacctgcgcaagggcaagaaaagggatacagcagaactagggagttgcccagtgaggaacttttggagcagttgcctgctttgcagcagttgttgtatcgtcttattggatgtcggcctgagggagcagcacttggaaattatgtgatacaatatgcccttgctctggtcctcaaggagagcttcaaaatctactgtgctataaatgatggaataattaatcttattgacaagttttttgacatgccaagacatgaagctattaaggcccttgatatctacaaacgagctggccaacaggccatgaacctctctgacttttatggggtatgcaaaggattggaacttgccaggaactttcagtttcctgttttgagagagcctcctcagtccttccttgtgactatggaagagtatataaaagaagcaccccggattgtctctgtgccaattgaaactctggattatccggagaggcttatgcttacgtataaacaagaggatgaaccttcagcttctgaagatgctcaagattcagctaacgaaacccctcctcctctgcctttagatgatgctgttgtttcaaccactgaggctccttccccgccaatgcctccacccccaagcagcttggaatctgatgatttactggggctaaatgcaccaagtggttatgcatcagcaattgaggacagcaatgctttggctttggcgatagttccatctgggacaacaccgttcgactcaaatcctgctcagccaaaagattttgatcctactggatgggagcttgccctggtcactactcccagcagcgacttatctgcagctcaggagagacaattggctggtggattggactccctcacactgaatagtttgtatgatgaaggagcatatagagcatctcaacgaccagtatatggagcaccagcccctaatccatttgaagttgctgatccatttgccatgtctaccaccatgcctccccctccgtcagtgcaaatggctgcggttcctcaacatcaaatgaatccttttggaccattcgaacctgcctatccacaacctcaaaatccaatgctgaatccccacaacccttttggtgatgcagggttcagtgcttttcctaccaatcatgttgctcatccacaaacaaccaatccttttgggagcaccggcctgatataatacaagttgtgcatccaccaggcatatcacagtgtattgcctgtcaatcattgttgcttttccacaaacaatcaatcctttcgtggagcactgggctgctatattcaaaagttgcacatacatgagtcgtagcagacttggcatagtcgatttttgttagtgaatctgcggttgtgtaaatcatttgatatagttttcgaaagcagtctatatgtaaagatggttataatggagattcaactttttttcag

SEQ ID NO: 190 - DNA, 1392 bp, Solanum lycopersicum
tctcatcaacaaacaaacagcaatcttctcaaaaaacaatcttttcttattcaactactctttactagcttctttttttctcattttaaatctcacaaaaaacactcatttctaatttaccaattataaaaaaaaatggcacctaatgtttttggtcttgcaactaaggcaactggtttagccaaggcaaaaagtttgtcaagccgtgcctatgttacatttttagctggaaatggtgattattggaaaggcgttgttggtttggttaaaggtttgcgaaaggcgaaatccgcttatccacttgttgtggcttgtttgcctgatgtcccggaggaacatcgacgtatactcattaaccaaggttgcatcgttcgagagatcgagcctgtttatcctcctcacaatcaaactcaatttgctatggcttattatgttatcaactattcaaagcttcgtatttgggagtttgtggagtatagcaagatgatatacttggacggtgatattcaggtgtttgataacatagaccacttgtttgacttgccagatggctatttttatgctgtgatggattgtttttgtgagaaaacatggagtcacaccccacaatataaagttggctactgtcaacagtgtcctgataaggtccagtggactgaagacttgggccctaagccatcactctattttaatgctggcatgtttgtgtatgagccaagtctctccacttatgatgatctcttgaaaacactcaaagttacccctcctaccccatttgctgaacaggattttttgaacatgtatttcagagatgtctacaagccaattccgaacgattataacttagttttagctatgttgtggcgtcaccctgagaatgtggatcttgagaaagtaaaagttgttcactactgtgcggcggggtcgaagccatggaggtacactggcaaggaagagaacatggacagagaagacattaagatgctgataaaaaaatggtgggatatttatgatgacgagtcattggattacaagaattccaacgttgttatgaatgccgtagatggagaagttgaagctcaaaaaattatggaagcgttatcagaggctggtgttgtgcactacataactgctccatcggccgcttagaatattataggaagctttcaaattgttttttatctttaaaaaaacaacaactttgggatacatagtcttaaagcaaattatactagctttacagagtgcttttgttatttatttttttacaaaaggattataaattgtctgtatataataggggagcaggcaatttaagttcttctataagttaaagagtgtttttgtttgtttgtttgtggatattggaagaacacagaaatgaaaaaaagt

SEQ ID NO: 191 - DNA, 882 bp, Solanum lycopersicum
atagttatttctcttcttcggataagctttaaaacacagaaaaattgaagaagctcctaaggaggagagctccaatctccattagagaccaaattcgaactttagtgaatacccaaatggcgatttcatcgtcttcactctcagcagctctttttccaatgtgtaattcatcttccatttctgcacaacccaagttttctcttctgtctttgcattcaaattctgttaagttacaagttttcaaccaatctcgagtgtctacaactaaggtttttgcttctcctgaagttttggatgcccagaatgttgaagctgatgttgaggatattctagctgcttcaacgctgagtattggtggtgactctgacaaggcagctccaaagcagaagattaggatcaaattgaggtcatactgggtacccctaatagaagactcttgtaagcaaattatggatgctgcaagaacgacaaatgcaaagaccgtaggtcctgtaccactgcccaccaaaaagagaatttactgtgtcctcaaatctccacatgttcacaaagatgccaggttccatttcgaaataagaactcatcaacgtcttattgacattctttacccgactgcccaaactatcgacaagttaatgttgcttgaccttcctgctggtgttgatgtggaggtcaagctctgagtaaaaaatttctcctccttgtttcacatcgtaaccttgtctatctcttgctagttcctttctggtttggattttgtactcatagcgacacaatcatttctcagggagaagtagggtaaacagatattttttttctgtgtaatgatttgattacttgattactgagcatcttttcaatctcatatcattgttaccttac

SEQ ID NO: 192 - DNA, 2040 bp, Solanum lycopersicum
ctgaaattcttggctctcctctttgtttcttccgcatgggctcatggccagtggcctagcaaggacatacacaaatgtgtggtctatcaatcttcgtattttgactatttctttttaccttttcttttaaaaataaattctgtccataaattaattgtagaagatgacacaaccaatgtgtttgttgtatatctgaaagccacaaaacacttttctagttttatcagtcaccacttttattctgtatttgcattttaatggagttctgaagattttttatttttattttttaaaagaagatttgaacttttattaacaaatttaagattcagccatgcaagctgtcaaagcttcttccttttcaccatttcacctcaacttgaactcaaccagttcatttcccaaaactaccaacttgtatattcaacaaaattatgaaaaccccatttcttgttttccctcaattcagacacaaaatgcaaaattcaaggtttttactgctacttccccaagtgtttcaacagaatcagaaaccccatttgatgaaaagactgaaaatgaaaatcaagaagagaaatttgagtggtatgctgagtggtacccaataatgccaatttgtgatcttgataagaggaggccacatggaaagaaagtgatggggattgatgtggttgtgtggtgggataggaatgagaaagaatggaaagtaatggatgattcttgtcctcatagatatgctccactttctgaaggaagaattgatcaatggggaagattgcagtgtgtgtatcatggttggtgctttaatggagctggtgattgtaagttgatccctcaagctcctagggatggccctcaggttcatacgtccaaaagagcttgcgcaactgtttatccaagttgtgtgcaaaatgacattctttggttttggccgaactctgatcctctatacaaggacatatatttgatgaaaaggcctccctatatacctgaacttgatgacagttcgttttcgaaaactttcatagtcagagatatatcatatgggtatgagcttctgattgaaaaccttatggacccagctcatgtccaatattcacattatggcattatgaataattgtttattcactgtgaaagctgatcgagaaggaggaagaccacttgacataactatcacgaagttggatgtaaatgtcattactgcaaaccagggacctggacggaacacatttgttccgccttgtgtgtattatagttattttgctttcggaggatctcagggaaaaacaactgctgtatcatctggaactgtacaggaaaaaccttcagctgagaagcagaaaaaagcacttttagttttcatctgtattccggttagtccaggtcatagcagaattatatttgcatctccaagaaactttgccacttgggcagatcgaataattccacgttggatatttcacctgggacaaaatctaattctggattctgatttgtatcttcttcatgtggaggagcgcaagctaaaggaaattggctcttacaattggcataaagcttgctatgtgccaacaaaggcagatgccattgttgttgcttttagaaggtggctaaacaaatatgcaggtggtcaagttgattggcgtggaaagtacaatggagacctcccgccaactcctccaagggagcagctgctggacaggtattggactcatacagtgagttgcacaagttgcaatctcgcatataaaagtctcaatgctcttgaagtcgtactgcagatcgtctccattggtgccattggaattgttgctgctttaaagcagggcacattgtctgcggtgacaaggtattccttggtcaccgttgcattactatgcttcgtggcctcgagatggttatctcatttcatatacaaaaatttccatttccacgattacgaccatgcctttcgttaacacttgagtactttcatatgactgaacattcactgtataaacatattccttgtagttgaaatttgcagaaaagtttgtta

SEQ ID NO: 193 - DNA, 1453 bp, Solanum lycopersicum
atttgttactacatgttagaatatactaataatagtattaaattattattatttttacactagtgtagtctagagtagtttattttttggtgtgtagcatgcaaatgaagagtattttagtattaaagttttgagagtggatctgaacttgtatctcaaaaattcatagttccaaggctttagtattctctgctttgctcttcagcatgtgaatgatctaccttgtaaatccatggtaattgttggaaaagtagaagtattcgtggtggtgaaggtattttccgtaagattttcaacagtagaagagtgagaaaatgagatctatagaggataaaggatgtttgaattatggacaaaaagaacaagaggttgtaggaggcagtagtatgaattttgagtttcatggaacaaatcgagcttcgactcatcatagaacagcagcattaggtaaaccaacaccatcaaaatgggatgatgcacaaaaatggttagttaatctatcaagaggagaaaaacatcaatcgaaagccacacctcgaaactcgaatgctgatgacttaaggttgattgcacctgttccaaagaaagaagagtattcgagtgacgatgaaggagattctagtatgattcaatttgaagttgaaacaaagaaagttgattgtgatgaatcaatatggagaataaataagaataataacaactttgcatccgttgttcgatcgatatgtgtgagggatatgggaacagaaatgacaccaattgcaagccaagaaccatcaagaacagcaacaccaataagagccacaactccagcagtaagaagcccaatatcatcaggatcttctactcctattaggggacaaaatgggacaatcgaaaacggtcaaattgttgccaacattggtcaaaacaggggaaatgcagggactacacgagtcgttcgtgatgtagaagaaactattgacaatgaattagcagctaagaaggaaacagaccatcccaacaaggttaatccactcgagactcgtgcaatggcgtgggatgaggctgaacgtgctaagtatatggcaaggtataagcgcgaagaggtgaaaatacaagcttgggaaaatcatgaaaagaggaaagctgaaatggaaatgaaaagaatggaggtgaaggcagagagaataaaagcaagggcagaggagaagtacaaaaacaaattggcagcatcaagaagaatagcagaagagaaaagaggtaatgcagaagcagagttgaatgaaaaagctgtgaagacatcagaaaaggcagattatataaggaggactggtcatcttccttcttctttctcctttaagttaccttcttctttctgttggtaataataataataataataatactatctatttgtgtatctataattcacatttactaactattactactagtaactttctttctttaa

SEQ ID NO: 194 - DNA, 607 bp, Solanum lycopersicum
aaaatattagcattttctctcttttcttccttttttgttttattattattatcttataggataagatggatacacaaattcctatattgagtcctaacaataatattgatgaatttgaagatttggaagtgacacaatttgatgaagatacgctaagaaaaatattattcgaagaagaactgcaaccgaataaagatagtattaatatcgttcaagataatataatacaaccaatgatggttgatacaacttcgaatttttcgaaaatcgaggaggaggaagaagaggagcttgtaatcgaagatttcgattggatagaaatgatggaattgtcagatacaattgtctcccacgagggagtaaatgagatttttgatgtgggagaattagattttgatttttctcatttttgttcttcttcaattcctatggaagaaataggatatgatgttttgtggcaaaataacttataatagtaattattattgtaataaaatcaatgaaacttaagtactatgtttgaatttttttttggtctcagttattttaattcaaactcgatctttgtatacgaataatttaaataaaatccaataagttactttta

SEQ ID NO: 195 - DNA, 1301 bp, Solanum lycopersicum
aaaatggttggagtataggaaggaaaattgtagataagggtgtgcgcatttctaacggataaagcaccgcgaaactaactgaactcaataaccagtcattcaaaagctctcaaaaacggccaacaatggccgcagcattcagcagcagctttactagttccgccattggagctcaattctacaggcccaaatttgtaaaacccaagacttttgtaaacacaattcgctgtgctggtagactagaatgggatccagatggtttattgggtccgcctcaaacgggtcatatagcccgactcgagttccagagacgccttgagaacgatgctgcggccagagaagaatttgaacggcaagttcgtgaagagaaagaacgtcgcagagttcttcgtgagtcacgagtgattccggatacagtggaagggcttgtggagttttttcttgacactgaagctcaagagattgaatttgagattgcaagaatgagaccacgattgaacaaagaattctttgaccatctgcaagtcgaacttggaaagctgcgtttttctgtaaacaaaactcaggctgtggaagacagattatttgaactggaagcactgcaaaaggccctgcaagaagcaacagaagcctatgataaattacaagcagatcttgtagcaacaaagaagaacctaactgagattttgacttcaaaggatgtcaaggctactcttttggatttggttgagaggaatgcgctgaatagacccttgttgacgcttcttgatgaaaacattgcaactgcacatagtgttaaccagaaacaagcagcagaatacatggaaaagctgagaggacttgttctgaagtacctaacagtatagattccatctcaaggctatcaaatgcttgtctcatgtttatacagagaaatgggcctggtgtgaatgtaaatgtgaaagctgctttaagattaagaatacttcatgttgcacaagttactagtaatgcacttgctttggttaatcgatttgcggatcgacaccggccaagtccttaatgtgactgaggcaaggagcgtgaatttgaattagtcgatgaggttacaagttttgatgtgtaaaggttacttttttttgggaattttcacaagcatgaaattggggctttgtgtctaagtggtaaaattatatatatttactgttggagcaaggtttgtgtgaaaaagttatcaattttatagctgcaatgaagacagtgcagcttagtttgttgttctctatatgtaaatgtaataataaataatcttcttgcttgta

SEQ ID NO: 196 - DNA, 841 bp, Solanum lycopersicum
tgttttcttgtgcttccctatcttcttcttctactactactttttggtctagtggaagcagagcaaaagcagaattatgactatggctactcctatttctccaatgaagcaattcccttcaactgctcttcaaccattcccatcaatctttcaaagaaaaccagtactaatctcttcacttagaaaaactcctcatcttttctcttattcatctcccaagtcattcgttccgctttctgcttgccttgctgttcttctatggtcctctcctgctaatgctggatttctttcgggttatactggtatagaatcagttcctggccctgaattacctaagattgagtttcttaatcgttggaacgataataatcagaaaaagtatgcagaactcgatgaaaaattcaaagagtcgcctttgcttaaacagttactcgaaaaatccaagcaaaataaagagaagaacaaaaggtcaattgaagacaagtattgtttacgcggagctgaatggggagttggagattgctcaacagcaggaatgacaccagaagacagagatagcttcattgccatgttgaagcagaaggctggtgtagaatgaacgcgcaattatgtactactctttatcgatgatgctggtttcaatttccgaatgcagagagtgaagattgaagcgtaatgctgaaaattcgcgataggagacggggagtttgattgagccttataacctgttagtattagcataagcacaagaacatgtcaaaagggacatttcttctattgttctatagcttgtaaatacattgcactagtaaattatgagcttgagagtggcatattgata

SEQ ID NO: 197 - DNA, 1364 bp, Solanum lycopersicum
aaagaagaagaaaaatgaaagcaaaaaaagaagaaaacaccattactatatcacacttctctcacataattatcctctttttcttttccttttccttttccttttttcttcttctttgatgagctctaccattttgacttgcttcattcttcacagatcaggatagtctgtcgtgccgtgttagctgttgtgatccttttgtaattgtagctttgaagtccaccatgtaatgaagattatacccagggctttttgatctatctacttattataaacttcaccagaatcagctttttttacgaagaatgtctgtgttaccaaaaattgattctatcaaaattagagaggtatggagcgataatcttgagaaggaatttgctttgatccgtcaaattgtggatgactatccttacattgccatggacaccgagtttccaggggtggtgcttcgtcctgttggcaatttcaagcatattaatgagtataattatcagaccttgaaggacaatgttgatatgttgaacttgattcagttaggtctcacattttccgatgaaaatggcaatctacctacttgtgagagtgagtactactacgtttggcaattcaactttcgtgagttcgatacaaaagcaaatatttttgcaaatgattcaatcgaattgctgattcagtctgggattgatttcaagaagaacaatgaaatgggtattgatgcaaaacagtttggtgaactcttaatgtcttctggaatcgttttgaatgacatggttcattgggtgacatttcacagtgggtatgattttgggtatttgctcaaattattaacttgtaggaccttaccggaaacacaatcagggttctttgatttgctaaacatgtactttccgctggtttatgacatcaaacacctgatgaagttctgtaacagccttcatggtggcttgaacaagttggcggaactactggaaattgaaagggtcggtatttgtcatcaagcaggttcagatagcttacttacctcgtgtgcgttcaagaagttaaaagataacttctttaatgggtctacagagaagtatgcaggtgtcctgtatggtcttggtgttgagtatggatctgataataaatagattgactttgtgtacttactagaaaataaaatagaaggaaaggtttcagtgtatgtcaagtggtgtaggtaatgtatcatgttgtctgtaagaaattaattgtgataaaagtatttgtaagacggtttggactttcactgagggtgctcagtttctaatccattgtttaatcagcaatgatctttttacagcaagacaaagtttgtgtttctacctttactcatttctaatcta

SEQ ID NO: 198 - DNA, 1899 bp, Solanum lycopersicum
aagaagcaacacaaaggtcttctacttcaacatgtcaacaaaaactacaagtgtctctaatgcatccaactcctttttcctcccaaaaatcactcacaataatggctttacaacaaccatttctatctgaattactactccactcatcttcaattagaacaacactccccaaaagttcacttttttctctacaaatacctcaaagattcaatctttatcttcaaaataagcaaatcaagaaacaaggaacaagttgttatgcaattgctgagaatcttgaagctgaggatcaaagtttgattttggaaaattcaagtttagatgagttgaggggacaaagggaaattgttggttatgattggactgaagaatggtatcctttgtatttaaccaagaatgtacctaatgatgcacctttaggtcttactgtctttgataaacaagttgttttgtataaagatggaagtggtgaacttagatgctttgaagatagatgtccacatagattggccaaactctccgaagggcaactgtatgatggcaaactggaatgcttgtatcacggttggcagtttgacggagatggtaaatgtgtcaagataccacagctacctgaaaatgctaaaattcctcgatcagcttgtacgaagacatatgaaattcgggattcccaaggagtagtctggatatggatgtctcatggaacaccacctaatattaacaaaatcccctggtttgaaaattttgagaggaaaggatttcgagacatttctactattcacgagctcccttatgatcactctattcttctcgaaaaccttatggatcctgctcatgtcccgatatcacacgataggacagattttacggcgaaaagggaagatgctggaccactgtttttcgaggtgacagaaaggactaaccgagggtttgcagggtggtggggtaaagaaagagatcaaggcaaagcaaactatactccgaacttcttacgttttgaatctccttgtgttcttcagaataatagagaaattgttgatgagagtggggagaagcattacttttcgggtctttttctttgtagaccatctggacaagggaaatcgatgcttattgttcggtttgggaatacaagaaaacgaaccgggatacttaaatttatcccaaactggttcttgcatcagaatgcaagcaaggttttcgagcaagatatggggttcctttcgtcccaaaacgaaatcctaatgaaagaaaaggttccaacaaagaaactatacttgaaccttaagtcgtcggatacatgggtagctgaatacaggaagtggatggacaaagtggggcacggaatgccttatcatttcggtcacagcaccattttcctgcctcaacaacctgctgtcgttgagcacgcccctgctggtttcgttgccaatttttcagctgctcagccagctaaaggaggaatcggtggaatatatgctccgaaccctgccaacagatacttcagacatgttgtacattgcagggattgcagcaacgttgttaaagctttcgagacttggaaaaaggccctctctgttatagctctcgtgtcaactgcattcgcgattctagtgtctggaagacaatggaaggccttgcttttgctttcgacgtcgctatgtttagctggtgcatatgcttgttcaacagccattgcaatgaacacaaccaacttcataaggactcacagaagattgtaaaaagtatgtatataatagctatattcatattgatgtttttcatgtaaaataggattcaggtttatgtgcttttcatacatattgctccctccgtcccaatttatgtgacactgtttgatttgacacttaataagtgaatctcatattatctctgcta

SEQ ID NO: 199 - DNA, 697 bp, Solanum lycopersicum
gtacaacaacaacttaattaattagccataccacacatatataagaagttgctatggcctcatcaaaagttttcttgattttcattttggctgcattaattgcaacccctgttgccgtagcccaattaggaggacttctgggtggccttcttgccccaacaagtatagaaggggttctgttttgtagccttaacggcaaaatagatgtcctcaatggagctaccaccccaattttccccgatgcatcggtgcagctgcggtgtggagcaggaaatgtagtatcaagtacaacaacaaatggatcaggagcgttttcgttggtgacgagtcctgtacaaagtttattatcatcattgttgtctgactgcaacatagtggttacaactccgctctcaacatgtaacgctaccttaccatccgttggggttctgcaggcacctttgcagattgttggcaaaaccgctggtggaggacttcttaatattgtcaaacttgttactggtgcttttcaacttattaactaaataaataaatgctactcctttatattatgtgttacgttattaattaatgtttcctagtgatgcatcagctagttagtgttgctgctgatggcataaataaggattcttctttctgtccactgtaattgtttcaatgttttgtcattatacaagttaagtgtaatattactcta

SEQ ID NO: 200 - DNA, 711 bp, Solanum lycopersicum
tcgaacccaagaatttccctatttttatttctcaccgccaaacccctctctctctcatctgtgtgtgtagaaagccgcagaaatggcatctttcgcggaagcaccaccaggtaaccctaaagccggagaaaagatcttcaagacaaagtgtgctcaatgtcacaccgtcgataaaggagctggtcacaaacaaggacccaacttgaatgggctctttggaagacaatctggtacaactgcaggttactcgtactccaatgcaaacaaaaatatggctgtgaactggggagagaacacattatatgactacttgctcaacccgaagaagtatattcctgggacaaaaatggttttccctgggttgaagaagccacaggagcgggcggatctcattgcttatctcaaggaagcaactgcgtgaagatttctttggaatattaaaatacttttgctagtggtcaggagtcgtccatttctcattttatatttggaaggcatattttgcccgttttaaataaaaaccacatacagtgtcatgccattcttctggttgaactaagccagtcttgaaggaattttgtccaagaggttttatcatttattgttcacataaaatcttgacgtactaagtatatgctgatttatttatttctattttttggcgtctctgtcaccaaatgctaatttataggtattggtagcgtttcatga

SEQ ID NO: 201 - DNA, 1736 bp, Solanum lycopersicum
aagatatagataataataattggctatggcttttcaaggttcattttgggcaattagccttttgatatttttggccaattttttgtctatgattgagttttctaaggctgcaaatgcaaaagtgccaagccatactatatctaatccatttaatcgtaccatattttcacctgattttctttttggagcttccacttcttcctatcagtatgaaggtgcatggaatgaagatggcaaaggaccaagtattgtggatactttcgttcacactcatcctgaaaaaatattggaccgtagcaatggagatatagctctggacttttatcatcgttacaaggaggacgtgaaactagcaaaatttgaaggactggatgctttcaggatatctattgcatggacgagaattttaccaaagggttcggttaaaaagggaataaatcaagctggtattgactactacaacagtctcataaatgagattgtagcccttggtattaaacctctcgtgacactttttcattgggatcttcctcaagcccttgaagatgaatatcttggctttctaagccctaaggtcgtagatgattacgtagattttgtggagatttgtttcaaaaattttggagatagagtgaagttgtgggcaacaatgaatgagccatggatttttacatcaacgggttatgattctggttctttagcacctgggcggtgttcagcctggatgaacaataattgcacaatcggtaactctggcactgagccttatatagctggacacaacatacttcttgctcatgctgctgcttccaaactatacaggcaaaaatataagccaattcaaaagggtcaaataggaacaattgtagtgtcacattggtttgagcctgcctccaacaaaccagaagatataaaagcatctataagagcccttgattttatgcttggatggtttatgcacccattgacttatggagattatccaacaagtatgagaaaacttgttggcaagagattaccaaagtttaccccaaaagaatcaatgttggtgaaagactcatgtgattttataggattgaattattacacctctaattttgcagctcatatttctaaaccaccaaatactgtcaatattagttcaggaactgataatctagtcaatcaaacaacatcgctgaacggaaagttaattggtgatccaactggtgtgagcatattttatgttgctccaaagggactttataagcttcttgtttatattaagaaattttacaagaatccaattgtttacattacagaatgtggaatgggtgaatccaatattgatgatgttgcaaagggtattaatgatgctcagagggttgatttctaccaacgccatattaaggctctttatagggcttttagggagggagtacatgtaaaggggttctttgcatggtcattttatgacaattttgaatggggatcaggatacacacagagatttggtatcaattttgtagattacaaaaataacctcaagagatatcctaagcgttctgctctttggatgaagaaattccttctcaaataaaattatttgtaacatgtgtagaatctaatcaagtgtgcttattctccttaaattcagtattaatctgtttgttaagtagcaactactaattatggaataaattaagggggtgttctctttgtaataaaaagagaagaaataaagttgttgtaacaat

SEQ ID NO: 202 - DNA, 686 bp, Solanum lycopersicum
tcaccactttctttcacaacatattgctattcttaaaaaaataaaaaatatgggtttaaaaggtaagttgattgcttcagtggagatgaagtgtggagaaggctcatttttcgatatttttcacattaatactaatcaggtacccaatataagtcctaaaaatatcgtccattttggaattcacgaaggtgaaagcgttaagactggttcgattgttagttggaaatacaacgaagctggacaagaaatgtatatgaagcacttaattgaagctgccgatcctcagcagaaattaatcaaatggaaagttatcgaaggagatttattgaagttgtataaatactgtaattttacaacatcttgtgatggccagtggactacttggacaattgactacgaaaagaaaactgaagataccccagaacccctccttcacttgggtgttatccttgccatgaccaaggatatagaaagtcaccttctcaagaaataatgtgtgtatgtgtgatgaataatttggctagttctagctagcatgtggaataataaataatataatgtatgtgtgactatgtagatacacattataagtatgtgtgtgttggtgtgatgaatatttggctagttctagccagcatgtggaataagtaatgtttttgatgaatatgttatgtatatgtcactag

SEQ ID NO: 203 - DNA, 952 bp, Solanum lycopersicum
aaagtgaaaagaaaaagaagggtccattccatttccatcatactaccaaaaaagcaaaagctaaagaaaaaaaaaagcaaaaaaaaagaagacaaagtttaaagagagagaattcaaacaagaagaagggttttctatctttgtggaaaaaaaaataagaaaaaaaaatgcagaatcaacaacagctacagacactgatgcaagcaggtcagatttcagggagtttgagttttaatggtaatttaagtaaagaagatgaagaaatgtcaaaatctgcactttcaacttttaaagctaaggaagaagagattgaaaaaaagaaactcgaggttaaggagaaagttcaagctcagttgggtcgtattgaagaggaaactagacgtttagctattattcgtgaggaactagaagcattagcagatccaatgaagaaagaagtttcaacggttcgaaaaaggattgatattgtcaacaaggagttaaaacccctgggccagacttgccagaagaaggagagagaatacaaagaagctctcgaggccttcaacgaaaaacacaaggaaaaagtacaacttatatcaagattgatggagctggtgggtgaaagcgagaaaatgaggatgaagaagttggaggagctgagcaagagtgtagaaacgatccattgaaagataaatcaccttaaaaaagctcatcagtgacgactaattaggcttgtgtgatatatttaagatctataatcgaaatttctgtttattatatggttgttttcgcgtttggtgggtgtattctttcttccttttttcgcgctttatgttgttctttgttcatttttaggcttttgaaggatgatgatctaattttaggtgtcaaaagggaagaaatacccttgtaaacatgtttgtaactaaaacaggtcttctctcaagctatggattcttttgttcaatta

SEQ ID NO: 204 - DNA, 1363 bp, Solanum lycopersicum
atccaaaaacgttacaaaaaattctatcttgttgaaaaatctcatcttgatctgtctactcggagatcagcaattttacttctgttttgtaagcttatctctgttgctgtgggaagaaaactaagtgttttctgagttagtagtctgtgaggatgatgaatagtgaacgattagcaaatgttgctttagcaggtttgagtttggccccactggttgtgaatgtggacccaaatttgaatgtcgtgctaacggcttgtctcactgtttttgtgggttgctaccgttctgttaagcctactccacctacggagacaatgtctaaggaacatgcaatgagattccccttggttggaagtgcaatgctcttgtcattgttcttgctttttaagttcctctcaaaagacctggttaatgctgtattgacgtgctacttttttgtacttggcattgctgcttttgctgcaacactgttacctgctatcaaacgattcttgccggaaaagtggaatgaagatctcgtaatatggcacttcccatatttccgctctttggagtttgagttcacaaggtcccagattgttgctgcaattcctggaaccatgttctgtgtatggtatgctaaacagaagcattggctagctaacaatgtattgggccttgcattttctattcaggggattgaaatgctttcccttggatcatttaagactggtgccatactattggctggactttttgtgtatgacatcttttgggtcttttttaccccagtgatggttagtgttgctaagtcttttgatgctcctatcaagcttttgttccccacagcggatttgaaacgtcccttttcaatgttgggtctcggagatattgtaattcctggcatttttgtggctttggcactccgctttgatgtctccagaggaaaggggcctcaatactttataagtgcattttcgggatacgctgttggtgtgatttcaaccattattgtgatgaactggtttcaagctgcacagcccgcgttgttgtatattgttccagctgtaattggatttgtggctgtgcactgcatttggaatggggatatgaagccgttgttggagttcgatgagtcgaaaacacagagcactgaagaagtcgccgcggaagagagcaagaaagtagagtgaggctttaagaagagttacagtagggatatatgaccttccaactgatgcagagattgttggttaggaaaagaacttttttttgttttgtacttttagattattgtttagtgaaatattgatgagattggcttcaatgttatttacccaaaaaatttaacatttcaattgtcaatcttaatattattgcccct

SEQ ID NO: 205 - DNA, 1049 bp, Solanum lycopersicum
aacaacccacatcaagattcatcaatttaacttcaatttcacaaaagaaaatttaaaatttgattaaaaatggtgaaacccaattcgaaagatactgaattttcacagtcgtcatcgtcgtcgttgtatcggggagtacggaagaggaaatgggggaaatgggtatcggaaattagattacctaatagtagagaaaggatttggttgggttcttatgatacgccggaaaaagctgctaaagcatttgacgccgcacttttttgtttgcggggtaaaggggctaatttcaatttcccggaaaatccgccggagattaggaacggaaggacgatgactccgtcggagattcaatcggcggcggcgcagtttgcgaataatacagaacccgaacttatccgggtcgggccaagggagaattcggatctttcttcttcctcatcggaaatatttcgagcggaatcaccgtcggtgtcagtttccgatagagtagaaagtgaaaagacggaaataaccttgggtaacgattttatcgatgtgtatcgggtggagtctagagtggaaagtgaaaagacggaaatgtccttggataacggatttgttgacatgttttcgtcgttaggaacggttaatgatatgtctgattttggaatttttccggggttcgatgacttatcgggtgaattttttataccaccaccatcgtcaccacaaccatcaccactgcaaatgcctaatttggaatcattagaagaagagaattatttgaactatgatggatttcaatcacaggggacttcatttctttggaatttttgaaggatataaaaatgttacattatattcattaatggttaataatataagtttataaaattagaaatagtactaaaaattagtattaagtaggattaagagaacttatttgaattttaaaacttcatttgatgattttgtagacaattctagacattttttttggttgctagaattgttacaacatatgtgatttgtacacataataaagagaatgtattttttgactaatcgat

SEQ ID NO: 206 - DNA, 723 bp, Solanum lycopersicum
ggcccattgtgcaccaaatgagtcggtattcatcgggggcgggtcctaacctatgaatgtcaaacaggttcaaagaggagatcgtcactgtagaggttcaatttttatggtagcagagaaaaaatggctgctcaagaggaagttaaacaactggcagagtgctcagtctccaatgctctggggacatgggttttctctgtagctggtgccctgcttgcgattccagtgggtattaaacggaaatctttggcaccccttgtattctttggcacaactggtacgatgctagacataattatgggtatcagtgcttgtgaaagggagcatgcagaacggcaaatgaagcttttggaagaagcacaaggatctgtagctgttgataccttgactgatgcagcaactgaacattgatggcattcaggtcgctctggattttgtcttcaactaatagctgaggttcatgacttcatgtagcattttgagtactgttggccttcagtttctgctttacttggcttgtaacttggatattatcatgagcagaaaagaaggcaaataatgtgtggggtgattgcacttgtgatgtggcttcagaagtcagaactatcttttttctgcttctaaaaagctttctattagtaaaccatgtagataagtccaaaataactccaataacttcgccttaatcccaaataaatagagtcaccggctatataaatcctc

SEQ ID NO: 207 - DNA, 723 bp, Solanum lycopersicum
ccctcctcattctccatctctatatatacttccccattctctcctccatttctcctcgcttatgtaaccctaagttcgccggagaaagagagtcgaagctacagaatttcagttcgccgctgcggaagctccatagccaaactccttccgccgcagcgttcttattcagaaattctcttgctccgactccgatctcgatatcataataagcaatggctcgttctttctctaactctaagactctctctgctttcgtctccgactccgtttctgcttttctcagcaggcgtggatatgcagcggcatcacaaggtgcagtttccggtgtagcaaaaggagtgccaaggagcaacgtgatgatgcaaaaaagtggagaggaatcggtgaagacttcatgggtgccagatccagttaccggttactataggccggaaggacaagcaaatgagattgacgctgctgagctccggaagatgctgttgaaacacagatctggaagcaactgaaaatctttgaagctgcgccgttgatctgcggttaatcatcggagattttcgatcaacgagaaaagagaatttagtgaaggaactgttttatcagaaaaatatagcagtgtgaaatttactcgtgctttgttgcttttaaattttaagcttattgttatatctttcttttattagtatcttttattcatgcaaatgaaataattatagtattagtatt

SEQ ID NO: 208 - DNA, 696 bp, Triticum aestivum
aaaatctccgtcgatccaccacaccctgcaatggcgtccgcgctcaccaacgtgagcctgtctaccttcgcgcccacggccaggggcgacgtcctcgccaggcctcaggtggccgccgcccgcgtcaccttcccgacggcgtaccgtggcagcggtgccctctcctgcagggcgggtgggccggccacgccgccgggcatctccgacaagatgtcggacagcatcaaggaggcccaggagacgtgctcggaggacgccgccagcggggagtgcgcggcggcgtgggacgaggtggaggagctcagcgccgccgccagccacgcccgggacaagctcaaggactccgacccgctcgagaactactgcaaggagaaccccgagaccgacgagtgccgcacctacgacagctgagcgtacgtgctaatttgttctggacggcggatagtgaaggtggacgtggtgttcttggctcatgggagcccgagaaaacctactatgtctcaacctaccgttacttacacgatcgggatgtatgtagtaaaaacgcgccaaatattttcccagggacatacgtggttgatatacaattgatattacagacgtttatttaaagttgtattatggatgtgtgcatgggtatggtgtagaggcgagtgtctggtcgtccttttccattaaaaaaaatggaagctctat

SEQ ID NO: 209 - DNA, 2186 bp, Triticum aestivum
gccttctccgtccaccgcccgccggaagaagaaagaaagcatatttgcttctcgccgccgccgccggtgagggaggaaggaaggaaggaaggaagcaggggatcccactgggtgttgccggtttggagccagtgatgagctgcctcacgttccgccgctccgccgccgacgccagccgcctccaggacggcctcctcgtcttcatgttcttcatctcgattcccatacgtagtctgaataccaatcgtactagtagtaattccagtattattactagtagcatcagcaatcttctcttgtaaacaaacgtacgccgctcgtgctcgcggttgcgttcgcgcggacggaggggtcctcttcttctgctgctgctccgtctgaatcttcttcttcttctcgccggttgacggtcgcgacggcggccatggatcccaacagcttcaaaaccggaggccttctgcttccaaccatcgagaggcgctgcgcttcgcctccatctgtgatcgtgatcggcggcggaatctcagggatcgccgcggctcgtgtcctctccaattcctctttcgaggtgactgtccttgagtcgagagatcgaatcggtggccgtgttcatacggattactcctttggatgccccattgacatgggagcctcatggttgcacggtgtcagcaatgagaattctttagcaccactgataggccatcttgggctgagattataccacactagtggcgacaactctgttctgtatgatcacgatttggaaagctgttcgctctttgataagaacggcgttgcagtcccaatggagacggctgctaaagttggcgtgatatttgagaaaattctcaaggagacggtgaaactccgcgacgagcaggaacatgacatgccccttgaacaggcaatttcaatggttcttgagaggcaccctgatctcaagctagaagggctagatgatcggatcctgcaatggtgcgtctgccggctggaggcatggtttgctgcagatgcagatgaaatatctctgaagaactgggatcaggaacatgttctcactggtggccatggcctgatggttgatggatactttccagtaattcaggctctcgctcaaggtcttgacatccgtctgaatcagagagtgaagaaaattacacgccagcacaagggagtgacggtcaccatcgaggacggcacgcaatactcggccgacgcctgcataatcactgtgccgctcggtgtgctgaaggcgaacataatcaagttcgagccagagctgccatcctggaagagctcggccatcgccgaccttggcgtcggcatagaaaacaaggtcgccatgcacttcgacaaggccttctggccgaatgtgcaggtgctgggcatggtcggcccgacgcccaagacgtgcggctacttcctgaacctccacaaggccaccggccacccggtgctggtcttcatggccgccggtcggttcgcccaggatgtggagaagctctcagacaaggaggcggtggaactcgtcatgtgtcacctgaggaagatgatacccgacgccactgaacccactcagtacctggtgtcgcggtggggctcggacccgaactctttggggtcctactcgtgcgacctggtgggcaagccgtcggacgtgtgcgagaggttctcggcgccggtggagagcgtgctgtacttcgccggagaggcggccagcgcggagcactcgggggctgtgcacggcgcgtactcgtcaggcatggacgccgcagaggaatgccggaggaggctgctgatgagcaagggcgtgcctgacctcatccaggtcggcgccgcggcgtgcgaggagatggcggacgtcgtcgcccctctccagatttgccgcacctagggatgacgatgattcttcgttacagccgcgttctgccatgccggattgatttgatgattgacagaagccgatcagtgtgcagtcgatcagtccgagtcggcagaacgcaagatttgaaattcagttttcttctttacatttctaattttctcggaatgcttgggatcaagaaacatttgatcgatgcctgtgctgctgtgcactctgggcactggatttatagcgttaacaatttgttatgtccaatcagtcaataaattttagacaagtgacatttgggtactgatga

SEQ ID NO: 210 - DNA, 1651 bp, Triticum aestivum
gaccacacctcacctcatcgcagtttcatcacaaatccaaaacaaaacgtctccgccgacgacccgcatccgatagcccccttctccgcgccttctccggcgagaagcacccacaacggtctcaccggcggccatgccggctacggactaccagggctcctcctcctcctcccactccccgttcgcctccttcggccgctcgctgctgtctcgaagccgggacaccccggcgtcccccgccatgcttccgtccggcggggaggccgaggtcgaggcgttccagcggcacgtggccgttagcctcgcggagctgagggacggggaggatttcctctccgtcgcgtggatccggcggctcctcgaggcgttcctgctgtgccaggaggagtttcgggcggtggcggccgaagcgcggcgccgcggcggtggaggcgcgctggcggagaggctggtgggggagtaccacgagcgcgcggtgaaggcgctcgacgtgtgcaacgccgcccgcgacggggttgaccaggtccggcgctgggggcggctcgccggcatcgcggcgtccgtgctgctcgcccccgaggagatccacgagggccagctccgccgcgcgaggaaggcgctgtccgacctctcgatcctcctcgtcgacgacgcggccgccgccgggggcgggggcggcgtcgcctccttcctggcctcacaccgcaaccgctccttcggccgcgggagccgcgcgtccccgtctcgcgcgtcctccgcctcctcctcgtcgtcctcctcctcgcacttccgctcgctctcgtggagcgtgtcccgcacgtggtcggcgtcgcggcagctgcaggccatcggggccggcctggccgcgccgcgcgcgcacgaggcgggcctcgccgcgcccgtgtacgcaatgggatgcctgctgcacctcgcctcgtgggcgctcgtcgcggccgtcccgtgcccggaccgcgccgcggcgctccaagcgcaccacctccccgcggcaccgccgcgcggggcattcgcgtgggcgccgccgctcctgacgctccaggaccggctcaccgaggagggaaagcgcaaggacaggcgcaattcctgcggcctcctcaaggaaatccacgcgctcgagaagtgcgcgcagaggctcgccgaggcgatcgacgcagcgcccatcccgctcaccggagagagggaggccgcggtgcgggaggccgccgcggagcttgccgccgtatgcagcgccatgaaggacggcctggagccgctggaaaggcaggtccgggaggtgttccaccgcattgtgcgcagccgcatggagggcctcgactcgccgatgcccaacgccgccgactgaaccatcatcaagaatccgcattttggccgcgcgctgcggcggcggcgataggtagctctctcctgtccgtggtttttgatcacccgtgatctgtctcgcagtcagtagtataagtttaaaatgtgtatcgttctgtaaaggaaaggggaaagggaaggaaccatctttctgcaaagatttattccttcttctcatgttttgatgctgcatttggtgtgtatcatcagatttttgttagtcgtctacgacatgtgcgcgcggctaattcttgagttacttgcgtctgtgagc

SEQ ID NO: 211 - DNA, 1919 bp, Triticum aestivum
gacgcacgcacgcagacgcagacgcagacgacaggactctcgccatcaggggagagatagagagggaggcgacgagcgatggcggctgggacgggcagggtgctgccgctgctggccgtggcggcggcgctcgccgccgcgctcctctacacggcgcccttctccaagagcctgggcggggaggggtgcagcctgctcccgcacggccacttctggatcgccagccagcgggtcgtcgcgctcggccgcgtcggccccgccgcagtggaggtgaaggaaggtctgatcaacgccatcgccgtcggggactaccggagcttcgtgctccgccgcccgctcgtcgactacggggacgccgtcatcatgcccgggctcatcgacgtgcacgcgcatctcgacgagcctggacgggaggagtgggaggggttctccaccggcacaagagccgcggccgcaggtggcataactacgttggtggacatgcctctcaacagcttcccttcaacagtctctgaagaaactctcaaactcaaggtggatgcagctcgagataagctatatgttgatgtcgggttttggggaggccttgtacccgagaacgccttgaacccaagcaaattggagagtctactgaatgcaggagtgctaggacttaagtcttttatgtgcccctctggtatcaacgacttccccatgacaaattcaactcacatcgaggagggcctcgttacattggcaaagtacaaaagacccttacttatccacgcagagcgcataccggatgtcacaagtgacgaggagctcgatggcgaactagatcctcgatcttacgcaacatatctgaattctagaactccagcatgggaggaatcagcggttagagatttgaaccgtgccatgaaggacaccgaggttggaggccggtcagaaggagctcatcttcacatcgtccatctctcagattcaaaaactaccctcgaccttctgaaggatgcaaaacacagcggcgcaaaagtcactatagaaacctgtcctcattacctcgcattttcggctgaggaagttccagatggggacactcgtttcaagtgctctcctcccatacgtgacgccgccaacaaggaaaacctctgggaggccctgcttgatggtcacatcgacatgctcagctcagaccactcgccgtcgactcctgatctcaagctaatggaggaaggcaacttcatgaaggcatggggaggtatctcatctctgcagtttgtcctccctgtaacatggtcacatgggaaaaagtatggcatcaccctgaaccagctagcctcatggtggagcgagaagcccgccgagctcgcggggcagaagaacaaggggtctattctgccggggtaccatgccgacatcgtggtgtggaaacctgaggcgcagttccatctcgacgacacccatgccgtatatcacaaacaccggaacatctcagcttacctagggaaggagctatccggcaaggtcctgtcgacgttcgtgagggggaacctagtgttcgccgaagggaagcacgccggggccgcctgtggcgccaccatcctcgccaagtaaaactgtagagctacaatatcgtcgctgatttctagcgtatatgatcgtgtgcgctgtgtagtatgtagtatgtatgtatccagattcgtagccgtttctctgtgtataattggcccatcgcatgcatccattccccaccattgttgtatatccatccattcattggacaacacagtgtaggttatttctctgaaatattcagatgtactagttttgaacttctgagttgtgataatatctacagtatgagaggaatgtgaattattctgctactcttataactttccgacgaattttcagctgcaaaaaaaaaaaaaaaacga

SEQ ID NO: 212 - DNA, 1130 bp, Triticum aestivum
tccagtttggtgtaactagcagtaggcgcccagcctgccggtccacttctctatgcacaaatattcccagcctctgcggctccaatttgcaaaagctactcaagaattgacccaacccacccggccttctcctaccaaccaagcagctccaaacaccaagaaatccacagaaaccgagatctctctctcttctctctctctccgacccgacggatccctggttgttgttgtagctgggcaatggcgaccgacgcgatcctggagaccatcaagcctcggcggagcccgtggctggaggacctcccggtgacgaatgggggcgcagcgaagggcggcaaggtggacctgtccgggatgcgccggcgcgtgtcgtcgtccttgtcactgagcctccagccgctgtcctcgtcgtcgtccgcggcgttccggcgcgcgcggtcgatgccgtcgatcaaggcgctggcggcggcgggcgcggtgcggcagtggtgggagtgggggctcggttgggtgatgacccggaagccctccttcgcgcgtggcctcgagatgagcgaggacgaggccgccctgctcgggtgccactgccgcggcacgctccggcacgtcttctacaaggcacgcgccgaggtgcgccgcctcctcggccgcgacggccgcccgctcgggggcgtcgcggcgcaggacttcaggtacgactccgtcagctacgctcagaacttcgacaacggcgacgtcgacgccagatgctagctgctgcgccggcgcacgcatggattcggacgccgccattcgtgccgaaagtgaaggtatacatggctcgatcgatggctacgaactatatcttcttggacgcggcaataaaccgaattgtttgtaagatactagcagcatatagcacggcgtgtgtgtgtgtgtgtgttttgtctgaacgatcgcagatgatccagcagcgagtgatgcgcactgttcagggaccagatgtatatttcttccgctcttctttcttgtgtttttccgagtcttttcttggatacatccgtccctacaatgtaatgtagcccgtggatcttgaactggcaaaatgtacatgttctgtaacacattgcaaatgcaaatcaataagcatt

SEQ ID NO: 213 - DNA, 2201 bp, Triticum aestivum
cgcctctccctctctctcgtctcgtctctcgtcccaatttcaccgcctggcactctcccccgctccgtctcttccccgcacgcatcaccctctctcccgtcgcccctggcccgagagaacccacacgcaaacccaacgaacacgcggcgccgcgctgagaaacccccgaggaacgacgaccccaggagcaggcccccattgcggcatggctgcggccgccgacgtcgggcagctcgctggcgccgccgcggccacgctcctcgcggcggtgctcttcgccgccgcgctggggcgccagcgccagcgccgccgccgcggggctccggtcgaagggatccccgcgccggaggacggctgcgcggtcgccgacggcgcagggagcgcggccgtggacggcccgacggacgtcatcatcgtcggagccggggtcgccggatctgccctcgcctacacgctcggaaaggatggtcgacgggtgcatgttatagagagagacctgacagagcctgatagaattgtgggtgaattgttacaacctggaggctacctgaaattgatggaattgggtctgcaggactgcgttgatgaaattgatgcacagcgtgtccttggttacgcgttgttcaaagatgggaagaacacaaaactttcttaccccttggagaagttccattcagatgtggctggcaggagctttcacaatggacggtttattcagaggatgcgtgaaaaagctgcgtcgttacccaatgtccaactggagcaaggaacagttacatctttgcttgaagaaaatggtacagttaagggtgtgcaatacaagatcaagtcaggtgaagaactaaaagcttatgcaccattgacaattgtatgtgatggctgcttttcgaacttaagacgtgccctttgctctccaaaggttgaggtgccgtcttgctttgttggcctggtcctggagaattgtgaacttcctcatgcgaaccatggccatgttatcttggccaatccttctcccatcctattttacccgataagcagcaccgaggttcgctgtttggtagatgtccctggtcagaaggtgccttccatagcaagtggtgaaatggcaaattatctcaagaccgtggttgcacctcagattcctccacaaatctatgattcttttatagcagcaattgataagggaagcataagaacaatgccaaataggagcatgccagctgcaccacatccaacacctggtgcacttttgatgggagatgctttcaatatgcgacaccctttaacaggtggaggaatgactgttgcattatcagatatagtcgtcctgcgtaatcttatcaagcctcttcgcaatctgcatgatgcctctgccctctgcaaatacctagagtcattctatactctgcggaagccggttgcttctacaataaacacattggctggtgctctatacaaagtcttcagttcctcgcctgacaaggctagggatgagatgcgccaagcttgctttgattacttgagccttggaggtgtctgttcaaatgggcccattgctctactctctggtcttaatcctcggccattgagtttggttgcacacttctttgctgttgctatctttggtgttggacgactgatgctcccccttccttcacctaaacgaatgtggactggagcgagattgatttcgggtgcatgtggtatcatcttcccaatcatcaaagctgaaggtgtgaggcaaatgttcttccctgctaccgtccccgcgtattaccgtgcacctcctgaagcagagttctgatctacgaaggtgcagctaatctctcgcacgatgacatttttccctgtgttggtagtcgctcgccagtgttagccggttgttgaaaatgtgctgtgttggtagtccgaatggatcgaggaacgtgtatagtatctccgttgggtgctgatcctgtttttgaaatgttttgaattgctgcatcggtgcccatgttgattcgtcctagctaaattgtacatctttgttgtgctactaatgaactgcgcctgctgttctaactagtggactaaggcggtgttccttgtctactgatcgtgagctgtgctgtgtgcgtttcaaatcagaccactgtataccatgttaggctgaacgctgttatggaccatgatatgccttcagttatatgggccagcccatc

SEQ ID NO: 214 - DNA, 1501 bp, Zea mays
atttggcccaaggttcaccgctttgcctcgttcccgttctcctcctcgcaactctctcgtccatacgtcgtagccgccgcctgtctctcaccgccgacatcccgacagctctcagcccagatcgagcttcccccttcccaaatcgggttctgcttgggctcccgccaccgccgccctacaccaggtgccaaggccttcgccgacctcttcgccggcgaagagcgcccagcagagatgaatgtagcggtgccaccacaatctccacatcttcgtctatatgactttgccaagagtgccatcatcaaaatttttgcctttccttatgctacggtctgtgacctgtattgcgacggtggaatggatacagacaagtggtgtgatgcccaggttggccactacataggcatcgatgcctctgcatcgggtgtcaactatgcccgtgagctatgggagaacaggaggaaacctttcactgctgaattcatcgagttggatccttctgatgatggttttgaagctcaagtgcaggaaaagggcatccaagcagatatggtttgctgtatgcagcacttgcagttatgctttgagaatgaagaacaggcaaagaagcttctgaacaatgtatcatcacttctcaaacctggaggctacttctttggcataactccagattcatctacaatatggacaaaatatcaaaagaatgttgaggcttcacataataagggtttgaagactgttccaaatagcattcgctcagagaactataccattacctttgaagtcgaggaagagaagtttcccttttttggaaagaagtatcaactcaaattcgcgagtgacgcggtgtttgagaatcagtgcctggtccactttcccacccttatgagattatcaagggaagctggacttgaatatgtggagatccagaatttaaccgagttttatgatgataacagaacacaattcgctccaatgcttggtggttacggtgcaagttttttggatgctcgagggaagcttgttgctcgttcctacgacattttaggcttgtattcagcatttgtgttccagaagcctgatccagaggcaataccaccgattgtaactcccgacttgcctgatcctgataaaggtcacgaagaggagtggctccagccacagcaggcgtcagtggaagatgggagacgctcgcatgcggatgtgcttcccatagaccctgagaaaggcatcctgggtcctggacctgcagacatgaggctttagttgctggacattcaaatgcagctgagcctgggtagtgatttttttttccaccgtgggcattctcccatagtcccatgtggccatgtctcctttatgagtccacgaaaatagcgaacaacactacaaggctcatgaatcctgcacggacgcatgggctttcttgtaaaacaaatgctcgatacgtatgaccttgtacggtctttgatgtgtatatttgactgctcatactcagtac

SEQ ID NO: 215 - DNA, 1588 bp, Zea mays
acgatccttctagacacttcgacgcgcccgttataaaggccggcgcatccgggccatgaccacacagccccttgctcattggctagggcggggaaggaaattgcgggaggatgcgaagccattggtgtattgcatatggtggcaccaagcatgaggcaggaactgcattacttgcaagaaagtcacaagctcattccaatctgattctctaaactttggaggtctcttacacctaggcctgaaagctcctctcccattagttgcctacaacattggaaaagagtttctcacattatcttagaatccattgcaagatcatacttgtggctttcttgcaagttgtgcagttgttgcctcaagcttgctgcctccctttgccagagctatcggtaaaacaggaagtccctagaaaggaaaatcgtgatttggaaaggaaattcatcaacaaacctgagtcggaaggatgcttaggaagcgggtactccctatgttccagattatagttcatttagatttgatgattcaatcaattatttctggggtggtctacagccaatgcatagtctctatctgtgtgtgtgttttgtgtttcccgtgcactctattcctttcgagaggcactctatgtcaggtgcctgaaatatggtttagcttcaggcaatgaagtggacgtcggatggagatccgagtgtccacgatgacagagaccgggttttgaatctctcgtctctccatctctcatgcgttcccaacttccaactccaatgccgtctccgctggctgatcagtgatcacctctgaccctctctggtgatgtgtacccattgttaatctctccaatgaagctaccctgcctgaccaggcccacaggctgtctcctgcatacggtggcaacacaccaacactgctggcctgccctaagacacatcttcgcgttgcgtccactggatacctgctttcttagtcagcagcatgccgaaaccctccatttgtgaaacctcagcggtgataggcggtggttgtcgaacgctggcatgaaggtgtgagctcccaactgctgaatcgtgttcctcttttacatgcacgtgtccaacaagaaccaagaaccgagattagcgctacctcagtacactgccggtgcaagataaacgaaggaagctgggattgcatggcactgcggtctgttatgtagccgtggaacagcaagacaaaaagacatggatattccttgtttggattggggtgtttgatccagaaacagtctcattgctaattgtttcattattactacaaatcttggtcgaggcgtgaatatccttgctcttgatataattatagtattttgaatccctattgtgttttttacttaagtgataaatgttgcaaagaaaccattagataattgttgaatgattagttattgattacattgattgattttgatttaatgaatcttaaataaaccagaagattcatgtgtatgaatatttgtgttgggaatttcttggtcacatgttttccgcataataatatcataaaactgtggaatgaaacagcttttgcaaaaaaaaaaaaaaaaaaaaaaaaa

SEQ ID NO: 216 - DNA, 1120 bp, Arabidopsis thaliana
atgaacagagacgaaatattgtccaaattcatttcttacagtaacaaacaggaaaaaaagatggagagaagcttgaagaagacgaagaacaattataacaactccataaagagcaatcttatgaaagatgatgaattgtttcatgtgattcacaaagttccctgtggagacactccttatgtcagagccaaacatgctcagttgatagagaagaacccggagatggcaatagtgtggttttggaaagccatcaacactggagacagagtagacagtgccctcaaggacatggctgttgtaatgaaacaacttgaccgttctgaagaagctattgaagctatcaaatctttccgtcctcgttgttccaagaattcccaagattcccttgacaatgtcctcatcgacttatacaagaaatgtgggagaatggaggagcaagttgagttgttgaagaggaaattaaggcagatctatcaaggagaagctttcaatggtaaacctaccaaaaccgctcgctcccacggaaaaaagtttcaagtgactgttcaacaagaaatctcaagattactgggtaacttggggtgggcatatatgcaacaagccaagtacttatcggccgaagcggtatacagaaaagcccagatggttgagccagatgctaacaaatcgtgcaaccttgcgatgtgccttatcaaacaaggcaggtttgaggagggaagattggttcttgacgatgttctcgagtatagggttttgggtgcggatgattgtagaacaaggcaacgggccgaagagcttctgagtgaattagagtcttcgctgccacggatgcgagatgctgagatggaggatgtcttgggaaatatcttagacgatgactttgttcttgggcttgaagagatgacatccactagttttaaatctaagagactcccaatcttcgaacagatctcgtcttttagaaatacattagtttgctagttaattcattctgtgttttcttgtgtatcatcatcatagctttgctgctttatagttttgatgagttgtaaatatatgtttctctttagtaactttgtacatacaacaaataatgggaacaacttcatttaagctccaa

SEQ ID NO: 217 - DNA, 651 bp, Hordeum vulgare
tgcgtccggtactgcgagggcaccccgcccgccgacgggacgcccgccgactgggcgcacgagacgctcctcgagcacgaccaggcccgccgcttcttccgctacgagatgaacgacaacaacatgggcttcggcgccttcttcgccgtgttccgcgtcgtccccgccgcggccggcgggtgcgagctgcggtgggagttcgagtgcgagcccgtgcggggcacgcccaaggaggcgctcgaggcgcggctgcaggccgggctcgacggcatggccgcacgcgtgcacgggcacctcatatccgcgcgcggtgccgtcgccgccgccgggactgcggggctggaggccgccgatgagctcaagctggacaactccatcgcggcctgatcgagctccgagcactcgatgtgcatgccaggcccggttccacctctgtgcgcacgtaccggcgacgtatgtttggttgtgatggtctcgttcctttctcgcggtactacgttgtcggatgatattttatctttgttctgttctgggcctttgttggtttgccgttatgtatgtgcgcgtacgtaccgtttactacagtgcggcagtagtacccctatatacagctgtaccgggaataactgtatgatattactcgtaatatat

SEQ ID NO: 218 - DNA, 2203 bp, Hordeum vulgare
accctcactaaaggtcacaactactgaatactcaacatgacaaagctggccacgtgttgtctttgatgtcacttcacaagaaacgtcttttcatattcctttacaccgtatgctttcattactattgcgtgaagcaatgaagaaatgtttcggagaggatgccaaaacagaggaatgttcagttgtgcagtccaatgagttcttctctcaggtacttggaggttgtgagccttgtgggtttgcttcagttgtgatggagcatccattaagattgagagtattttgcgcacaagtgcgtgctggaatgtggcgtaagaacggagatgcagctgtacttagtgctgagtggtaccgctctgtgcaatggcttgaacagggcttggagtcggatttgtttctgcttcaatgctgtggtgcattatcttctccagagttctttgtgaggaccattcaagaaagatttggtttgtcagattatacatctatggatctcacggaacagaatgagtatgaatcagttcttatacaagaaatgctaacttttcttgttcaactagtcaaagaacgcagattttgtgggcgtcccacagcagacaacttgaagagagaattgatttataagttggccgttagagatgccactcatagccagattgtgaagtcccttccccgtgacctttcgtcaagtgaacaacttcaaattgttctagattcactcgcagtttattctgatccatctggaaagaaaaagggcaagtatgtgcttcgcgaagcattctggaaggaattggacttatatcacccgcgctggagttcgatggaattagagattgctaaagagagatattaccgttgttgcaaagtttctgctcttggcgctcaactacctcaatggactcatgtttttagccctctgcgcagtatttctaaaattgccacctccaaagctgtccttcaaattgttcatgctgttctcttctatgctgtttacaccgacacatcatcggtatcacgtgcccctgacaatgttctcgtgactgctctgcacctgctttcgttggcacttgacatatgtgaatcagagagtcaaatgtctgcggaccagtatgggatggacttagtgcagcatgatgatgaatcatgggttgttctgtcatctgatgcagtagaggcttttcccatattgacctattctacagaactagtctccccagagtctgacaaactaaagaaggaaagcatgataaccttgcttgtttcactaatgcacaaggaaaagaatgacagcaccttttctggatgcaatattccatctctagttgaaagtttgttgaagagatttgccaagttaagtaagcagtgcatgtctgcagtaagacaaatggcaccacaagtactcccatccattcctgagcatgccagcgccaaacagaatttaggatctccagattcgacgggaaacagccaatgcaaagctacaatcatggcaaaaatgggagcagagcagtcaaaacttgctgaaagtatgaagtcgtcaggaaatgaagggcctgatgttccaacatttgagccagatgcacctagatcaactgccatcgagatgcgaccattttgctctctttgccaggattcggattccaaaagtccactctgctgtttgattcgccttcaggctgctctggaaactatgatggcagagactgctgaggatggtcagaccccaagatcagttgcagagttcgcttccaacatactctcccatgtcggttccacaggctcgttgaagtcgccagctgttgaagttcttgaggataaactcagggcggaaagacggggtgcggccgcgctccgagaagaaatcgacgccttgaagaagcaggcagaaaaggccgacgcggtcattgccaaaacccaagaagagatggaggaagtcaggaagaagcaagccgagacagaccaggttcttcagcttctcctgcgcaggtctcagggtaaccccggttcttagtctctgttgaaactgtggttctactggagtatgtcgaacttgtttgagtttgttgttgtgtgaaaaacttcgtatcttgtgtatatgttaaataaaatgcgagttaaatgttgtatttatgtggcatattcagtattagtatattgtattgggctatgcaatgcatgatgcttctgattgccatttggccggtag

SEQ ID NO: 219 - DNA, 922 bp, Hordeum vulgare
cccgctatcctatcatggctcctcacgccgctgtcctcctctccctcctcctgctcaccacctgcgcggcggacacgcatctccacttcttcctccacgacgtggtctccgggagcaacccgacggcggtgcagatcatcaagggcccggcctcgtcgtccaacgccttcccgggcatggccttcggcgacacgaccgtcatcgacgacgcgctgacggagacctcgtcgccgacgtcggcgcccgtggggcgcgcgcaggggttctacatgatgtcgtcgcagtcgggcatggtgctgatgatgtgcgtgaactttctgctcaccacgggggactacaacggcagcacgctcgccgtcatcggccgcgacgacatcatgaccaccacgcgggagctctccgtggtgggcggcacggggaagttccggatggcgacggggtacgtgctgtggaagaccaacagttcgaaaggcgccgacgccaccatcgagctcgacgtctacaccaccgccctcaacggcaccaccaccatcgacgccaacgcgccagtctcccccatcgacgggggcggcggcggtacggccggcggggccaccgggaagtcgtcatcgggcgcggcggcgctgaggggagcagtaccttacgggtgggccaacgcgtgggtagccgccgtccttgtagctctggctggttgcgtttggtgagcagctcgatttcgatacaccatgaatctgagtgggtgcgagtggggtccatacatacaacggaatagatcttgattgggcgtgaggcgttggtcggtgtagtggtgtggttggtgatgatggggtgggtggtttcttgtcgctgttcgggttggggttggtgatgtgcacatgattgcgcatctccatgcgtgagcgtgagaggttactttctggct

SEQ ID NO: 220 - DNA, 1402 bp, Hordeum vulgare
acgagggggccatgctgtacgaaagcaagcagcagaaacacttcagtgtatgcaatcactagtaaaggctcaagctcgtgtcagagcaagacaggttcgtattggtttggaaggtcaggtgacccagaagaaggctcctgaacaaaatgctcacgatgatcatgctcgagaaattgaggaacgctggtgtggcagtattggctcagcggaagatatgcaagctaaagtattgaaaaagcaagaagctgctgctaagcgggaaagagcaatggcatatgctttaacgcaccagcggcaggcaggttccaggaaactgaaagctgcagatgtccaagggccagaggcggatgagaaccagtgggggcggaactgggtagagaggtgggtggctgtacgcccgtgggagaacaggttactggacagtaatgccaaagagagtgtaccaattggcgatgataaggaggctgaggaaaatggggacagggatgtaaacaatccaaaaggaaaagttgcagtttcgggcattcagtcaaatggttcaagccagacgaaagatgcaaaacacaagaagtcacattctgatgcaagtggttcttcatcggggcaatctgcggctgcaccacccaccgcttctttgggttcatccaagctgaaaccgaagccatcggatcaaacctctgaggaagtcagccctcaacctacagatccggctccgcggtccacaagtaatcccaaggaaaggccagcacaagtcagtgcaccaaccaagaagcggctatcccttcctaacaacgctgtcggtggcgcggcaagaaaaggccaggtgagcagcagcgagagaactcggtccgtcggttccaagaacacggtgaagggtgcatcgaagcctgaatcgaagcagcgaccgagtcccggtagcgcaaccgcgaagcgggtccaggcacaggcctgatgattcaagccactccctcccatttcattcagaaacttggtcatggcaatgcccatctgtcacggtgtgtcgccgcatcgtctgtgtacataaaaccgagaaataaacaaccccgcatctagatcgccgccatgctccacgccccgccatcggtaggcgtcgtcgtaaccgtttcctcggtcatgcttccgtcatctaccatttctgtgtgtatgttatcttcttcaagccactcttccgaaagaagcaaagaggctagcaccatgttatctgcaagttgtgttcgtccttgagtttcagtgtaagaaaaaaacatgatttagttgttccaacttgacatgttctccagcactcggtggtggttggtgccatgccatcaaccatgcgtatcccccatgtatatctctctctggctgcccttctttcatggaaagttcatcttgattcttc

SEQ ID NO: 221 - DNA, 1828 bp, Hordeum vulgare
gggcaactccacctccatggcgctagccggcgccgcgaacgccaccttccgcccccgcctggtcactgccgccgccgacacctccgacactcatacacgccgccgccactggaaggccggcgagttcccattccccaccacctccccctcctccggcacgcagcagcgccggagaccccggaccacggagcgtccgcccccacctccaccgtccaagggggaagacccggaggggagagggcgccagaggcactggaaggcgggggaagacccggaggggagaggacgccagaggcactggaaggcgggggagttcccggcggcgggcgagtcccaatcccagtccgggaggaggggccgcgctcgcacccccatcaagaacgtccagaagaggctcgacgcgcgcgccgatgccaaggcctgggcctgcaccgtcaccgaggccctcgccgaccgcatcgccgccaagaactggcaaggggcgcttcaggtcttcgagatgctcaaggagcaacctttctactatcctaaagagggcacctacatgaaactcctcctgttgctggggagatcaggccagccttctctagcacaagaccttttcaccgagatgcagcagcaaggatgccagccaactcccgagctttacacggccttgatcggggcctactgccggaacggcctcctagacgaggcactcaagcttctccaagacatgaaagccaacccgctgtgccagcctgatgtctacacctatagcatactcatcaaggccttcgtcgacgccccaaggttcgacctcgtcgatgctatgtacaaagagatggctgagcgctccgtggcgccaaacacggtcacgcagaacattgttctcagtggctactgcagggccggaaggttggatgatatggagaagctactctccgcgatgctcgaaagtgcaaatagtaaaccagatgtctggaccatgaacattatcctaagcttgtttgggaacagtggccaggttgagctgatggagaagtggtatgagaaattccgaggctatgggatcgagccggagactcggacgttcaacattctcattggtgcttacgggaagaaacggatgtatgacaagatgtctgcggtgatggaatacatgcgcaggctagcgtttccatggacgaccgccacttacaataacgtgatcgaggcatttgctgaggcaggcgatgcaaagaacatggaggacacatttaaccagatgcgctcagaggggatgaagccggatacaaagaccttctgttgtctcataaacgggtttagcaacgcagcccttttccacaaggtggtaggcatggtaaagcttgctgagaggctcgatgtaccgccaaacacatcttttcacaactctgttcttgcggcatgtgcgaaagcagaggatctgatggaaatggagagggtcttcaggcacatgaaacatatgcagtgtgaaccagatgccatcacatactccatcttgttggaagcttatcggaaggaaggaatgaccgataagatgtacgctctgcaacaggagaacccaagtttggtttcgactgagcttgtcatggtgtaaccgacctcatgaattgattatggtgtgagttcatctgactgaaataaaaaatctgttcctctacatgtctggaatccataatgcaacctagcaaattaactagtgccagaattgtttcatttctgttgacctacaagattagtatgtatatctcttgatgactgtattgctgtaagtacagagaagcttcattatatcaactctcaagtgatattcttctattttagt

SEQ ID NO: 222 - DNA, 1432 bp, Hordeum vulgare
cctacttccgggaactcttgctgccatgggtccagttgtgctcctcctcgtcgtcgttgccgttgccgtcccggtcgtgcggccggcggcggccgagctgccgcggctggagcactcgcccaaggcggatgggtcgctgtccatccttgccgtcggcgactgggggaggcgtggggagttcaaccagtcccgggtcgccacccagatggggctggtagcggagaagatggacgccgacttcatcatctccaccggcgacaacttctacagcgatggcctaactggcgtcgacgataaggccttcgaggactccttcaccggcatctacactgccaagagcctccagaagccttggtacacaattcttggcaaccatgactacaggggcgatgcactcgcacagaccagccctatccttgcgaaagtcgactgccggtggatctgcatgaagtctttcattctaaacgcagaggttgcggatttcttcttcgtcgacacgacgcccttcgtcctcacgtattggaccaaccccaaggacagcacgtacgactggagaggcgttgctcctcgcgagacgtacatcacgaatctcctcaaggacgtggaggattcgctgaggcagtcgagggcgccatggaagatcgtcgtcgggcaccatcccatccggaccgccggcaagcacggcgacaccgaagagctcgtgcagctgctcctgccgatgctcaaggcccatggcgtcgacctctacatcaacggccatgaccactgccttgagcagatcagcagcagcgacagtcctctgcagtacctgacgagcggcggcgggtcaaaggcctggggcggcgtctacgcgccgggcgccgacaaggtggagttcttccacgacgggcagggattcatgtcgctgcggctgaccgccacggacgcgcgcgtcgcgttctacgacgtcgccggcgccgtccggcacacctgggggcataccaaggccgcacactactgatcgaataagctgccgtgcgcgccagccatgcatgggcgccatttcgatataatcagcgcagcgcccgcgcgaacaatttaagcatcttcactacgcactcaaattcttattcttgtaagttctccgggttaaactgcaagtccttttagacttttgaatcatttgattaaaatgtaactggtgatgagtgatggatgatgttgtcggtgcataaaacaagggcagtgatctgcccgctaaacttcccaaaaaaaaatagattaatagatttactagggggggggggagagatataagaagaccctggggggggggccgggtccccaattggcctttatgggaatcgtgttaaaaatgcatggggcgcgggtttacaaactccgggatggggaaaacccggggggtaccgcaaataatttggctggagacaat

SEQ ID NO: 223 - DNA, 1429 bp, Hordeum vulgare
ccgccctccaccgaggatggctctgccggctgccaaggcggcgccggcgacgcctttctcgtcgcagacgcacggcggaggcatcctcctcggacgagcttcgtcaccgccgccgcctgccgccgcgctgcgcctcggaccactcttctggccgtgggaaaaggtgaatgttgggcccctttcagtttcccccatgggttttggaacatgggcttggggcaaccagctgctctggggctacgaggaaagcatggacagtgaactgcaggagtgtttcaatttggctctgaagaatggcataaaccttttcgacaccgccgactcctatggaactgggaagttgaacggccaaagcgaaaggctgctcggcaaatttatccgcgagtgccaagggccaataaaatctccagacgacgtggtcatcgcaacgaagtttgccgcgtatccttggcgactaacgtccggccagtttgtcaacgcctgcaggtcgtcattagaaaggttacagatcgaccgtctcggaatagggcagctgcattggtctactgccaactatgcgcctctgcaggagcgcgctctctgggacggtctagttgaaatgtatgacaagggtcttgtccgggccgtgggtgtgagcaattacgggccgaagcagcttctgaagatccacagctacctagcatccagaggtgtccccctgagctcagctcaggtgcagttctcgctgctgagcatgggtgaggagcagatggagctgaaaaccgtgtgcgactctctgggcgttcgtctcatcgcttatagcccgcttgggctgggcatgctcaccgggaagtacgacgcctctaaccttccaaatgggccaagatctgtgttgttccggcagattcttcctgggctggagtccctgctgtcttgcttgaagagtattgccgaccgaaagggcaaaaccatgtcccaggtggctataaactggtgcatttgcaaaggcgcaattccgattcccggcgtgaaaacagttagacacgtggaggacaacttgggtgcgcttggctggaggctgagccctggtgagatctcagagctggaagccgcggcgatggagtgccccaagaaaatggttcagaacatatttcagaccacatgagcaaactgtagtactccgtattaaacatgacagcaacctgaaataagagcagagcaggttgctttctcttctgtgcctagttcagagttcggttcagaacttcagagttataccattgtataaatcctgactagatgtctagagctgtatgctgattgcctgttgagatttaattaacccacgtgttaattaagaagaatcttcactatccctaaccgtcatgcacaaggaacgcgactgttcgctcgtgtcttttcggaccatcgtgtctgttggacgcatcct

SEQ ID NO: 224 - DNA, 617 bp, Hordeum vulgare
cccttctccctccaccctccgccgcggcagcccccgacccttctccgagatccggccacctccgtcctccgtacccccagcacgcctcctccgtccaccgcccggtcgtacgcaggccgatccgccgccgcgtcacgacagcgggccccgccgctagcgagcaatggaccgggtcggcagcggcgagaagcacctcgaggactgcaccgtcgccaatgccctcggaacttgggtcttctctgttgctggtgctctccttgccattcctgtgggcataaagaggaagtccttcgctccgctcgtgttctttggcactactggaactatgcttgacatcatcatgggcattagccagtgtgagagggagcatgctgagcggcagatgaagcttttagaagcgcagaaccttgcaacaaatgcttcagtagagggtgaaagcttgactgattcatttaccaatgtggataagcgagatggggcctactgtggggtttcctttgatggaattccctgagtttaatagtcatgatccttgggaaacattgtgggtccttctatatccaaaaatttgtttggaaccatgatcacggttgtaaaaagacacatgaaaggcctct

SEQ ID NO: 225 - DNA, 791 bp, Hordeum vulgare
ccgtcgatatttactacgactatattcatgtaatattatatttgcatgctaggatttgtttgcggcaggtagtgacacaagctctagcacagtggaatgggcaatgactgagcttcttcaaagctcgtcctcaatggccaaggtttgcgacgagcttgcacaagttatcggctcaaaaagaaacattgaagaagatgacattattcggctgccatatctccaagctgttataaaagagacttttcgactccatcctccagctccactcttgttgccacgccaaccagagacgacagtgaaaatagcaggttacacaatacctaaaggttcacgtgtgttcataaacgtatgggcaataggtcgagataaagatgtatggactgagcctgagaagtttatgccagagaggttcttgggttcgacgattgactttaaaggtctggattttgagctccttccatttggtgcgggacgccggatctgccctggaatggcattggccattaggatggtgcatgtgatgctcgcttcattactaaatcagtttaagtggagtctacctcttgagctggagcatgatgggattgatatggaagatcagtttggcctaacactagcaaaggtagtgccccttcatattatagcaacaccaatttgacctgataacataatgcaacctttttaagaatgatttgttaatgtgtaataattcaagtgtatcagccatgtaatttataccgtttatgtggaaaacaatcatatgcctagagttcaaagttttggcaaaaaac

SEQ ID NO: 226 - DNA, 1360 bp, Brachypodium distachyon
atgcctcaggtcaagtctactgcaggtgctggcgcaatgccttccggatctaaaggtggtgatggtgaagtggaggcagggttcgcgaagctgcagggtgaggattttgagtattacatgcagacctactcgatcatgctgggacgtaacagcaagaaatcgtcagtggatgtggatctctccagccttggtggaggcatgaacatttcgcgccaccatgcccggatattttatgacttccagcgccgccgattcgccctagatgtcatcggcaagaacggctgccttgtcgagggtgtcctgcacctccctgggaaccctcctgttaagcttgactcgcaggatctccttcagatcggagacaagaagttttatttcctcctgcccgcgcgatctatctttgcctcatttgccgctgctcgacaagtccctgttattccgacacagatcctgccgccatcctttgtgcggccaggccacccaaatgtgtccaattaccatgaccagccctttgaaggtgattatggccgagagggtgatgacattcggaatggtatcaatgaaagtggaaccaggggcaagttgataaagagaaccaagaagccttctggagatctgggcatttatggtgggcaccgaatcaatgttgaagcaatagaaacactgggtgaagaaaatatatcagatgtaagaccaaggggtgacaaggatatggacaatcagcagctcctgcaaatggaagagaaggaagtcgtgtcatctgttgcgaccgtgttatctgacctctgtggtcctggagaatggatgcctatgagaaaactccatacagagctcgtggaccagtttggcaacgtgtggcaccacagcagggtgcggaagtacctgactgcggaggaatggtcgccggttgaagcaaaggggaggccatggtttggcctgctggggctgctgaggaagtacccggagcactttgtgatcaacaccaagtgcaagggccgggcgatctcggagtttgtctccctggtctccttgctctcctagaggggaccgcagactaccgacgacggccgtctctagggtctgttgtttcgtgccgtcctgttctctgtccagccatgcccagaagggccaagggcagagtggcggcgatggtcctggtttgtcttgtcttgtctgtcctttgagtaaacggggaatggaccctgctgtactgtgtcctgtactgtaatcctgggtttcccctctgtgtttacctgtagctctgtgactgtgatacctagaatgttattatctggtagcaagactttcaggtactagctcagttactgttgaaggaagtgtactagctcagttggtgtct

SEQ ID NO: 227 - DNA, 1657 bp, Brachypodium distachyon
atctcggcccatggacgacgacggcgccgcctccccgtcgccatcgccctccccatcgcgctcctcgtctccgctcccgctcgccgaacccgtcaccgtcgccgccgtgccccccggccacctcgccgtcgccctccccatccagaagcctgccccctccagcggcggcggcggcggcggagggggccgagaggacgcctggagcgacggcgccacctccacgctgatcgacgcctggggcgagcgcttcgtcgcgctcggtcgcggcagcctacgccacccacagtggcaggaagttgccgaggtcgtctcctcccgcgacggctactccaagccgcccaagtccgacatccagtgcaagaaccgcatcgacaccctcaagaagaagtacaaggtcgagaagtccaagtcgggctcctcatggccattcttcgaccgcctcgactacctcctcgcccccgtccagaagctcgggggcaattctggccgggctgcaggaaattcgggctcctctaacctcgccgagcggacaaccgctgttatgattccgcgtttcaacttccctacgcgcagccgtacgacctcgcacttccccccctccgcaggtctaaagcgcaggctgccgtcgccgccccaggcctcagcatcgtcggattcgtccgatgggttcccacctgagccaccggttgaggctgccaacggcaagagacagcgtgtcgaggaggctgtgaatggagcagatagcagcgtccgtgtgcagggtctgcgcgacctggcgcaggcgattcggcggtttggtgaggcgtttgaacgtgttgaggcctcgaaaagggagcatgagctccggatggagcgggaccgcctgaatgctgcccgcgagctagaggaccagcgtgtgcagttcttcctcaagatgcagatggagatctcaaaggccaacaatggtaccgcacttggtccccttgctgccgttgctgctgccatgattggcaattcagcacctgccacagtccccgccgttgctgatggcaacggctccaggagaacatctatggcacctgatgtcgggaccagcagcaatcaccatgtccggtaccgtgtgaaggatggcaggcatcatcaatccttgcaacacccatcctaccagtacaaccagaacaatgccggcgaggatgccacaggccatggtagtggcagcaacgacaacaaagaagatgatgaggtggaagatgaagaggaagagagccagtagaatttgtatccagtcaattggcattgtcctggtttgaattgctcccagttaattaggttggtctgggagcaagaaatgactattgagaactgctagattgtagtggtatttagcaaccaggagtagttaagttatggtaagtaactgcgagttggttgtagtaacttatagcttacctgtttgtgcttgtgatgtgattcatgtatcattggggatgtctcattgtggtgttagatgtatcagtgcttgctctttaatcatgataagtgtcgtgaactgttgtcaagatgtgtcattgaggatgtctcattgcagtgttggatgtatcagtgctttctctttaggatcatggtcagtgtcctcaacttggtcaagatgtgtgcacagtactcaattttccctttc

SEQ ID NO: 228 - DNA, 1698 bp, Brachypodium distachyon
atgcctttacctgttgcctgctgctgctcaggtagagtagagagcacagcagtaatacccatgcatgcatcaggtgctgctgctgcttcaggccttcaagagccactagtagcccacggcctctataaacacaggccgctcgtaccgtcctctgatgcagcatttcttctcgaggcaaagaaattactaacacactcggttctcttcgctaccgcggagagagcatatatctttgagatcatgggagggtcgatgtggatgaggtacgcgccgcacaacatgatgatcctggtgcagctgtcctacaccttgatgtacttcgtcacggaggacgccttcaaccggggcctcaacccctacgtttacgtgacctaccggcacctcctcgtcgccctcctcctctgcccgttcgcctacttccatgaaaagaagttgaggcccaagatgacgttgatgctgttcctggagatttttgtgctctcccttctgggggtgagcttgactctgaacatgtacttcgcgagcctcaagtacacgtccccaacattcgtcaccgccatggcgaacaccgtcgcctccatcaccttcgccatcgccatcgtcctcaggatggagatcgtggacgtgaagagcccgcgaggcctggcgaaggtcgcgggcacggcggtgtcgttcgccggagtgaccaccatgaccttctacaaaggagcagccatcgcgagcccatggaaggcgcccatccacatccacggcagcaacgccgtgcacggtagctgggtcaaagggtcgctcctcgccgtggccagctgcgtctgctggtcgatctggtacatcatgcaggcggggtccgtggagaggtacccggcggagctgtcgctgacggcgtggatggccacggtcggggggatacagtcggctgccttcacggtgttgctgcagcacaggaaggaggactggctcgtagggttcggcctcaacttctggtgcatcatatactctgggatcgcgtgcagtggcttcgcggtgttcgcgcagctgtggtgcacggagaagaaaggccctgtcttcgtcaccatgttcaaccccgtctccaccatcatggtcgccatcctggcctacttcatctgcggcgaaaatctttacgtcggaagcataatcggaggaggggtggtcatactgggcatgtacatgctgctgtggggcaaggacaaagatcaagagtacaacgcgagcagcagcaaggagctgcaggggtccgatctggactgggagaagcaggcaaagatggccgacgtttcttcagtacagaacgattctcagccagagacgaagacgatgacatagaagggttgggtcgccatcgtttcttcagcacagaactgtacctgcctgaaccgcgtgcattccgatttttggttttctggtgcactggcgttttagtgccttccagaaatcctaactaggagtaccacaattctgcaacctattgggagaaacatttgtggcgtggataatccactaacggtttgccagacggcccagacccagaagtaagtagtctgagaggttgggtataccagttcaggtagcttccctgaatcggaatacgcccgtctacgcttttgttccaagtacgtgctgtgttcggccaaatgcggcttgtctccgtgagaaacctcataaaacgaatataaaaaa

SEQ ID NO: 229 - DNA, 1171 bp, Setaria italica
ttttacttctgaagggagctcttcatatttaagaaggcatggtacatcagcatttgcgcaagagtttgtggcatcttttattgataatgacattgaagaagaagatgaagaaacccatgggatggcattgccttaccagcctgcatatcggtatatggaaaacactaggcgacatccatgcagatatcgaatcctccggctatctgaaacagctgatatgaagtctaaatggcgggtgcttcttcagccaggaatcaggcatgccttgtgttatggcatgctaattcaagctcttcagcagtcagcaggaatcagtgtccttctccgctacactcctgaaatacttgaacaggttggagtggttagtttgttttcagacattggactttctcctcattcaacatcaattctcataagtgcccttaatgctttgctgttgctcccttgtataactgctgcaatgctgctgatggatgtctgcgggagaagggctcttatactggccactactccaatcctgatgttatcactgagcgttatgtctttgtccaccctggtggatatgggatcattggagcgtgccatcctcttccacctcgcgttaaccatttgcttctgctcctacgttgttggtttggggccgatacccaacattctctgctctgagatgttcccaaccaaggcccgtgcgacctgcgtgagcttctgttctctttccttctggttcggaggtctgctttcagcatactgcttccctgtgatgctgagtaccatcgggctcggcggagcatgtgggatctatgcacttgtgtgttgcattcctctttgtctcgtctactatagaataccggagacgaggacgcttaacttggagttaatcgccgaggtcttcaagctttcaaggcagctgccgtatgtacagtaggttgctcaggactgaaggtagaggtagctcaggctgggtgctgaactgctgatggatgatgtgtgtacatataacaattgtagcttggatgttgaaagttttgtgctagctttaggaggattggtgatagtgtacttagtggttatttcttctttcttaccaggttggtggcagtttttgtagtgtttacagcaagaaattattcactacatgattcctttctgagatcgaaataatatttctggg

SEQ ID NO: 230 - DNA, 839 bp, Setaria italica
cacctctagcaacgagcccacctccaagcaacttctcgcacgtagtctcccactctcctcttctttccccactccagcgagctggcaaagcgtgacatcttggccggcgatgccggcttatgccctgacggcgaagcaggagacgaggcggtgatcagcagcaaggcggtggtgaagaagctgtaccgcgcgctggagcgtggcgacgtggacgccgtccgccgcctgctgaaccccgacgtggactggtggttccacggcccgcgggcgcaccagcacctggtgctcatgcgcctgctcaccggcggcggcggcggcctcccgttcaagatccggtcgctggacgcgttcgggccgaccgtgctggcggagggcacggacgcgacgggcgcgctgtactgggtgcacgcgtggaccgtgggtcccggcggccgcgtcacggaggtgcgcgagtactgcaacaccgcgctcgtcgtgacaaggctcggcggcggccgcgacatggaggcgcgggcggcgccggcgagcgaggatgtgtgctccaaggctcagcaggtgtggcagagccggctgccggaccaggctcggaggaaccttcctggcctcgtgcttgccatctgaactgatcagatagtgtcatgtaacagaactcctgaggcaaactggccggctgtaatttaactggccacaggctctacacgatggttcaacttttgttaactgatcaaatggttaaaagcttgacgctcgggagtcaaagcttccacgcttttgcatcctgtggggtcgtgaccaccggatgccacgaggaagatgatagaatcctagtggaacttctc

SEQ ID NO: 231 - DNA, 1430 bp, Zea mays
ctcgcccccgcagcacaccgaccacggatccacaccaatcgtcgcccgccgatcggccacatacccaccaacagaccctcctcgcccgcacgggatcccaaactcgcgtccacgtaggacgccacgcggaacgggcggttccgcgtcggagacttctctcccctcgcgcaacctatttctacgcgccccacccgttcgtcgccggtgactcgtctcggatcgtgctaattctactactacttcggaaccgccgccgctcccggcgcctcggattatcaactaccgcaggaggtcgcggcggcaggatcggtggtccagcgtgcgatggcggcggcgcctaccgtgcggggctacgggccagcgtcgccgtcgtcgtcgtcggtggcgctgcctcggccgcgatcgcgggtgcccgcaccgctcgtgcccgtgacgacgcggcggggggcgccgtcggtgcgcctgcgcgcggcgggcgcggacacgcctccccgcggcggcctgcagctccagcggcgggaggaggacgaggggctgccggggaccgtgttgggccgaggggaggacgatgaggtgtcggagaaggtcggggaggagaaggtggagaggtggatgcgggactcgatcgcggagatcgtgcggcacgtcggggaggcgccgttcctggtgcacctgttcagcagcggcgagggcgagcgcgtgacggtgcggcgggagcccgcggcgccggagagctggccggacgtgcggcgccggtgggggccaggcggggcgcggaggccggacgggatcatcctggtcgagcaggtggcctcggacggcggcggggcctccgccgcctcggaggcggcgcggcaggtgtgggggctggtggtgcaggcgcgcggcatggagcgcgcgtcgtgctacgtgctttccacctgccgcgtgcgctcgtcggccgggttctgcacgcacttctgcctcgcgcgggcgcagtgcttcggcgaccctgtcgagctccagctccgcaacgcctggctcaaccgcctggccggccgccggtagccgcccgtcggctgctgctgctagtgctactgatactactaataggattcgaatcgatgctccaaggaccaaatgcaatgatgcctcctcttcgctggcaagaacgaggaagagaagcttgcagattggatttgaagcaggggagacgaacatatcttttcgttcacttggggttctcccggaattggatatcaattgtacagattattgaatgtaaatttgcctattcaatcaagaagcaattcatcgagtcaaattaaattacaattccttgcccgaccacctaatctatcgcagcgtcttcctatcgttgcaagggaagggaagtgacggcatgatcacgattccatcgatttggatcgcgccgtaaagttgcttcttta

SEQ ID NO: 232 - DNA, 1457 bp, Zea mays
atgaaggtcctcgtcctcgccgtgctggcgctcgtcgccgccgccgccgccgccggtcagggcgaggaggggggcgggccgccgctgccgttcgcggtgggcgcggcgccggcgggctgcgacgtcgcgcagggcgagtgggtgcgcgacgacgacgcccgcccatggtaccaggaatgggagtgcccctacatccagccgcagctgacgtgccaggcgcacggccgccccgacaaggcgtaccagagctggcgctggcagccgcggggctgctcgctgcccagcttcaacgcgacgctgatgctggagatgctgcgggggaagcggatgctgttcgtgggtgactcgctgaaccgggggcagtacgtgtccctcctctgcctcctgcaccgggccatccccgacggcgccaagtcgttcgagacggtggactcgctgagcgtcttccgggcgaagaactacgacgccaccatcgagttctactgggcgccgatgctggccgagtccaactccgacgacgccgtggtgcactccgccgacgaccgcctcatccgcggcgcgcccatggacaggcactacagcttctggaagggcgccgacgtcctcgtcttcaactcctacctctggtgggtcgccggggacaagatccagatcctgaggggcgccgacaacgacccgagcaaggacatcgtggagatgaagtcggaggaggcctaccggctggtgctgcaccaggtggtccggtggctggagcgcaacgtggaccccgtcaagtcgcgggtgttcttcgtcaccgcttcgccgacgcacacggacggcagggcgtggggcgacgacgacgcggagggcagcggcaactgctacaaccagacgtcgccgatcagcgccgcctcgtcctaccgtggcggcacgagccaggagatgctgcgcgcgacggaggaggtgctggccacgtcgcgggtgcccgtcgggctggtcaacatcacgcggctgtccgagtaccgccgggacgcgcacacgcagacctacaagaagcagtgggtggagccgacggccgagcagcgcgccgaccccaggagctacgccgactgcacgcactggtgcctccccggcgtgccggacacgtggaacgagctgctctactggaagctcttcttccccagcaacgatcaggtcctctgatggtgcattggtgcctgcatacatacgcctggaaaccaactgctaggggctagcccaaagaaaatgtgtctagatgaacaaagacatggggttcaaatgttttgttttgatttcggatatggacgctgtcgatgctcttgttctctgtggaattcttcttaccaactgtgcctcccatatatacatcactactgatactagaatctatgctgatattttctttcgttaaaaaaagcgacagtgaagcgtagaagcacctacaagagttttcaaaa

SEQ ID NO: 233 - DNA, 1210 bp, Zea mays
gtcgtttgtttcaggcccggcgagccctgcgcgcactacgtggcttggtgcgcctgcaggcgctggtgcgcggtcaccaggtgcggcggcaggtgcacctcaccatgcgctgcatgcaggccctcgtccgagcccaggcccgcgtccgcgcgcgccgcctcacccaacacccgctcctcctcctcccgccgccgacacctccagccagcagtcccaccctgctgttgggagcggggcgtccattatgcgtcgagctggcattgcagggcgaccacgacgtcggtgacgacggcgaggtggccgatctgttgctccagcagagaagcaggagcagaggcaggtttggaagaggcgacgataacggcggcgcgaggagcccttccggggcctgggacagcagtagccgcaccctggaggacgccagggcggagggcgcgcgccggcacgacgccgccgcacgccgggagcgggcgctcgcctacgcctacgcctaccagcagcggcagtggcagcggcaggaggacgagaaggccggcctgggcttccactggctagagcgctggatggctgcgacgacgcaggcgcagcagcaggagcacgcgcccgaccacgccaagacgcaccagagcacccccaccaggacgacgtcatcctacgtgacggcggccgctgctttcgcgaacggcatgtcggagaagacggtggagacggagacgacgtcccggagcccactgaaccaggcctccgcggctgctcacgggcgtccgcccgcgatcccgggctacatggctgcgacaaggtcggctcgagccaaggcgcgccccgcgccgccatcggctacacccacgcatgccaggagccggtcgggtggcgggctcgccggggacacgtcgagctcgggccagaacggcagtgcggtcgccgggtacagcccggactcgagctgcacaggggactggaccccgccgcggctcggtgtcagcacgcgcaccagcagggtggcctatacttgagcttgacttgagcatggcgacaacatcagtttcatcatcatgaatgtgcgcttgagagttgagactcatttttgaatgttcttgtttgttcaaaatttatgtatagcttgctctgtcagatgagatgacacgcctgatgccgctgtaaacgctctgaatactcaaaatgattgcgaataaaacactcgagaattcta

SEQ ID NO: 234 - DNA, 1990 bp, Zea mays
caagtgagagataccaggcgaagaaaaaagaaaccgcggtcgggatgccagagcagcgctaagatccgtgacgtcgagcgcgggaccaaaatctatagtggtctcaatatgattttttaaaagagactaaaatggggaaaaaactggctagcacctagcacgtatgacattgctcgctgccacttgggtcccatgcgccatagctgggtcccctctcgcggccacttgggcccatcatgcacgctaaccccacacgcagaggacggcccatggcgtctgttggtctgccctgccctgccagctgccatctcatctatatatatgcggcatcaggtcggccactccagtcttccaaaacgaagcaaaagcaaccgtcgagcttgcaacgccttacgcctccacactcaacagtcatggtcgtcatgggcaaggagcagcaacacgaggaggaggaggtgcaagggaaggtcgtccaagaagaagtgcaagtcgtccaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcatcccgcgcagcagcgtggacgtggagcggctgggcccggagctgcaggagatgcgcggcgggctgatccgcctctgcgccgacgcggaggcgctgctggaggcgcactactccgacctgctggcctccttcgacaacccgctggagcacctgtcgctcttcccctacatcaacaactacatcctgctgagccagctggagcacgggctgctggcgcggcacgtgccgggcccagcgccggcgcgcgtggccttcgtcgggtccggcccgctcccgctgagctccctggtgctcgcggcgcgccaccttccgggcgcctccttcgacaactacgacatctgcggggaggccaacgaccgggcgcggcgcctggtgcgcggcgacggcgcgctccaggcgcgcatggcgttccgcacctcggacgtggcggacgtgacccgggagctggcgtcgtacgacgccgtgttcctggcggcgctggtgggcatggcggccgaggagaaggcccgcgtggtggcgcacctcgggaggcacatggcccccggcgccgcgctggtggtgcggagcgcgcacggcgcgcgcgggttcctgtaccccgtggtggaccccgaggagatccggcgcggcggattcgacgtgctcgccgtgcaccacccggagggggaggtgatcaactccgtgatcatcgcgcgcaagcccgttgccgtcgacgcgcacgccaccggcggggtggggcacgcgcacgcgcacgcgcacggcgccgtgctcaaccggccctgcctctgctgcgagatggaggcccgggcgcaccagaagatggaggaggtggccgtcgagcagctgccgtcctaggcaggcgcacaccggcgtcctcgctttcttgtccgtccggccgcccatttgattttcggagttgcatctatctcatctaatatggatccatccatccatccatctatagcagtattatgtatgcatccacatggtaataatctggctgaccgcatccgcatatcgtcgtctcatcgtccatctataccttgaaagctactaattaattactgagttattattactactgtttttactactactacgtacaactacctcatctagctggtgtattaattgattttgtttgttactgctgtactactgttgttgtggagatgaaccatgcatggagtggttagtcactctttagtactttcatgacgttgttttcaacggtcatatcatcatcattgttgttactgctgctgctagctcatctagctgctgtattgtctatatactgatgcatgtgtggaaacgaatcatggagcggttattgttcg

SEQ ID NO: 235 - DNA, 1584 bp, Zea mays
aaaaagcgtcgcggagccacgaccacgacccctattttggcacgcccgtcccccgcttatacgccgcgccggcgaggtcgctgctccgaatcaccttcccttcctattccctctctctctctctctctctctctctctctctctctctctctctctctctcccgcccgctccgcggcctcctcctctacccgccccacaaaccaaggccctccgctgtctgcacggcgacggcggtgcatgggcggcgggcgcgccgggacgacgacgacgacgaccgcgccgccatgaccaccaccaccacggccgcggccgcggtcgcgcagctctgcgccgggccacggcggcgcaagcaggcagcaggggctcggctcgacctgcgctgggcgcgcctgctccgcctcgccgtcgtcaccagggtgctccgcctcgcgcgcgaccagctgctcgcctgctcctcctgcgggggcggcaccgccgcccgccgccggtaccgccgcctcggcccgcccaccagcgccagcgccggtcccgtgctgtcacccgtcgacagggacgacgactgcgccgcggacgccgaggccgcggcccctcgcgacgcggccgacgacgaagacaacgttgtcagcctcaaggtcagcctgctcggcgactgccagattggcaagaccagcttcatggttaagtatgtgggagatgacggggaggagcagaacggcttgcagatgacgggcctgaatctcatggacaagacgatgcccgtcaggggagcaaggattgcctacagcatctgggatgtggcaggagaccaccagtccgtcgaccacgtcccaatcgcgtgcaaggacgccgtggcgatcctgtacatgttcgatctcacgagccgctgcacgcttaataacattgtagattggtacgggagggcgaggaaatggaataagacggctattccaatcctaatcgggacaaagtttgatgactttgctcagcttcctcttgagatgcaatgggccatcgttaaccaggccagagcatacgcaagagcgatgaaggcgaccctcttcttctcgagcgcgacgcacaacatcaacgtgaacaagatcttcaagttcatcacggccaagctcttcaacctcccgtggacggtggagcgcaacctcaccatcggcgagcccatcatagacttctgacgaccccttcctctaactagtaactcggcagcacacgcacgacgacccttggtatatatcatgggttgacagggtcgtgtctttcgatcctcttgccctgtgcgagccgccggagccatgaagtgaccgagcatgcccgtcgtcctcttcctcctggtggccggctgcagcaggcaagatgccctttgtaaatatagccataggtgacggtcccgcgtgcgtgcggccgtgcgggagcgtcgtcaaatgggaagaaaaccgcgaggtgtgactgtgatgtaacaccccgtctgtaacattcgccagagtatataggaaatccatgttaatataccctccattccaactgacaaaggcatgcgctggcgcgtggcggcttgctgccggtgcagaacc

SEQ ID NO: 236 - DNA, 1132 bp, Zea mays
tcttaatataatgatgtgcagttttcctgcgcaatcgataaaaattcacaacaatttttgctcaaatgaaaatttatttcttcttctcaaatgtatatcaaatatattctttcactttattttatacagattgcaggaaaactcaataacataataagggaacaatgtcttcgggatgttggacagctagagcaagatcttgtgtttggcgatgctggaaccaaagaactaatcaactttttgagaacacaattggttgtaagtcgtgaaaataaattacgcttgctgatgatttatgcagcacttaacccagagaagtttgaaagcgacaagggtgcaaaattaatgcagttggcaggattatctgctgatgacatgattgctgtaaataatatgcgttgcttatgtgggcctgataccaaaaagtcttcagtagggggttttacactgaaatttgatgttcacaagaagaaacacacaaatcgaaaagagcgaacaggggaagaatcaacatgggcactctctcgattttaccctattttggagcaattgattgaaaatcttagcaaaggtgagctgccaaaagatgaatataactgtatgaatgaccctagtcctactgttcatggactgccaaccagtagctctgcccgaacaagccccgctcactcaatgcgatccagacgaacaggtggcacatgggcaagacctcgtggctctgatgatggatattcaagtgattctgtgttgaagcatgcctccagtgacttcaggaaacttggtcagcgtatatttgtttttgtaataggcggtgctactcgatcagagttacgtgctgcacacaagctttcatccaagctgaagcgagacatcatccttggttcatctagccttgatgatcctccccagttcatcacaaaattaaagttgatgtcagtagaagaattgacacttgatgaccttcagctgtaaatggtgtccgcccacacggagtgtaaccttttattttctctgttctgtcagctcttatttgtgggggcctgtcatattcattcggtgaaatgcattcttaataccacttttactggtgaatgtaagaaaaaaactgttatgcaattaatcttttcatgca

SEQ ID NO: 237 - DNA, 1175 bp, Zea mays
gttgcgacgcggagcgagtggtggcctggacgcctggtgtgcgctattttcccccgcgcgcgcgtcccaactccaggagctctcgatggtgcccgcggccgcggctgtcgcagcggcgagcccggcagcgctccctcgttcaacgtccccaaggggcagacgtcccagggcccgtgcctgctcgtttcggtgcgctgggccgagcgcacgctcctcagcacttgtgtcctcctataagtcgggttccgccggccatggccatccccggattcggcagctgcgcggacggccggactgcagccggcaggcggaagtgatgggcagcaccgtcgacgacgacgaggcgtgcgagctggtgagcggctcggacctcgtcatcggcgagggagacgacagcgtcagcgcgtaccttttcaaggccgtcaagaacaacaatggcaccggcatcctcctgctctccgacatcttcggcttccaggactccgccacgcgggacttcgcctaccgcgtcgcctgcaatggctacaatgtcctagttccggacttgttccgtgggaacccgtggaagctgaacgtcccgttcgacggcgacagcttcgagcggtggcgggcggggcaggccccgggccgggtgtccggcgacatcgacgcgtgcacgaggtggctggtggacgagttcaaggccgcgggggtgtccaagaagctgggcgtgatcgggttctgctacggcggcgggcgcctcgtggagacgctggcgcgcgacgccgagagctgcttcagcgcgggggtctgcttctacgggtcccggatggacgcgtccctgggcgaccgcgtcgcggcgcccgtcctgttcgtgtgcggcgacggcgacccgctgtgccccgtggagacggtgcgggagctggaggggcgcgcgagaggcgcccgggcggcggtgtacgccggcaggggccacgggttcgcgcaccggccgcagtcggtggaggaggacggcgacgccgaggacgcgttcaacgcgatgcgggggtggctgcacgaccacctgctcgcctgatcggacgatcagacgctgtacacgggtttgggtgttttgtacatacgtactaatatgttatttgaccaagtctcctggtcatcctataataaagagcaaaatccaccattaaaaaaataaa

SEQ ID NO: 238 - DNA, 2696 bp, Sorghum bicolor
atccaaatggtgcttctgtcaactgtcaggtgggacggggggacgggggcgtggtgacgtcggaagctgccgtgcggccgcagtgtcgtttcccgcaacgcaacgaccagcggcagcgtggcgatccgcccccaccgctcttccctccgctccgccctcgcactatttctagcaccgccggagccgggctggacacttctcatctcccatctcctctgcttcccagtccccgcccgccgtgagagcccgccactgctgcatctcaagggtcagaggttgtaccgatcatcgctgtggccttcgccgccggccgccggcgcatcaaccaccgcgccggcacgggcgcatgcaggtgacattccgctctccggctctctccgccggacgtgggtgctcccccggaacaaaacgcctacctactctctcggcaacgtttctggaagttcgttgaggcatcaaagaattgcctgccctgcgccgtgcgcgtgtgccgtatgaactgcttctccggcctgctcagcggcaagaggaaggcatccaagggtaagaacaagggcgcttacgtcaagaagggtagtggcaatgattgtcccaaggtgaagccggtggagttcatggacatggcggacactgttgtcgacgacgtcgtcagcagaggcggagacagcagcgttcctgcgtctgcatgcaacagtaggtttgtcgttcacgcagccgcccagctgccacgccatgccagtggcgagaatggcgacaaggccgcagctaagaaggagtcgtccgccgccgacgacgacctcgtcgccggcgttggctcctccggtcacagcagctacggaactggcaacagcgatgccaagagcaccgagccggacgacggcgagcgctccagccttggccgcatgtcgccaacggcatcgccgaagctgatgcgctcctgctccaacatcgagacgacgaggtctgtcgtcccggcagggtccgacctgccggcgaagtcgcgctcctacaacgacctgaagatcctgcctcccggaaggtcgaccgccgcccgcagcggcgcgatcgacgcgagcccgacggcgtccttcaggacctcgtgctccgccgaccgcgtcatgctgaagaagcggtcgtcgaggcaggtgctcccgtccaggagccggaagctgtggtggcagatgttcctctggagccaccgcaacctgcaccggccgggcgcgagcgcgaccatgcccacgctgctgccgccatcgccggggcaagaagaagaagaagaagaaggcggtgccgcgcaccagcacgacgggtacacgtccgacacgctgggcgcggtcaccgcggacgccaagaacaaaggcgtcgccatcgaggcggaccccattacgagccagtgggtcgcgttctccgccgaggcctcgccgctggaccgggtcagcgcgtgggtgaacagcctcggggacggctcgttccacgccgtcgacgaggacgatgccacggggcacggcagcggcggcgaaggcgccgctcgcccgcgacggcagcggtgctccgagatcgtggagctgtcgacggcgacggccggcggcaagaggaacccggaggcgaagcggcgcgcggcggacgaggctgcccaggcgagcggcatcgtgcagacgctcaacaccttctcctccgtcgcccacatcgccggcatggggctcaagaccgtcccgacgattgcggctttctcgaccctccgtgccgtcaatctgtctggaaacacgattgttgaaatcagcgctggatcgttgcccaaaggcctgcattcgctggatctgtcgaggaacaagattgcaatcatcgaggggctgcgggagctgacgaggctgcgggtgctcaacctcagctacaaccggatctcacggatcgggcatggcctgtcgagctgcacggcgatcagggagctgtacctggccgggaacaagatcagcgacgtggaggggcttcaccggctgctgaagctggccgtcctggacgtgagcttcaacaagatcaccacggccaagtccctgggccagctcgtggccaactacggctcgctgcgggcgatcaacctgctgggcaacccggtgcaggccaacaccggcgacgacacgctccgcaaggccgtgtcgggcctgctcccgcggatcgagtacctcaacaagcaggccgtcaagccgcagcgcgcgcgggaggtggccaaggacagcgtcgcgcaggcggcgctcgggaacgccggctggaactcgcggaggcggctcacgcggcgcctcagccagagccccgggtcggcggggaagggcggccggggcagggacggcaacggcaacggcagccgcaggggcagcaggagcaggtccatgaccaggccccagagctcgagcttgccaaggagatgagaggcaaaacgtgcgacgtacgtactgataaaaaaaaatggtcttcggcttgaagagggagaagaaacaactctatgcgtttaaactgcatgcaatgcaatgttgtgatgagcttgagtttgacgcattttcccgaaccttttttgacagcacaatctgttgccagttagcgatgtctgtagcttctagtagtactaccgtccaaggaggacgtctcaaatggaaaaactgtttagtggctaccatttgattgcttgatcttgtttgttttct

SEQ ID NO: 239 - DNA, 760 bp, Sorghum bicolor
gcaatgtcgtggctcctggtcgtcgcggtgcttgccggcttcgcgcttggtccgtccgcgggcacggaccacatcgtgggcgccaaccatgggtggaaccccaacatcaactactccctctggtccggcaaccagaccttctacgtcggagacctcatctcgttccggtaccagaaggggacgcacaacgtgttcgaggtgaacgagacggggtacgacaactgcaccatggccggggtcgccggcaactggacctccggcaaggacttcatcccgctccccgaggcccgccgctactacttcatctgcggcaacggcttctgcctgcaaggcatgaaggtcgccatcaccgtccacccgctcccgcacaacgccacctccaagggctccagcacccgtgggggcaccggcgcacaggaagaggccgccgcggcggcgcttggggccaggagcgccgcgtggctggcgacgctcgcagtcgccgcagtgtctgctatctgctaggagctttattccaagcattctctgagcattgttctactgtagtattttgtggtttgcttttgtcgccatgtcatttgtgttttttaactcctctgcaagtaaatctgcttgagaagccaagctaactttctgacaactcatcaatgcatttcacaaaaccccagtttatgaaccaacatgccatgtattacaggttgcgacggctctgaacactagaaagaaggaaggaacaaaccctataagagattgtcgaata

SEQ ID NO: 240 - DNA, 1647 bp, Sorghum bicolor
gctccgcctccactcccgagctcgtcactccggcaaccgagcagaagcaggccggtggttccggtgacctcccgatggcgtctctcgctgccgtcaagaaggtgctggtgctggtgccgatcacggcgggctcggagcccgtggaggcgttcgtccccatcgccgtcctccgccgcgcgggcgccgacgtcaccgtcgcggccgcgggtgccggagccggcctgcgcgtccacgccatgtacggggtcaccgtcgtcgcggacgccaacgtcgccgactgcgccgacgcctcctacgacctcgtcgccctccccggaggcgtccccggcgcggacaacctcggcggctgcgcggcgctggagagcatcgtgaggcgccaggcgctcgggggcggcctgtacgccgccatctgcgccgcgccgccgctggcgctggcgcgctggggcctgctcgacggcgtcaaggcaactgcgcatccggcgttcgtggacaagttcccggcggaggtggccgccgtggacgcgaacgtggtggtcgacggcagggtagtgacggggcgtggcccggcgccggccatggagttcgcgctcgctctcgtggaacagctctacggcaaggacaaggttgacgagattgccaaaccaatgatggtcagatatgaacccgggtacgccttcaaggaactgaacccggtccagtggcagtgcagcggcacgcccaaggtcctgatcccggtggccaacgggagcgacgagatggaggtgctcgtgaccgtcgacgtgctgcgccgggccaatgcggacgtcgtggtggcgtcggccgagggcggcgacgccgaggtcgtcgtcgtcgcgcgccacggcacgaggatcgtcgccgacgcgctgctggtcgacgccgtcgccgccggccagcagttcgacttcgtcgtcgtgccgggcggcatggccggcgccaagacgctggccggcacggaggcgctcgtggcgctgctgaaggagcatgcggcggcgggcagggcgtacggcgccatcggcgccgccacggcggaggtgctggagccgcacggcctcctcgagctcgagggcaagaaggcgacgacgacgtgcgcgtccatggcggactcccgcgagtgcgggagcagggtggtggtggacgggaacctggccacgagcagcggccccgggacggccatggagttcgcgctggccgtcgtggagaagctgctcggcgccgaggcggcaagggaggtggcggaagccctgctgttcgtctgacgacggaccacgggcggagatgagctgtgcctgtgctatttgatcctttgcagtagagatcatggaacgtggccggaccttccttgtcataacatcatctgagaatttggtatctcgatcgtgtagtgtagtaaaaattctatacaagtatcgttacttatatagagaggtgggacttgggttaagccataccgcctcaggatggtcctcttgtgatttttgccgctctttggaccatgatatctaggcacgtaagacgtgtcaaggtgtcgttgtggtgctacgtttttttcaatagcccaagcacagctcatggtacccaaaaaaaagtctttatatcgtatcattaattttttagttttctttgttc

SEQ ID NO: 241 - DNA, 437 bp, Sorghum bicolor
gaaggatgcaggcggtgggcatccggcgtggtctgaccatcgacccggcgggggaggaggagcccgcggcggcgcgcgtggggcggctggtccgggagagccccgtggtgatcttcgctcgccccggctgctgcatggcgcacgtgatgaagcgactgctgcaggcggtgggcgcgcacgccaccgtcatcgagctggacgccggcgccgccgaggaggaggagctcgcggcgggggccgagggcgcaggcgtcccggcgctcttcgtcggcggcgaccccgtcggcgggctcgagggcctcatggcgctccacctcagcggacgcctcgagcccaggctcagggagctcggcgcgctctgcgcctagctgtccgcttgcttctccgccgtcgatccatgtgtccggtcagcgtgcccgcggccgggcgccccgggc

SEQ ID NO: 242 - DNA, 1716 bp, Sorghum bicolor
gctccgacacatcatagacagatagcagaacacacgcgccgtgcacgcttgcgcaaacccaaggattgccgctctgttcttggtctcctcctcgggtgaccgcaggggcaatggcgattaacggggaggaggcgccgcctctgctactggacgaggccgcgcgcccgcgccgcgtcgcgctcttcgtcgagccgtctccgttcgcttacatctctgggtataagaaccggttccagaacttcattaaacatttgcgagaaatgggggacgaggtcattgttgtgaccaaccatgaaggagttccccaagagtttcatggtgccaaggttattggttcatggagcttcccatgccccatgtatggaaaagtacctctttcgctggcactcagtcctaggatcatttcagaggttgcaaagttcaaacctgacattattcatgcatcttctcctggaattatggtttttggtgctctagctattgccaagctactcggtgtccccctagtcatgtcctatcacacccatgttccagtatacataccaagatatacatttagctggcttgtagagccaatgtggcaagtcataagattccttcatagagctgctgatttaactttagttccatctgttgctatcagcaaagattttgaaactgcccaggtcatatcagctaacagaatacgcctttggaacaaaggtgttgattctgcaagcttccatcctagatttcgcaatcatgagatgcgagtcaggctaagtgacggcgagcctgaaaaaccactagtaattcatgtcggacgttttgggcgtgagaaaaatctggattttttgaagatggtaatggataggttgcctggtgtaagaattgcatttatcggagatggaccatacaggtgtgaactagagaagatgtttgaaggaatgccagcagtgttcacaggaatgatgcagggtgaggagctctcgcaggcatacgccagtggtgacgttttcatcatgccatcagagtcagaaacgcttggccaagtggtcctagagtccatgtcatcaggagtgcccgttgtcgcggcccgtgccggcgggatccctgacataatcccagaggaccaggagggcaagacgagcttcctgttcacccctggcgacctggacgactgcctcagcaaggtccagcagctgctgacgaacagggagttcagagacaacatggggcggactgccagatccgagatggagaagtgcgactggcaggcagcatcgaagacgatccgcaacgagttctacaacgccgcgatctggtactggcgaaagaagcgtgcggagctggtgaagccgctgcagtggctagcacagatgttcctgccggcgcctgaggtccgcagcatcaagcagtgctgaggcctctctccacttgtgggacgatggtgttgcttgcagccatgatccagacaagtgatggatggatggaaagcaagacatgcatatgcactccttgtaaattcctggtgtatagtgctgtgtcgataggtgagatagttccccgtttttttatggaaattggaattgggttgtgattgttgtggcaattccatcgattacatgtgtgttgtgtagcaaatcagaattggaatgtgctatatatcttgatggaaattgtaacctgtaaatcatgattaggccattaattaaatgcatgagtatgcttttgtgc

SEQ ID NO: 243 - DNA, 1212 bp, Sorghum bicolor
gagctgccaaaaacgggggccaagacagatggtgcttctgcgcgtctgccaccgcttcggccgccccccgcgcttcccctccttcctctccatggcggcgccccagcaacctggtaaaaccctgccgcgcccctgtccttcgcctcccctctccgggtcggcgcccaagaggttcagggcgatggccacagacgtcgcggcggcggcggtggatcctccagccgccaggggctgccccgctatgaaggcggagttcgccaagcacgccgagtacctcaacgccctgaatgacaagagagaaaggcttgtgaaagctagtcgggatgtgacaatgaacagcaaaaaggtcatctttcaggtccacagaatcacgaaagttaacagggacgaagttctctccaaggcagaaaatgatcttgctgcagtggttaatcaatacattgcaaaactagtaaaagaattacaaggaactgacttctggaagctcagaagagcctacacctttggtgtacaagaatatgtcgaagctgcaacactgtgtagattttgcaagactggcactctattaagtcttgctgaaattaatgattctttactagcactaagtgataaatctgttgagcccttacagttaaatgtgcttgactatcttttaggggttgctgatttgtcaggagagcttatgaggctcgcaataggccgtatatctgatggggaagttgaatatgcaaaaactatctgtgcttttgtacgtgatatttacagggagctgactcttgtggtacctctaatggatgacaataatgagatgaagaagaaaatggaggtcatgctgcaaagtgtagtaaaaattgagaatgcttgcttcagtgttcatgtgagaggttcagagtacattcctctgctaggatcatcaggagacccagattattcctttttcggtgcctcagactttgaccaatgaatgttttgaagcaagaagaactaattgagtgttaaaggagcttagatcgatttaaggagagtggttgcgttaggtgtttgatttttattgccagtttatgttgcacatcttggagtctgtaaatcttgccctaaggtggtaacctgggagaataatgttgcaagactaccctttttatggtgcagcctgtttgatctgtgctaataacagtgttcgtaatagctgaaagatttgtctatgtgttggca

SEQ ID NO: 244 - DNA, 1207 bp, Sorghum bicolor
ctcgactcgacgtgtccatcctctcactcgcccctagaagccatcacgaattggccacctccgatgtgaggcaacctcaaggagaaggaagctcatcaatctcgccgctggcctcctcacctctgcttttgcgtcgctgcgttatcgtctctgcatccgagtgtcgctatcttcctggtgcctggtgctgcctgtgttcacgagctggaacttgtccgagcttcagccaagtcaagctcgagcctgtctagccaagcagaacggcacggtggtgctggtcgacgcctcctctgaggaacacgtgccggtcgacgcttcctcttggcggacggtctcgagtttggtcgggaggatgggtggcgggagctgctgcgtctgcaaggaggcgccgcccaagtacaagtgcccctcctgccgcacgccctattgctctgtcacatgctttaaaaagcacaaagaggaatcttgccaaaagacatcgcctcaggaagaaattagcaagtcaccactgcaggaggaagttacactgaacaccacatgcattgcagaatctccaaatacagtgggccctacaaaagctcttgaagttgaggacccaagctgggttgttgacaacaatagactaaggtctttagcggaactgaaagggatccaagatgctctcagggatcctgaactgcagaaaatgatacttaaaattgatgggtctttggaaccagaaaaagaattggagaaattgatggaaggtcaagcttttggccagttcgctgataagattcttgacattgtcagcccacaagaataatcgcctgccctgcctgtttggtgggattgatgctggagtaaatagaagcatccaggcaaacaagcgaaagtggacgagctgatctctggttttcctttttccaggatggggtagactttagaacacatcttgagtcgcctgtttttccatgacgggggtagactttggaacacatattgtgtcgcctggtgaaaggaaattgctgtagctgaaaaatctctcttgccaaagatagatatttcttctgtggttgcattatgcgtttcacttcagagtgtcgataatcctagctgtattttagtgcagtagacagcgactctacattgactactgaatcttgagaagatgacgcttcttccattgaccaatatagcggccatatttccgcaacatgcttctgac

SEQ ID NO: 245 - DNA, 758 bp, Sorghum bicolor
aaagaaatattgtgatccctgaccacggaacaacacccctgatcgacaacccattccacatatactcagcgcccacacttagcgctagtagctaggcgctataccaaccatgagcgacctgttaacctacatttccaaggttatgtgcatcaaggcaagatcggaggcaacacaggccggcgatgacggcggttgcccagcggatgagtgccgcgtctgcctgtcaaagattcggctcgccgaggctacccggcgtctgccatgtcggcatgttttccaccgggactgcgtcgaccgatggctcttgtcctgcaagcggacctgtccgctctgccgagtttatgtgaccgatgggaacaagcagccggtggcggcgaagcacaccagccgtgaagcacaggcactcgccgacgacctggtgatctggttctccaccgtgctcgtccccggtttctgatgccaaatcccctcttttgttcgctcgatcgaatgcttggtgtgtattcttttatatatttcaacacatgtacgtacctatgttatacttatcgatctttagaacagtttttagaaaatgtgtgtattgtagcatcttgttggatgaattttattcgaacttttgcacttggagctgattactgcaaataagaagtccgagaaaatgttgtcggcatttattgtactatatatggtgttgtttgtgtgtacaaatgttagcataaatgtagtttgttgcacgagtgttcactgattcgaaa

SEQ ID NO: 246 - DNA, 2757 bp, Sorghum bicolor
cggtgatggtggcgaggatgatgcggtggcctcggcccccgccggcgcgaaacttccgcgtccgcctggtggtgcggcgggcggaagggctgcctccgccgccttcgcccctctcgcctgaggggtctcccgaggccgaggcgaaggtgtttgtagaggtgagctggaagggccccaagatgtcgccgctcacctcgctgcggcggtcccagcggccgcccaggaaccagacgcggaaggaggcgctgccggccgtcgccacggccgacctcgaggatggcgccgccgccgctcctgctccggcggcggtgtcggcggtggcctgggaggaggagttcgagagggatgcggcgctcacggcgacgtcgcaccgtgaccccgctgtgttccatccctgggacgtcgccttctccgttgtcagcgaatcaaataaaatgtcaaagagcaaacttgttctggggactgcttcactgaacctagcagattatgcatctgccgctgaagaggaaatcgagataatcctaccattgtctgtgcctagtagtgcaatggacctggccccatcactccatcttactttaagcctggtggaactaaggatatctcaacaatcgcctggtgcttcacagcgttctgttattgccccattgtcaccttcctctggtgactctgttccttctggaaaagatgaggtttctgtcattaaggtggggctgagaaatctgaaaatcctaagagatctagtatctacacggaggttcaaaaagactaaccaagattatgacggcagtgaggagaagtattatgttcacagtgatggtgcagaattttcttgtgatactgactctcttgatgatgacctggatgatagagagcaggatgatgagtttgggggttcagcagtcaggaagtccttcagctatggctcactgcagactatgaatgtcggtgccctactttatgcacctaggattgatggagatgacgagggttgggtacattacagccaccgaaattctgatgtcagttatcatgttgagcaagtgccatcctccacagctgaggagcatgcttccatcccattgcggcggaagaggagcctacttccagctcgatggagaaagacaaaattaccaaaggctaaaggggagcctcttttgaagccatatggagaagagggtggtgatgatattgactatgatcggcggctgttgaccccttctgatggatctgtttcagagggatcaaatggctctggtaatagtatggtgtcggtatttggtgatgatgattttgttgtggggaactgggagtcgaaggaagtatttagccgagatggccacctgaagctttctacacaggtgttctttgcatcaatagaccagagaagtgaacgggctgcaggggagagtgcttgcacagcactggtggctgttgttgcagactggttccaagcaaaccaagacctgatgccaatcaggtcacagtttgacaacctgatccgagaaggctctttagaatggaggaaactttgtgagaatgagacctacagagaacgctttcctgataagcactttgatcttgaaaccgtccttcatgcaaagatccgcccactcacagttgcacccagcaagtcgttcattgggttcttccatcctgaaggtactgaggatgtatctggatttgacttccttgatggcgcaatgtcattcgataacatctgggatgagataagccgagcagcagagtgctcctctggaaaacctaccatatacattgtcagttggaatgaccacttttttgtcctcaaggttgatgttgatgcttattacatcattgatacacttggtgagaggctgtctgaaggttgcaatcaggcatacatattgaagtttgatgacaccaccaccattcacaaagtgcctgctgaaaagaaggaatcaaatcctgataccgatggacgccacaacaaggattcctcagagatctgctcagctgagcaggacagtggaacggacactgaagagtgtgagcttgtgttgaagggtaaggatgcatgcaaggagtacatcaagagcttcttggccgctatcccaatccgggagctgcaggctgacatcaagaaaggtctcatggcatcaactcccctgcaccaccgcctccagatcgagttccattacacggaatcttgccctgccgagatcagcgtgcctgctccactgtccccattcgaagccccttttgagttctgttggcctgagccaccatcacccccacctgccactgaattcgctgtaacctatcctcctgccatggaggtcgccataacccaggccgttgccgttatatagctgaccttggttgctgctgtgactagggcagtggctgcgtagtttataacatatagagagctgcgcttttcagagcgaattgtgaagtggaccagatcgaagatttggcttcgtttctagtttgctcgtttgctgtccaaagtccaactaagatgaactgactagtatagcttaactgtcttttggtctgcgtgtgtgtgtttgttttgttcacttcttccaggcttttggggagcttccattttgtaaagaaagaaaggatgtttgctcctgcacatctttacctgtgaagtgagtttgctggacttgtaatcctggctacattatcattatgttaattatgtcctgttctctgatactagatgcgtatcctggtgatgttctctcaagaaatttacaatttgag

SEQ ID NO: 247 - DNA, 1417 bp, Sorghum bicolor
tcccatacgaattcttgtctgaaaaaacaaaaaatctctcctttcagctgatcggcatgccgcagggagcagcagcaacagccgtggacagcaacggcaaggacggcggcggcggcgccaaccccactagcacggcccggccagcggcggcgctgcccctgaagctcctccgccctctcctcctcttggcggtgctgggcacggggttcctcgccgtcgtggtcctgttcctcggcggcccgacctactcggccatgctcccgcggctgtccctcgccccggacgccgtgctgcctgcgccagcgtcggcggggaaggcgccgctggaccggtggaagcgggcgcccgcgtccgcctggcacaacatgaccgacgaggagctgctgtgggcggcgtcgtggcggcccagcgtccggcggtacccgtaccgccgcacgcccaaggtggccttcatgttcctcacccgtggcccgctgccgctcgcgcccctctgggacaggttcttcgccggcgccggggacgccgccctcttctccgtctacgtgcacgccacgccgggttaccgccacgacttcccgccggcgtccgccttccaccgccgcttcgtgcccagccaggtggctgagtggggcaaggcgagcatgttggacgcggagcggcggctgctagcgaacgcgttgctagacccggcgaacgagctcttcgtgctgctctccgagtcgtgcattccactctacggcttcccggcggtgtacagctacctgacgcggtcgagggcgagcttcgtcggcgcgttcgacgaccctgggccggcaggccgtgggcggtaccgggctgggctggcgccggaggtgcggcgggagcagttccggaagggcgcgcagtggttcgagctggaccgggaactcgccgtcgacgtggtcgccgacgagcggtactaccccaagttccgggagcactgccgcccgccgtgctacgtggacgagcactacctgccgacggcgctctccatcgaggcgcccgcgcggatcgccaaccgcagcgtcacgtgggtcgactggtcccgcggcggcgcgcacccggccacgttcgccgggaaagacgtcgacgaggcgttcctgaaacggctcacggcggcgcccgcgaagcagaactgtacctacaatggccagccgtcggaggtgtgcttcctgttcgctaggaagttcgcgcccagcacgctgcggccgctgctcaggctcgcgcccaagctgctaggatatggctgactgtcactgtcactgtcactgctctgctctgaatctgaatctgaattttctcacagggaaccatactctgctttaacaactttctactagtatgactaaacagatgtggttgattggtataaaaagctgctctagaccccatgatcgtc

SEQ ID NO: 248 - DNA, 894 bp, Sorghum bicolor
atctacttatcgcacaacaagccaacgcaggacaggagagctagcttggccgcgcgagagatggagaagcaggcggcggcacaggcgcaggcgcaggagcaggagcaggagcagtggcagggcgcggtggaggcgactctgccgtcgacgccagcgtccgcggcgtggccgcacatcgccagcttctgcgcgctgcaccggtacctcgcgagcatcgacgtgtgcgagctcgcggaaggggaggacggccggcccgggtgcgtccgctacgtggcctccctggcgccgggcaccaccacgggggagatcggcatctgggcgacggagaagctgctggagatcgaccacgacgcccggcggctcgcgtacgccgtcgtcggcagcagcttggggttcggcagatacgtcgctactatgagcatcgtcgctgctgacgacgaggacgacgcggggtgcaggctggtgtgggcgttcgagtgcgaccccgtgcaggggtggagccgggatgggatgctcgcctacctcgacgccggcgtcaagggcatcgccgcgcggatcgaggaagcccatgccgccgccgccagcgccagtgccggaggagacggcggcgtcgctgcttgacaactccatctgcgggcgggtggaatctcaacagtcgccagatgcatttctatattgaattgttattacgtcgtcaaactaattaatgcattgttaattgctactagcttgcttgtttgtctctccttcattgtctaccggccggatttgtatgtatatgtatgtcgcgtcgcgtcagagtgtcagctgaatgcatgtacgaattaacgtgaaagggactgtgcttgttggctcatgcttgtttttattctggcgatgtccatgtcgatgcat

SEQ ID NO: 249 - DNA, 1179 bp, Sorghum bicolor
ggaggagacagagagatggacccggagaagcagcgccagcacgacggcgacggcgacggcgatggcgccgccgcggcggaggcggacatcgagcggctccccgtcgacctcctcgcgcacatcctctccctcctgtcttccttccgcgacctgtccatggctgggggagcgagccggaggtggcgctgtgccgtggagcgggcactggcgtcgcggcggcggctgagcttcgcgggccagcgcaccggcaacgacaccgccgcgcgcctcatccgcgccgccgtcaacctccgcgacctcgacatttcacgaagctgctggggctgccatattaccgacgaaggcttgatcaagatttcctccgcggattgcgtcggcaatctgacctccatatcgctctggggattggccggcatcaccgacaagggcgtcgttcatctggtttcaagggcttattctttgcagcacctgaacattggtgggacattcatcacagatgaatccctgtatgcggttgcaaacagctgcacaaatctgaagagcatcatcctgtggagctgccgccacgtgacggaggccgggctggtggcgctggtgaacaagtgccggcggctggagtgcatcaacgtcggcgggatgcgggtgccgccggagagcttcgtgggcctcctctccatcagccccgccctccagatcaggtccatccaccgcatcctcaacgccggcgtcggcgtgcaggtctcttgatcggatgatccatgcatgcattatccatggatgataaggatcatatgtgtcagtcagttacagtatcaagccataaacccacatttgttgccactgtgtttttcatggaaaaagaattgtcagaagggattcatcaaattatggatcaacatatacgtgtgtgtgtgtgttcctgttgtcttattgttgttgtaaagaaaaaaaggatacattgtcttgattctatcttttgtacatgtatacatgtaaataaattgtaccgatacttttcatctaaaaaaattgtaccgtcactgcaccactggaagtgctaggaactataggaagtgcgtgtgagttgtgtgtctgtgttgtgacactcatatatatcagcatcatatacttgttaaggttcagttacactgcaactgcaaacatatctcagattctaga

SEQ ID NO: 250 - DNA, 903 bp, Sorghum bicolor
tgagagatggggaggcagccgtgctgcgacaaggtgggcatgaagaagggcccgtggacggcggaggaggaccagaagctcgtcggcttcctcctcacccacggccactgctgctggcgcgtcgtccccaagctcgcagggctgctgaggtgcgggaagagctgcaggctgcggtggaccaactacctgaggcccgacctcaagcggggcctcctctccgacgacgaggagcggctcgtcatcgacctgcacgcgcagctcgggaacaggtggtccaagatcgcggcgcagctaccggggaggacggacaacgagatcaagaaccactggaacacacacatccgcaagaagctgctccggatggggatcgaccccgtcacccacctcccattgcaggagccgcccgctcctcctcctcctcctcctcctcctccggagcaggagccggacgaccaggaagaagaaccgcagcagcaagagcagcaggccgggaagctcatgcaggagggcggcgcgggggaagacgacgtcgcgccgatggtccagccgcacgagaccatcatggcgccgccaccaccgcccacgacggcggcaagcaactgcggctctgctgctgtttcctctgcctccgccgggtccgcgtccgtggtctcgccgtcctgttcctcctcctcggcctcagcccccgcggtgaccggcgtggaggcgacggagtggccggagcccgtgtacctgttcggcatggatggcatcatggacgccggctgggccggcctcttccccagcactggcgctggcgctggcggctgcttcggcttgggcggcgtcgatccgttcgaccagtaccccggcgtcggcgtcggcggcgccggcttcgatcaagatgacggccactggatgtga

SEQ ID NO: 251 - DNA, 2747 bp, Sorghum bicolor
aaaggcgcttttacccctgcgggcagcgcgcagtagtagtagcgaagcactggttgttggtaggtgcacgcaccccgccccctccccctcctcctgccgtcctcgatctcgtctcctcctcctccccaccctatccctcccggcgggcgggggaggaagcgagcgacgatggcggcgctggaggcggcgaggtcgtgggcgggctccgtcatcccgccggagctcgccgccgccgcgggcggagacccgctcgccgcgctggcggccaccgccgcggccctcgtcgcggggctgcttatcctcgccgtctggttccgatccggaggcggcgcgccgtccaagccggtcgccgcgccggtacgcccgccgccggtcaaggtggacgccgacgccgacgtggacgacggccggaagcgcgtcaccatcttcttcggcacgcagaccggcaccgccgagggattcgccaagtccatggcggaggaagcgagggcgcggtacgagaaggccgtgttcaaagtggtggatctggatgactatgctcaggaggacgaggaatacgaggagaagctgaagaaggaaaccgtggtgctgttcttcttagcaacatatggggacggagagccaactgataacgcagcaagattctacaaatggtttactgagggaaaagagaaggaagtttggctgaaggctcttaaatatggtatttttggccttggaaacaggcagtacgaacattttaataaggttgcaaaggtggttgatgagctactagaggagcagggtgggaaacgtcttgttcctgttggccttggagatgatgatcagtgtattgaggatgatttcactgcatggaaagaactagtgtggccagagttagatcaattgctccgcgacgaggatgacacaactggcgcatcgactccatatactgctgctattcctgaatacagagttgttttcattgataaatctgacctgtcattccaagatagatcatggacactagccaacggtactggtgtgattgatattcaacacccttgcagggctaatgttgctgttcggaaggagctgcacaaaccagcttcagatcgctcttgtatccatcttgagttcgacatttctggcactggtcttgtgtatgaaaccggagatcatgttggtgtatatgcagaaaattctgttgagactgtggaggaggctgaaaggctacttgacctttctccagatacgttcttctccatccatgcagatgcagaagatggatctcctcgtaaaggaggaggttccttggccccacctttcccatctccatgtaccttgcggactgcgcttctacgatacgctgatctactcaatccaccgaagaaggctgctttgcttgctttagcttctcatgcatctgatccagctgaagctgaacgacttagattcttggcttctcccgctggaaaggatgagtactctcaatggataactgctagtcagaggagccttattgaagttatggctgcattcccttcagctaagccaccactgggagtgttttttgcagcaatagctcctcgtctgcaaccacgatactactcaatttcatcatctccaatgatggctccctccagaattcatgtaacatgtgcattagtttatgggccttcaccaacaggaaggatccaccaaggagtttgttcaacatggatgaagaatacaattcctctggaatatagtgaagaaagcagctgggctcccatctttgtgaggcagtcaaatttcaaattacctgctgacccatccactccgattatcatgattggtcctgggacaggactggccccttttagaggcttcttgcaggaaaggttagcactgaaacaatctggaacagaactgggcacttcaatccttttctttggatgcaggaaccgtaatatggactacatatatgaagatgagttgcaaactttccttgaggagggggctctttctgagctaattattgcattctctcgggaagggccaacgaaagaatatgtgcagcataagatggtagagaaggccacagaaatttggaacatcatctcacatggtggttacttatatgtatgcggtgatgccaagggaatggctagagacgtacacagaatgcttcatacaatagtccaagagcagggatctttggatagctccaaaaccgagagctatgtaaagagcctgcagatggaaggcaggtacctccgtgatgtatggtgacacatcacccccaatcagccatagcttctagcgtgtggaattaaagctggctttgcgtgtatatgccaatccagtcgtcagctttggaaatgaagcgtgccattgattatatactgaaatgagttgatcagtgtaattctttgacatctaactatttattattatatgagatgggaggaactgagggagagaataagtgctgttgtagatttgtagaacttaaaaatttatgtatccctgacaagtttgtagccaaggggatacatcatacagtttgagatgaggacattatgtatactgtttgagacgaggacattatgtatactaagtactttagaaggccacctaaaacaaattttgcatctgtttttttaaaggcttgtgtttgtcatgctatccaagcttgttcgcttgtttgaaaagccgtgactgaagtactattatcgctgatttattatgagagaacaatattgatggctgatagaaaaagtatg

SEQ ID NO: 252 - DNA, 2221 bp, Solanum lycopersicum
cacattattcaaacaacatggcactcaccacaacatttttctctctctttctcctaatcatcaccgtcgccggacaaacaactccgatggctgaagctccggcaccggcagccgacgactgtaacggtatattcttgcagtatgtgtttaattccggatctaaaatcaaacccactttgaaaactcgtcaaccctacaagtttcagtctattctcagtataactaacaacggacttgaggaacttaagttatggagggtttttgttgggtttcaacatgatgagattttggtttctgcttctaacgctctgcttgctgatggggaatcatttcctgctttagttggtaatggtactgtttttgctggatttccggctgccgatcttaagacagctgtggaaactgctggagatactacacagacgagtgttcaaatcaaaattgtgggtacccagtttggagttggctctcctaatgtacctatgccctccaatatctctttggaaaatgatgggtttatttgccctaaaccctctatgcaaggaaagagtgttatgcaagtatgctgtattaaagacgaaaatttcaagacaaatttgacgttgggtgagaaatttagtccacgccaagatggggatcttacaattatgtatgatatcctaagaacatatgattcaaattactgggctcaggttaccattgcaaaccataatccccttggtcgccttgataactggaaactaagttgggactggatgaaggatgagtttatttgggaaatgaaaggcgcatatccctctgttgttgatacttctgagtgtgtttttgggccacaggcaaaattttatcaaaaccttgacttttccactggtttgaactgtcagagaaggccgacactaattgatctgccgctggagaagaccaatgatacaaagttgggaatgatacctttttgttgtcggaatgggacaatcttgccacctgctatggacccaagcaagtctgtttcagcattccagatgaatgtctttaaaatgcctccagatcttaatcgatcctcattcactcctccacagaattggaagatcgaaggcagactgaatccagattacaagtgtggacctccagtccgtgtaagccccacccaagtccctgatcctagtggattgttacctgctacatcagtatttgctagctggcaagttgtatgcaacatcacccaaccaaaaggagctagccccagatgctgtgtttctttctctgctttctacaatgaatctatcattccttgtccaacatgcgcctgtggttgtccttccaatactgctcgtacatgtagcacgaaagccccagctcttctcctcccatctcaggctcttctggttccatttgacaatagaaccaagatgtcccttgcctgggctgaaattaatcatcttccagtttcaaacccattgccatgtggagataactgtggtgtaagcatcaactggcatttgttcacagactataggggtggatggtctgccaggatcaccatcttcaactgggaggatgctgcttttgctgattggttcactgcggtggaattggacaaagcagcggctggttttgacgcagtgtattcattcaatggaactatgttagatggggttaataataccatattcatgcagggccttccaggcttgaactatatagtagcagaagcagatggagctaatccagcgaaagatccccgagtacctgggaaacaacaatcagtaatctcattcacaaagaagaatatcccaaacatcaacgttgctgctggtgatgggtttccaacaaaattatacttcaatggagaagagtgctcattgccaaagctactcccaacaagcagttcatctagaatatcttcattcactgtcactacttccattcttgcagcagttgtggtttttatgttggtgcgacaatagcagtgagctgtggcgttttctcttcgtttcatacctgccaattgattcattctttagcgtctgctaccaggttttaatgctggtgaccaatctttcaatcagtttgtcggattatgtattcagggacgtgggtttttcggcgagttttgatttgtaactatttattacactctggaattctcattccagacaatatttgactttaaagttaatacctgttatattagcagataagataagaatacctcagtttgttc

SEQ ID NO: 253 - DNA, 823 bp, Solanum lycopersicum
gttttctatctttgtggaaaaaaaaataagaaaaaaaaatgcagaatcaacaacagctacagacactgatgcaagcaggtcagatttcagggagtttgagttttaatggtaatttaagtaaagaagatgaagaaatgtcaaaatctgcactttcaacttttaaagctaaggaagaagagattgaaaaaaagaaactcgaggttaaggagaaagttcaagctcagttgggtcgtattgaagaggaaactagacgtttagctattattcgtgaggaactagaagcattagcagatccaatgaagaaagaagtttcaacggttcgaaaaaggattgatattgtcaacaaggagttaaaacccctgggccagacttgccagaagaaggagagagaatacaaagaagctctcgaggccttcaacgaaaaacacaaggaaaaagtacaacttatatcaagattgatggagctggtgggtgaaagcgagaaaatgaggatgaagaagttggaggagctgagcaagagtgtagaaacgatccattgaaagataaatcaccttaaaaaagctcatcagtgacgactaattaggcttgtgtgatatatttaagatctataatcgaaatttctgtttattatatggttgttttcgcgtttggtgggtgtattctttcttccttttttcgcgctttatgttgttctttgttcatttttaggcttttgaaggatgatgatctaattttaggtgtcaaaagggaagaaatacccttgtaaacatgtttgtaactaaaacaggtcttctctcaagctatggattcttttgttcaatta

SEQ ID NO: 254 - DNA, 666 bp, Triticum aestivum
atggcgtccgcgctcaccaacgtgagcctgtctaccttcgcgcccacggccaggggcgacgtcctcgccaggcctcaggtggccgccgcccgcgtcaccttcccgacggcgtaccgtggcagcggtgccctctcctgcagggcgggtgggccggccacgccgccgggcatctccgacaagatgtcggacagcatcaaggaggcccaggagacgtgctcggaggacgccgccagcggggagtgcgcggcggcgtgggacgaggtggaggagctcagcgccgccgccagccacgcccgggacaagctcaaggactccgacccgctcgagaactactgcaaggagaaccccgagaccgacgagtgccgcacctacgacagctgagcgtacgtgctaatttgttctggacggcggatagtgaaggtggacgtggtgttcttggctcatgggagcccgagaaaacctactatgtctcaacctaccgttacttacacgatcgggatgtatgtagtaaaaacgcgccaaatattttcccagggacatacgtggttgatatacaattgatattacagacgtttatttaaagttgtattatggatgtgtgcatgggtatggtgtagaggcgagtgtctggtcgtccttttccattaaaaaaaatggaagctctat

SEQ ID NO: 255 - DNA, 1905 bp, Triticum aestivum
gacgcacgcacgcagacgcagacgcagacgacaggactctcgccatcaggggagagatagagagggaggcgacgagcgatggcggctgggacgggcagggtgctgccgctgctggccgtggcggcggcgctcgccgccgcgctcctctacacggcgcccttctccaagagcctgggcggggaggggtgcagcctgctcccgcacggccacttctggatcgccagccagcgggtcgtcgcgctcggccgcgtcggccccgccgcagtggaggtgaaggaaggtctgatcaacgccatcgccgtcggggactaccggagcttcgtgctccgccgcccgctcgtcgactacggggacgccgtcatcatgcccgggctcatcgacgtgcacgcgcatctcgacgagcctggacgggaggagtgggaggggttctccaccggcacaagagccgcggccgcaggtggcataactacgttggtggacatgcctctcaacagcttcccttcaacagtctctgaagaaactctcaaactcaaggtggatgcagctcgagataagctatatgttgatgtcgggttttggggaggccttgtacccgagaacgccttgaacccaagcaaattggagagcctactaaatgcaggagtgctaggacttaagtcttttatgtgcccctctggcatcaacgacttccccatgacaaattcaacccacatcgaggagggcctggttacattggcaaagtacaagaggcccttacttatccacgcagagcgcataccggatgtcgtgagtgacgaggagctcgatggcgaactagatcctcgatcttacgcaacatacctgaagtctagaactccagcatgggaggaatcagcggttagagatttgaagcgtgccatgaaggacaccgaggtgggaggccggtcagaaggagctcatcttcacatcgtccatctctcagattcaaaaactaccctcgagcttctgaaggatgcaaaacacagcggcgcaaaagtcactatagaaacctgtcctcattacctcgcattttcggcggaggaagttccagatggggacactcgtttcaagtgctctcctcccatacgcgacgccgccaacaaggaaaacctctgggaggccctacttgacgggcacatcgacatgctaagctcagaccactcgccgtcgacccctgatctcaagctaatggaggaaggcaacttcatgaaggcatggggaggtatctcatctctgcagtttgtgctcccagtaacatggtcacatgggaagaagtatggcatcacgctgaaccagctagcctcatggtggagcgagaagcccgccgagctcgcggggcagaagaacaaggggtctattctgccggggtaccacgccgacatcgtggtgtggaaacccgaggcgcagttccacctcgacgacacccatgccgtataccacaagcaccggaacatctcggcgtacatagggaaggagctatcgggcaaggtcctgtcgacgttcgtgagggggaacctggtgttcgccgaagggaagcacgccggggccgcctgcggcgccaccatcctcgccaagtgaaacagtagagctacaatatcatcgctgatttctagcgtatatgatcgtgtgcgctgtgtagtagtatgtatgtgtgcagatttgtagttgtttccctgtgtataattggatccagtgcatgcatccattcccctccattgtgtatacccacccattcattggacagcaccagtgtaggttatttctctgaattattcagatgtactagttctgaacttctgagttgtgataatatctacagtatgagaggaatgtgaattattctgctactcttataactttccgacgaattttcagctgcaaaaaaaa

SEQ ID NO: 256 - DNA, 1981 bp, Triticum aestivum
tcgaagggatccccgcgccggaggacggctgcgcggtcgctgacggcgcagggagcgcggccgtggacggcccgacggacgtcatcatcgtcggagccggggtcgccggatctgccctcgcctacacgctcggaaaggatggtcgacgggtgcatgtcatagagagagacctgacagagcctgatagaattgtgggtgaattgttacaacctggaggctacctgaaattgatggaattgggtctgcaggactgcgttgatgaaattgatgcacagcgtgtccttggttacgcattattcaaagatgggaagaacacaaaactttcttaccccttggagaagttccattcagatgtggctggcaggagctttcacaatggacggttcattcagaggatgcgtgaaaaagctgcgtcgttacccaatgtccaactggagcaaggaacagttacatctttgcttgaagaaaatggtacagttaagggtgtgcaatacaagatcaagtcaggtgaagaactaaaggcttatgcaccattgacaattgtatgtgatggctgcttttcgaacttaagacgtgccctttgctctccaaaggttgaggtgccgtcttgctttgttggcctggtcctggagaattgtgaacttcctcatgcgaaccatggccatgttatcttggccaatccttctcccatcctattttacccgataagcagcaccgaggttcgctgtttggtagatgtccctggtcagaaggtgccttccatagcaagtggtgaaatggcaaattatctcaagaccgtggttgcacctcagattcctccacaaatctatgattcttttatagcagcaattgataagggaagcataagaacaatgccaaataggagcatgccagctgcaccacatccaacacctggtgcacttttgatgggagatgctttcaatatgcgacaccctttaacaggtggaggaatgactgttgcattatcagatatagtcgtcctgcgtaatcttatcaagcctcttcgcaatctgcatgatgcctctgccctctgcaaatacctcgagtcattctatactctgcggaagccggttgcttctacaataaacacattggctggtgctctatacaaagtcttcagttcctcgcctgacaaggctagggacgagatgcgccaagcttgctttgattacttaagccttggaggtgtctgttcaaatgggcccattgctctactctctggtcttaatcctcggccattgagtttggttgcacacttctttgctgttgctatctttggtgttggacggctgatgctcccccttccttcacctaaacgaatgtggactggagcgagattgatttcgggtgcatgtggtatcatcttcccaatcatcaaagctgaaggtgtgaggcaaatgttcttccctgctaccgtccccgcgtattaccgggcacctcccgaagcagagttctgatctacgaaggtgcagctaatctctcgcacgatgacatttttcctgtgttggtagtcgtccgccagtgttagccggtcgttgaaaatgtgctgtgttggtagtccgaatggatcgaggaacgtgtatagtatctccgttgggtgctgatcctgtttttgaaatgttttgaattgctgcgtcggtgcccatgttgattcgtcctagctaaattgtacatctttgttgtactacgccctccgttccgaattacttgtcgcacttatggatgtatcaagatgtattttagttctagatacatccattttaacgacgagtaatttggaacggagggagtactatgatgaactgcgcctgctgttctaactagtggactaaggcggtgttccttgtctactgatcgtgagctgtgctgtgtgcgtttcaaatcagaccactgtataccatgttaggctgaacgctgttatggaccattatatgccttcagttatatgggccagctcatc

SEQ ID NO: 257 - DNA, 285 bp, Hordeum vulgare
ccgccgcggcctgccccgcgtgccgctgccccgtcaccggcaccgtgcaagtcttcttcgcgtgagacgggtccgccgccgctggatcatgaaactggggccatggagaaagctgtagatcagatcaagacagggtgcataattccttcctctctttgccctcccgtgctagtgggctgatccttccatccatgatcgcttcacctcttttgctagtgatgctgtaaatcattactgctgatttgaatcttgcgtgacagtttttactgctaaaaaaaaaaaaaa

SEQ ID NO: 258 - DNA, 1800 bp, Zea mays
actgccctcccacgctccactcccgacacctgttccgtttaaaatctccggcgtcgacgtggccgcgtgcgcagccacaaaccctccctcccgccgcaattaacaatccgctaatcagctcggcgcagcccgaaccctccctctaatcgcccgctaaaccgctccctccctccgccaaaaggccagtccgggggcttttcctatctccacttgttggcgacttggtagtagactcgcggatacgatccttctagacacttcgacgcgcccgttataaaggccggcgcatccgggccatgaccacacagccccttgctcattggctagggcggggaaggaaattgcgggaggatgcgaagccattggtgtattgcatatggtggcaccaagcatgaggcaggaactgcattacttgcaagaaagtcacaagctcattccaatctgattctctaaactttggaggtctcttacacctaggcctgaaagctcctctcccattagttgcctacaacattggaaaagagtttctcacattatcttagaatccattgcaagatcatacttgtggctttcttgcaagttgtgcagttgttgcctcaagcttgctgcctccctttgccagagctatcggtaaaacaggaagtccctagaaaggaaaatcgtgatttggaaaggaaattcatcaacaaacctgagtcggaaggatgcttaggaagcgggtactccctatgttccagattatagttcatttagatttgatgattcaatcaattatttctggggtggtctacagccaatgcatagtctctatctgtgtgtgtgttttgtgtttcccgtgcactctattcctttcgagaggcactctatgtcaggtgcctgaaatatggtttagcttcaggcaatgaagtggacgtcggatggagatccgagtgtccacgatgacagagaccggcttttgaatctctcgtctctccatctctcatgcgttcccaacttccaactccaatgccgtctccgctggctgatcagtgatcacctctgaccctctctggtgatgtgtacccattgttaatctctccaatgaagctaccctgcctgaccaggcccacaggctgtctcctgcatacggtggcaacacaccaacactgctggcctgccctaagacacatcttcgcgttgcgtccactggatacctgctttcttagtcagcagcatgccgaaaccctccatttgtgaaacctcagcggtgataggcggtggttgtcgaacgctggcatgaaggtgtgagctcccaactgctgaatcgtgttcctcttttacatgcacgtgtccaacaagaaccaaggtggaactgtaaagccttgtgtctttgaactttgcagccacgtattcagatttttttttgagttattgtaatttatttacattccctctagaaccgagattagcgctacctcagtacactgccggtgcaagataaacgaaggaagctgggattgcatggcactgcggtctgttatgtagccgtggaacagcaagacaaaaagacatggatattccttgtttggattggggtgtttgatccagaaacagtctcattgctaattgtttcattattactacaaatcttggtcgaggcgtgaatatccttgctcttgatataattatagtattttgaatccctattgtgttttttacttaagtgataaatgttgcaaagaaaccattagataattgttgaatgattagttattgattacattgattgattttgatttaatgaatcttaaataaaccaga

SEQ ID NO: 259 - DNA, 1589 bp, Arabidopsis thaliana
agaaaatggacccatggtcatggatatgtgagcttccagaagatcctgagttcagcgagtctgattcacacgcagtgtttcagctcgctggcgatttgacacgttcgatcaaacttagagccgaacggactttgggttctgaccaagaatctcactctctcacctttacagttgtagcagagggttttaacctccttaagtcgtcgaccatttgggtctccaacacatgtcccttgtcgtcggagaaaccgttcctccctcttgttctccagcttcttcaagaactaatcacccgttcccctaccacacacgacggcgcgtgcacaaagtttgaacaacttgaaatcaaaccaagtccagttagctgggtcatggactctcactcacctgaatccttctcatcagtctttaatctaatcctcctcacacgcctcttctggttgtgtgtgtttgacgcgccaagcgaagtaggctctttcttcttccaacacttactaggtccacacgtgaacgcgcttacatgtcaacatgcacctgtcttacggacgtttctcgtctctctcggtgtagacgccgagctttgtattgtacgagctgcttcgtatgccttatccaaatggatgatctctaaagagataggacttgggaatcttggtttgaaacagttcagtagcagcctcatgccacgtcattcgttggggttttcgtatgccacagaagctcatggtctttggatcttgaaaggttatttcccaatcttgtcaatgaacgtcacaaataatagctctaacgaggttcacaacaagatcgtcaagtttccattcgtagagcctaaagaagctgtcctacgttacgctttgtcgcatcaacaagctgaaatactagtacagtttgaatactccgttaagttctatgagaactacataaaagtaaacgcacgtgtagacaacatacgcatccacgtctcgaagctagggtttcacaaaggaggagttggcgtggagaatcagatagcggattgttactccgaggagaggtacttcccatcacgggtacgggtctggctcgggccagaactcgggtccagccacgtatcggggctaagtctaggaaggtcaacgaagaacgaggagagagatatcgaggtgactagagtgctaaagggaaatttcggaaaaggtaaagtggctccgagagtcaaggcaagagcaagaatggcaacaaagaggaaggttaaagattggagaatagagcaggaaagcgaaggaaacgctgccgtttttgatgcggtgttgtacgatagagagagcggtcaagaagtgacaaccgttaagccgaagccaaaccaagagggtttaaagaatgtgtttacgaagagtggggggatggtgtttggaagggatgagtatggagatgaagttgggtggagagttgggagagagatggaaggaagtgtgttgaagtggagactgggtggcaaaatttggctaacttattggccaaacaagttgaacactttgttttatgagactagatgtgtagagtggtgtgatgaggttgatttgccgttgcttcctacttcttagtag

SEQ ID NO: 260 - DNA, 586 bp, Arabidopsis thaliana
attagaagacatgaagaacggtaaccggaaaacaacgccggaaacagagaagtctcaccggagaaagttatcagagaaagcgatgtcgtttcacggcagaggaacaacgccgttatcaaatccaggcgagcttcgaagaccgaaaacgttaccggagttattctccaccggtcaaagcatcaccgtaccggagacggtttcacttccgccacgtttgacgaaacttttacttaacgtgacggtacaaggaagtttaggagccgtacaaattataatctcgccggaatccaccgtgagtgatttaatcgacgccgccgttcgtcagtacgttaaagaagctcgccggccatttttaccggaatctgaaccgtcacgatttgatcttcattactcgcagtttagtcttgagagtattgtaagagacgagaagttgatatcgctagggtcgagaaactttttcttatgtggtcggaaagagaccggagggtttatcggctgtggtttatcgtcggaatcttgttctaaggaagcagagaaagtggctaaaactggttttcattggctcaaatttatgggcttctagtaa

SEQ ID NO: 261 - DNA, 1544 bp, Arabidopsis thaliana
caacaatggagatcaccactatcatattcctcatcatatcctctctcaccttctccatcttccttaaactcatcttcttcttctcaactcacaaactcccaccgggaccacctcgttttccggtcatcggaaacatcatctggcttaagaaaaacaacttctccgatttccaaggcgttctccgtgacttagcctcccgtcacggaccaatcataacactccacgtaggctccaaaccttccatctgggtcacagacagatcactcgctcaccaagcccttgtccaaaacggtgccgttttctccgaccgttctctcgctctccctaccaccaaagtcatcaccagcaaccaacacgacatccactcctccgtctatggctctctctggagaaccctccgccgcaacctcacctccgaaatcctccagccctcgcgcgtgaaagcacacgcgccgtcgaggaaatggtctctcgagattctcgtggatctgttcgagacagagcagagagagaaaggacatatctccgacgctttagatcatttacgtcacgctatgttttatttgttggctctgatgtgtttcggagagaaactgagaaaagaagagatcagagagatcgaagaagctcagtaccaaatgctcataagctacaccaagttcagcgtcctcaacatcttcccaagcgtaaccaagttcttgctccggcgaaaatggaaagagtttttagaactaaggaaatctcaagagagcgttatacttcgatacgtgaacgcaagaagcaaagaaaccaccggagatgttctctgttacgtcgatacgctgctgaatcttgagatcccgacggaggagaaagaaggagggaagaagaggaaactgagtgactcggagatcgtgagtctgtgttcggagtttcttaacgcagctacggatccaacggcgacgtcgatgcagtggatcatggcgatcatggtgaagtatccagagatacagaggaaagtatacgaggaaatgaagactgtgttcgccggagaagaagaagaaagagaagagatcagagaagaggatttggggaagttgagttacctcaaagctgtgatcttggagtgtctaagaagacaccctcctggtcattacttgtcttaccataaggtcacacacgacaccgttttgggtggatttctcattccgcgccaaggtactataaactttatggtaggagaaatgggccgggacccaaaaatatgggaagatcctctaacgttcaagccagaaagatttctagagaacggagaagcatgtgattttgatatgacgggaactcgcgagattaaaatgatgccgtttggagcgggacgacggatgtgtcccggctacgcgctttcgttgcttcacctggaatattatgtggccaatttggtttggaaattcgagtggaaatgtgtggaaggtgaagaagttgatctatccgagaagcaacagttcatcacaatggtcatgaaaaaccctttcaaagcaaatatttatccaaggagaaagtgatga

SEQ ID NO: 262 - DNA, 607 bp, Arabidopsis thaliana
aatctggttgaggaaagctgactaaccaccacataaaaagccacgtggcacatgcacttcccctagaaatacgaaactttaataagaagcatccagcaaaaccgaaatcttggttcaccaccgtctccagatcaaagaaaacagagaaacatctgtttttttgtttagtttgatctgttgagagatgacgagcggtggcgacgataaaaacagatctgtggtgacagatcatcaacatcaacaacagcctcctcctccgtttcaaggcgtctctaactatccaccgcagcagcagcctcccgccaccggttatcctcagcctgctcagccctacgcccaaggttatgttgttaatggagtaagaccaacagaacacggtcgttgttgcggtatcggcattggctgggtattattcatccttggtttcttcttcgctttgccctggtacatcggtttcttccttctattattctctaggaacccgcgtgagagaccaggatatatagcttgcgcagttggggctgtttttgctaccattatcgtcatctttggaaccgtaagaggatcaggggtgtggtcatgaaggtgaagatgtcaacaatctgaa

SEQ ID NO: 263 - DNA, 929 bp, Arabidopsis thaliana
gaagaagatatttgttgctgatggcgggtacttgcacttcgataaggcctcgtctcattggctcttcttcaattgttgagctttcaaggttgattaatcgagctggagttcctttctctgtacgattctctacaagaaccagagccctccacggtggtggtttaaccgcacctacctctcgtgaggaaggtccttcttgtatcttcgttggacctattgattctgctcgcaaagaaactctagaagctctttatcgccaagctaaggatgcgtattacaatggcaagcctttgatagttgatgacatgtttgacagagttgagctaaagcttcggtggtatggttcaaaatctgttgtcaagtatcctcggtgtagtctactaagacagtcaacatatgctgatgcagaggatgatgcatcgcaagttctcctgttagctaccgtatggattatgattttcttatttggtagttcggcatgtgttttacccacgatatatggcgtcggcctggtttatggaggagatccgtttgactcagggcttgtctatagcagtcagttgtcatcttctgtgcctattttgtcaaagtttaatggcatcctcctctccgtgctagggcctgcttttggatatccgattgcatcttctgcagtaagagtacttaaagggttatggagaaatgacttaacggctctaaaaggagactgcccgaattgcggggaagaggttttcgcatttgtgagatccgatcaatcgaaccgatcagctcacaaagccgactgtcatgtctgtgagtgcaccttggagttccgtaccaaagtagagaaatctgcctcacgattggggagaaaatgggtttacggtaggatataccttgtttcacggccaaggagagatcggcgttcaaagtttacataattctaacaa

SEQ ID NO: 264 - DNA, 987 bp, Arabidopsis thaliana
aaaagatggagagaagcttgaagaagacgaagaacaattataacaactccataaagagcaatcttatgaaagatgatgaattgtttcatgtgattcacaaagttccctgtggagacactccttatgtcagagccaaacatgctcagttgatagagaagaacccggagatggcaatagtgtggttttggaaagccatcaacactggagacagagtagacagtgccctcaaggacatggctgttgtaatgaaacaacttgaccgttctgaagaagctattgaagctatcaaatctttccgtcctcgttgttccaagaattcccaagattcccttgacaatgtcctcatcgacttatacaagaaatgtgggagaatggaggagcaagttgagttgttgaagaggaaattaaggcagatctatcaaggagaagctttcaatggtaaacctaccaaaaccgctcgctcccacggaaaaaagtttcaagtgactgttcaacaagaaatctcaagattactgggtaacttggggtgggcatatatgcaacaagccaagtacttatcggccgaagcggtatacagaaaagcccagatggttgagccagatgctaacaaatcgtgcaaccttgcgatgtgccttatcaaacaaggcaggtttgaggagggaagattggttcttgacgatgttctcgagtatagggttttgggtgcggatgattgtagaacaaggcaacgggccgaagagcttctgagtgaattagagtcttcgctgccacggatgcgagatgctgagatggaggatgtcttgggaaatatcttagacgatgactttgttcttgggcttgaagagatgacatccactagttttaaatctaagagactcccaatcttcgaacagatctcgtcttttagaaatacattagtttgctagttaattcattctgtgttttcttgtgtatcatcatcatagctttgctgctttatagttttga

SEQ ID NO: 265 - DNA, 2981 bp, Hordeum vulgare
cgaaaccctagcctcatctcgccaccgcacgcctcctccacaggacccttctcggagcccgcggatggacgactcggagaacaacgcgccgtcgaccccgggctcgccgggtttcagcaccgaccggctgccgcccaacaccaccaccagccgcggcgccaccgacccgtcctcctactcggacgacgatggcgaggcggaggtcgaccccaatgtgctccccgaggacgacggcgccaccgttatccgcgacgaggaggaagacgacggggaagacctcttcaacgacgactacctcaatgattaccggagaatggatgagcaggatcactatgagtccgttgggttagatgactccatagaggatgagaggaacctggatgagatcatggctgatcgaagggctgcagaagcggaacttcatgcaagggatgtgaggactggtgcaacgtctgatcgaaaattgcctcgtatgcttcatgatcaggatacagatgaggatatgaacttcaggcgtcctaaaaggcacagggctaattttagacaaccaactggaggaccaagaacacccagaagtgatgatgatggtgatggtctcactcctagttcacctggaagatctcagccatattctggtggtgatgtgcctatgactgatcagactgatgatgatggatatgaggatgaatttgatgaagaagatgagatgaacatgtaccgtgtgcaaggaacacttagagagtgggtcacaagagatgaagttcggcgcttcattgcaaagaaatttaaagaatttcttcttacatatgtaaaccctaagaatgaacaaggggagtttgaatatgtccgactaattaatgagatggttttagctaacaagtgtagtttagagatagactacaagcaatttatttatatacatccaaacattgccatctggttggccgatgcaccacaatctgtgctggaagttatggaggaagtgggcaaaaatgttgtttttgatctccacaagaattacagaaacatccatcagaaaatatatgtgcgaataaccaaccttcctgtctatgatcaaatacgcaatatcaggcaaattcatctgaacacaatgattcgaattgggggtgttgttacacgaaggtcaggtgtgttccctcagctgcagcaggtcaagtatgactgcagcaaatgtggtactgtcctgggtcctttcttccagaactcttacactgaagtaagggttgggtcttgccctgaatgccagtccaaaggtccatttactgtcaacattgagcaaactatatacaggaactatcagaaactcactcttcaggaaagcccagggattgttcctgctggcaggcttcccaggtacaaggaagtaatacttctgaatgatctgattgactgtgctcgtccaggagaggaaattgaggttacagggatatacaccaacaattttgacttgtctttaaatacaaagaatggcttcccagtttttgccacagtggtggaggcaaactatgtttcaaagaagcaggacctgttctctgcatacaaattaacagatgaggacaaggcagagattgagaagttgtcaaaggatcctcgtatcagtgaaaggattgtcaaatcaattgcgccatccatttatggtcatgaagatatcaagactgccattgcactagcaatgtttggggggcaagaaaagaatgtgaaaggaaagcatcgcctaagaggtgatattaattgtctcctcttaggtgacccaggcactgcgaaatcccaatttctcaagtatgttgagaaaacaggacacagggctgtatacacaactgggaaaggagcttccgctgttggactcacggcagcagttcacaaggatccagtaacacgggagtggacacttgagggaggtgcactggttcttgctgataggggcatatgccttattgatgaatttgataagatgaatgatcaagatagggtaagtattcatgaagccatggagcaacaaagtatcagcatatcaaaggcaggaattgtcacatcccttcaagctcgatgcagtgttattgctgcagcaaacccagttggaggaagatatgattcttcgaagacattcactcaaaacgttgaactaacagatccaattatttcgcgttttgatgtcctttgtgttgttaaggatattgttgacccatttacggatgaaatgcttgcaaggtttgttgtagatagccatgccagatctcagccgaagggtgctaatcttgaagatagagttgcagctgatgaggaggacgatccattgactgttgcccgaaatgctgacccagatatcctttctcaagacatgctgaagaagtatattacatatgctaagttaaatgtgttccccaaaatacatgatgctgacctggacaagattagtcatgtctatgctgaacttcgccgtgaatcatctcatggccaaggagtccctattgcagtaaggcacattgaatcgatcattcgaatgtctgaggcacatgcaaagatgcatctgagaagctatgtgtctcaggaagatgtcgacatggccattcgggtgttgcttgactcgttcatctcaacccagaaatttggtgtccagaaagcacttcagaagaatttccggaaatacatgacgtacaagaaggattacaatgaactgcttctgctccttctgcgcaccctggtcaaggaagcgctgcactttgaagagattgtgtcgggatcaaccacacgcctgactcatgtcgaggttaaagtggatgacctgaagaacaaggcccaagaatatgagatctacgatctgaggcccttcttctccagctctcacttcaacgacaacagctttgtcctggatgaagggcgtgggatcatcaagcatccagtagcagcataacaactcaatcaacctcagctacctcttttgttcaagagcgaggtgacca

SEQ ID NO: 266 - DNA, 1147 bp, Hordeum vulgare
agatctcccaagggccaaggcgaggagccaacaaacgcaaggccaccgccgccgtagtcgccgttctgcgatcgggtccgccgcagtcgccgttctgcgatcgggtccaccgccgccaccccgagagatgacgaaggcgttttatgcggtggggctttggatccgggagaccggtcaggccctcgaccgcctcggctgtcgcctccaggggaactacttcttccacgagcagatttcaaggcatcgcacacttatgaacatctttgacaaagcccctcatgttcacaaagaggcatttgtcgctccaagtgcatcccttattggtgatgttgaagttgggccagggtcttcaatttggtacggatgcgtcttacgaggtgatgcaaataacgttcaagttggatctgggaccaatatacaggataattccgttgtgcatgtggcaaaatctaatttaagtgggaaagtctttccaaccatcattggagacaatgttacagtaggacacagtgctgtattacaaggatgcactgttgaggatgaagcttttgttggtatgggagcaaccctgttagatggtgttgttgtggaaaagcatgggatggttgctgctggagcccttgtaagacagaacacaaggatcccttgtggagaggtatggggtggaaacccagcaaaatttctgaggaagctcacagatgaagagatcggttttattggggaatcgtctgccaactattccaacttagccagggcacatgctgttgagagtgctaagcccatggaaaagattgattttgagaaagttttgcgcaagaaatttgctcaccaggtcttgcttagtgtcactcaagaggttcctccagagctgcccccccccagtcctactcctgcccaataagcttttcttataaccatcttcagtttggattcttatatctctatctgtccagtgagtttggcagtttacgttgtaattttgggtcgagcaatgttctaaaaagctgactatctacttcagtttctgtattccatggaactaacagaactatttcacacaaattcactggcatgttttgcgtgcataatttactctagctgaaattgctagatgcactggaggcagcacatgaactgttggcttgta

SEQ ID NO: 267 - DNA, 1362 bp, Hordeum vulgare
tcagaagctcagaactaccacgactcggggacggggtccggtgctcttcgtctgatcaatctcgtccgcgtttcttgtacattggggccaaagatggcaaggtcagccatgtccgggctagtgctcctgcttctatgtgcgacctgcagattggcgctaggaatcaccgatgggctgctggcgaacggcaacttcgagcgcgggccgcagccgtcgcagctgcgcgggacgcaggtggtgggcgcgtcgtcgatcccgtcgtggcggacgtcggggttcgtggagtacatcccgtcggggcaaaagcagggggacatggtgctggtcgtccccgagggcgcctacgccgtgcgcctgggcaacgaggcgtccatcgcgcagcgtctccgcggcgcggtccccggtgcgcgctacagcctcaccttcagcgcggcgaggacgtgcgcgcaggcggagcggcttaacgtgtccgcgtccggccagtcgggtgtgctggtcatgcagaccatgtacagcagcaacggctgggactcctactcctgggcctgggacgccagcgccgacgaggtcgaggttgtcgtccacaaccccggcgtcaccgaggaccccgcctgcggccccctcatcgactccgtcgccatcaagaccctcaccccgcctcgccgcaccaacaagaacctggtgaagaatggtgatttcgaggaggggccatacatcatccccgggacaaagtggggggtgctgatcccgtcgcggacggtggacgagcactcgccgctgccggggtggatggtggagtcgctcaaggccgtcaagtacatcgacagcgaccacttcgcggtgccgcgggggcgtcgggccgtggagctgctggccgggagggagagcgccatcgcgcaggtgatccgcaccgtgccggggaagcagtacgcgctgtccttcagcgtgggcgacgccagcaacacatgccgcggctcgctcatggtggaggcctacgccggcagggagtcggccaaggtgccgtacgagtcggcggggcagggcggcgccgccaagcgtgccgtgctcccgttccgcgccacgtcgcctcgcacgcgcgtcgtcttcttcagctcattctacaacaccaggaccgacgacatgagctcgctctgcgggccggtgatcgacgacgtcgcagtcgtcagcgtgcgcgcgcggcacccaaagcgcgcctagaaggctgagctagctggccatacagtgtgctgggtgcacggcgttgttgttgctgctgctgctgcatccgtgttaattaggcagctgttcactgcttgggcgctcaaactgctcattgagcttgaatgtgcacgaaggaattag

SEQ ID NO: 268 - DNA, 1466 bp, Hordeum vulgare
actctcctagctcaggccaagctcctcagccatggcggccatcacggcggctttcctcctcctcctcgccgccacagtcgccgcggccgccgacctctccgtctaccacaacgtccaccctccgtccgcctccccgctcgagtccatcatctcgctcgcccgcgacgacgacgcgcgcctcctcttcctctcctccaaggccgcctccaccggcgtcacctccgcgccagtggcctccgggcagaccccgccctcctacgtggtgcgcgccgggctcggctcgccggcccagcccgtcctcctggccctcgacaccagcgccgacgccacctgggcgcactgctccccgtgcggcacctgccccaccaacagcctcttcgtcccggccaactcctcctcctacgcgcccctcccctgctcctcctccatgtgctccatcctccagggccagccctgcccggaccgggacccctacgacagcgcggcgccgctgccgtcgtgcgccttctcgaagccgttcgccgacgcctccttccaggcggagctggccagcgactggctgcatctgggcaaggactccatccccaactacgcgttcgggtgcgtgggctcggtgagcgggccgacgtccaacctgccgaagcaggggctgctgggcctgggccggggccccatggccctgctgtcccaggtcggcaacatgtacaacggcgtcttctcctactgcctcccgagctacaagtcgtactacttctccggctcgctccggctgggcaccgccggccagccccgggcggcgaggtacacgccgatgctcaagaacccccaccgctcgtcgctctactacgtgaacgtgacggggctgagcgtggggcggtccccggtgaaggtgccggcgggatcgttcgcgttcgaccccagcacgggcgccggcacggtggtcgactccggcacggtcatcacacggtggacggcgcccgtctacgcggcgctgcgggaggagttcaggcgccacgtcgcggcgccgagcgggtacacgtcgctgggcgcgttcgacacgtgcttcaacacggacgaggtggcggccgggggcgcgccggccgtgacgatccacatggacggcggcgtcgacctggcgctgcccatggagaacacgctgatccacagcagcgcgacgccgctggcgtgcctggccatggccgaggcgccgcagaacgtcaactccgtcgtcaacgtcgtcgccaacctgcagcagcagaacctccggatcgtcttcgacgtcgccaactcgcgcgtcggcttcgcccgggagtcctgcaactagtttcctttcccaccggacgactttccttcacgtgttcgcgcagttagtcgagacattagccatgcatttgggtgtacgtacgtacgtacgtatgattgttaatctccggcttaattttcagtgtgtgcaataaggaatgtgg

SEQ ID NO: 269 - DNA, 1551 bp, Hordeum vulgare
aacgccatcttgtgtgacgccatcgccgagagagcagcagccactccagttaagatggctccgctgatcaccgccgacgtcgtggtggaggctgcgccggccccgtccatggccgtgctaaaccaactggtttgcgcgagcgcgccaacgccgaccatcgccgtggtctccaagcatctggttctgccggagggcgctcagccggttggagacctcaagctgtccgtctccgacatgcccatgctctcgtgccactacattcagaagggcctcttcttcacgcccgcgggcatgccgactgcccgcctcgtcaagtcgctcttgctgtcgctgtcccgcgcgctcggggtgtttccggcgctcgcgggacggctcgtcacgctccccgacgaccgcatcgtcatccggtgcgacgacgcggccgtcgagttctaccatgcggtggcgcccgctctgtcgctcgccgacttcctcgtgcccgacgccgacgtgcctaccaggctgacgaaagatctgtttcccatggaccgcgtcgtcagctacgaaggccaccgccgcccgctcacatcgtttcaggtcaccgtgctcggcgacggcgctgtctttgtcggcctcgtcgccaaccacgccgtcgtggacggcacctcattttggcacttcttcaacacgtgggctgggctgtgccgcggcgagccagtccagccaccggacttcagccgcaacttctttggcggctccacggccgtcctccgcttttccggacgcgacggccctgcagtgacgttcgacgccgccgctcccctccgcgaacgagtcatccacttcagcgctgcggcaattcgcgacctgaaggcggcggccaaccgctgcagaaagaccaacgaggatgacgaggttaacggcaagctcgagcacgatctgaaggtccaggggggtggcggacagatctcctctttccagtcgatgtgcgcgcatatgtggagggccgtgacgcgggcgcggctgcagttgactgccgatgcgacgacaacgttccgcatggcggtgaactgccggcaccgcctgcgcccgaagatctccccggtctacttcggcaacgccatccagagcgtggcgacgacggcgacggtggccgagctggcttcgcacgaccttgggtgggcggcggccaggctgcacgcgaccgtggtggcgcacgaggacggcgccatccggcaggccgcggcggactgggaggcggcgccccggtgcttcccgctggggaaccccgacggcgcggcgctcaccatggggagctcgccacggttcccgatgtacgacggcaacgacttcggttggggcagggcggtggccgtgcggagtggccgagcaaacaagttcgacggcaagatgtcggcgttccccggtcaagccggggatggcagtgtggacgtggaggtgtgcctcgccccggacaccatgggccgcctcctctccgacgacgaattcctgcagttcgtgtcacatgcaccttgatggggtgcaccgcatctggctgtcttgtatgtttag

SEQ ID NO: 270 - DNA, 1106 bp, Hordeum vulgare
ttagccgtctccgacttccgttccgaggcgatcgccggccggatgggtgatctgggcgtacgggttgtgggcagaggctgcgccgcgcccatggagccgcgcaaggagatggcgccgccgccgccgatggagcagcaccatcctcccctgttcatggatttctctcgtcgagatggagtcgcagatggcggcaacgtgcggaagcggccgcgcgaggccgtggcgccgccggcacggctcttctccctgcaggcgccgcagggttccccggggcacaaggtgatacacctggcgcagctgcaccggcggccggcggcgacgggcctgcggctcgacttcgacgagggaggctcggagcacgtggcgtgcacgtcgtcgtcgccgtcctccgttctccccggcgagctcgccgctcagtgcgggcagtacagtaacgagatcgaccgactgctccaggaacacgcggagagactccggcttgcgctggccgacacgaggcgtcggcagaaccgctcgctgctgggcgccgcggaggcgctggccgcgcggcgggtcagggagatggaggcggagaccttcaaggcggcacggcgcggcgtcgagctggaggagcagctggcgcggctgagggcggaggccgcgtcgtggcaagccaaggcaatgtccgaccagtccacggcggccgcgctccacgcgcagttgcagcaggcggcggccacagcgcaggcgaggagcggcaaggccgccttggacgacgacggcgcggcgggcgcggcggacgacgccgagtctggcttcgtcgacccggacagggtggtggaggtcatcgcgccgccgccggcggccaggccgtgccgcgcgtgccggctgcggccggcgtccacggtgctgctcccgtgcaggcacctctgcgtgtgcgacgcgtgcgaccccggcgtgccggccgcactcgccggcacggcccccgccgcggcctgccccgcgtgccgctgccccgtcaccggcaccgtgcaagtcttcttcgcgtgagacgggtccgccgccgctggatcatgaaactggggccatggagaaagctgtagatcagatcaagacagggtgcataa

SEQ ID NO: 271 - DNA, 2171 bp, Hordeum vulgare
actgatgctcgtggagagattcggaggagaggagcgcgcggtgaggaggcggtggaggcggaagcgccgaagagttggccaccagcgcagccacggacgacgcgcagccgccgggggacgaggcctggaacagggctgctccgccgccgctgacgcccgccgcctccatgggggagtcgctgctcaccgcgctctccatggacaccgccacggcccaccacccgcaccagggcccctccaccttcctctccatggacactgcctcccacgacgagttcgacctcttcctcccgccgccaggccccttccagcgctgcctccatgccgccgcagccgccccccctgacatcaacctccccctcgccgctgacccgtcgcctccccctccggctatgcagaccaccaccctccatgaatccaacgtcgacatgctggatgttggcctcggctgcccgcagctctatgactcggactcgcctgctgctgctgccgcagccacctcggccccggtgtccaccacaacaactgtccatgtgtctcacaccaagagctccggttccagcgccgcgcgcaagtgcgtgaagcggaacgatagcatctggggtgcatggttcttcttcacccactacttcaagccggtcatgtcggctgataagtccagcaagaccaaggcacccactgctgctgggaatggtaatagcgccacactggatgctttcctggtgcagcacgacatggagaacatgtacatgtgggtgtttaaggatcgtccggagaatgccctggggaagatgcagctgaggagcttcatgaatggtcactcgcgccttggggagccacagtttcctttcagcgcagacaaagggtttgtgcgctcacaccggatgcagcgtaagcactaccggggtttgtcaaacccgcagtgccttcatggtattgagatcgtgcggacaccgaacttagtgggtgttcctgaggccgatatgaagaggtggtttgagctcactgggagggatgccaatttctcggttcctactgaggcagatgattttgaatcatggaggaatctgccgaccacggaatttgagcttgagaggcctgcaactgctgctccagcaaagagcacctcacatggccatcacaagaaggtgctcaatggttctggccttaacctgtcaacacatgcatcaaagcatggttctggggatggtttggacatctcaggcgtgtgcaacaaacgtaggaaagattcctccccctctgccatggaagaggattgcagcaattcaaattcagacaaggttcaggacatggatgtgagccacacttttgagccatcatggaataatgacttcaccggtgtgatgcgtcatgcttctgggccagtaactgctgcaaaaacaatatatgaagatagcaagggctacttgattatcattagcctgccatttgctgatatacagaaggtgaaggttacctggaagaacactcttacgaatggcgtcgttaagatatcatgcactagtgtcggacggatgccatttttgaagcgacatgaccggaccttcaagctgacggatccttcacctgagcattgtccaccaggagagttcatccgggaagttccattgcctacccggatcccagaagatgctactctagaagcatactgtgatgaatcaggaacaggcctagagattattgtccctaaacaccgtgctggacctgaagaacatgaagtccatgtgtccctgaggcctccctcgtcatggtgccaatgaaaacatgttgaaggtgtgtgatagatgttcatgtagtagttagagtgtccattattgtcagctgctcttgattgatcctttgctgtctgctaaccctctagtatgcggggagacaaggtgtggatgttaccatacaacaaatgcagctcagttttgctaattgtgacggagcaggccctagtcgatcgaagcattctgctagttggaagttggcagctgtggaattgtagggacatgctacaggccacaaggaacatatctggattactggtccgccctatgtttcggtatcgttgctggggaatacattgtgtattatcttttgcttttttgtggaagttttctttgtatgaaaggtttgtagccagcctgctcaatatgcttccatct

SEQ ID NO: 272 - DNA, 772 bp, Hordeum vulgare
agaggagctcccaccagcgacgtcgcagctcacaaatggacagcggaagcgagtccgacggcgcccctgaggagctcactgccgtccagggtgtcgagaaacatgaagaaatcagcaaagtagagaaggacagtgctgtcagagcaacccaggaggagaaagaccggaggaaacgctgggcccaacgcaaaacatcctcaaacccgaaaaaaaagaaacctctgaaagtagaagataaagatacagaagtggatgaggagacacgtgctatgcccgggacactccccaagagcgtaattgaaatgcttgcagcacgtgagaagcaaaccttcacatcggattctgaggaagaaaatgtaagccaaaaggtccagaagaagaagaaaagattgaaaactacaattactggacctgaaacaattctgctgaaagatgttcgatcaacggagcacataaaaaaagccctcgaatttctgaatcacaggaaaaaccaggtgccaagatccaatgcagttttgaagaatcgtagtgccatgcgtctctttaataaacctaatttcacggcttgagtggtagactgaggcagtttctgaattctgtgtcgaggctcgtttggaagactattatggttgacaggttgagatatcaattgtttttatgtgttgaacaaacatatatgcttgtgatttgcagtgtcgtatgggggtgatgatgtataatgttcatcctcgttagacacctgtgatgtgtgagctgaatgcgcataatgtta

SEQ ID NO: 273 - DNA, 1656 bp, Hordeum vulgare
ccagacaggcagacagacagacagagagggaagaggaggccgaggcgcgacccaccccaagcaagccctaggcgacgcgacgacggccgccgcggcgaaggcgtgcccggattcggggctcatccgctcggcccggccatgtccaccaagagggttctttgcaagttcttcatgcatggtgcttgcttgaaaggagagtattgtgagttctcccatgactggagtgaccaatcaaataatgtttgcacgttttaccagagaggctcatgctcttatggtagccgttgcagatatgaccatgtcaaagtttctcgtaacaacccagtgcctccactaccatcatcaagtgccgcaacacgtaacccagttcgcccgccaccatcgtcaagtactgcaacacatgttgcatctacatctctacaacttctaagttctggacgtcctcttcacccgggacaccaaacaaactcaagcaaccaaaggcaacagatatctatggataagctgtcactttctgaaagtaagcctgcatggaggaatgaggtccaacctgacagtgtatcagaggatgggattgactggtcatccattcaaactgcgcaaaaccaaacttccatgaaacttgctgatatgccaatttgttcttttgctgctgctggtaactgcccgtatggtgaagagtgccctcacatgcatggggatttgtgtgcgttctgtgggaaaatgtgcttgcatccttatcgtcctgatgagaggcaggagcatatcaagctatgtgaaaagaaccacaagcggcttgaggctttgaagcgcagtcaagaaatagaatgcagtgtctgcttggaccgtgtgctctcaaagcctactgctgctgaaaggaaatttggactattatctgagtgtgatcatcccttctgtatttcatgcataagaaattggcgtggcaactctcctacatctggtatggatgtgaactcagcactgagagcttgcccaatatgccgcaaactttcgtactatgtcattccaagtgttctttggtacttctcgaaagaggaaaagttggagatcactgaaaactacaaagcaaagctcaagtcaatagattgcaagtacttcgatttcggaacgggcacttgccccttcgggacaagctgtttctacaagcatgcttacagagatggccgtttggaagaagtcgtactgcgacatcttgattgtgatgatggaagtacacttattgctaagaacattaggttgtcagacttcctcggtcggttgcatctctagggaccagcggctgcatatatatcgaatgcatcattctgggatttcgatgtctaccaaatatttgcagtattctgaagacatcagtttaaaatcgaggcatcttcgaaaactgctgcttttctccaatttattggtggttgctttgtcgccaaacatacaaagaaaattcaaagttcgctgctggacacctggatgaccttgtagtgctattgaccagtggaacaatgggaaagaagttatgccgcgagtatgcttgaaaagtgaaaaaaaaacataattagaactgctgaaacgcctttccgtatgcactttgtgttgcttcctgggtggtcaccagtgattcggtagaacgttacctggccattg

SEQ ID NO: 274 - DNA, 1011 bp, Hordeum vulgare
accgcgatgtatcctctggagatggaaggcagctcgaacccaaaggcgtccaacaagcccaagtattccaagtttacacagcaggagcttccagcatgcaagccactactgacacctggaattgtcattgctgcctttgcgctcatcggcgccctgtttgttcccatcgggcttgcgtctctgcatgcgtcacgacaggttgtcgaactggtgcatagatatgatgctggttgtgtgcccgtggatgacaaggttgggttcatccagaactccaggactgacaagacatgcactataacaatgaatgtgccaaaatacatgaagagcccaatccacgtctattacctgattgacggcttctatcaaaaccatcgaaggtatgtgagaagtcgaagtgacaaacaactgcggtataagagcgctgtacatttgatatcggattgtgtgcctgaaggtaagaccgctgatggtgctccaattgttccatgtggccttgttgcttggagtttgttcaacgacacatatacagttcgggtcaatggggtggttgctcaagtgaacaaaaaggacatagcttggaagagtgacaagaacaataaattcagcaataatatctatcccagtaacttccagaagggaagtcttataggtggtgctaagcttaatgagagcataccgttaagtgagcaagaagatctcattgtttggatgagaaccgctgcgctcccaactttcaggaagctgtatggaagaattgagaaagatatcaatgcaaatgataatgtaacagtggttatacagaacaactataacacatatagttttggaggatcaaaagcgttggtcctttctactgcatcttggattggaggaaaaaacaatttcattggtattgcatatctgactattggtggtctgtgcctttctcttgctatgggcttcttagttctctacatgattaaacaaaggacctttggagatcccacgaacctgtcatggaatagatgataa

SEQ ID NO: 275 - DNA, 896 bp, Hordeum vulgare
atacgcccacactcactacttgcctcgtactgtgtcctataccacagctccgaaaagactgccaaggggctccgtcgtccatggacgtgccgaccgctggtgaagccgccgctgtgccgcagcgcacggcgtgggagtgggagggccgggcggtgtcgccggtgccggcggcgacggcggacgaggcgtgggcgctgctgtcggacttcctggcgttccacaagtggcacccgcgcgtggcggtgtgccgcctggcgtcctccggcgcggcggcggcggcggcggcggcggcgcccgggtgcgtccggtactgcgagggcaccccgcccgccgacgggacgcccgccgactgggcgcacgagacgctcctcgagcacgaccaggcccgccgcttcttccgctacgagatgaacgacaacaacatgggcttcggcgccttcttcgccgtgttccgcgtcgtccccgccgcggccggcgggtgcgagctgcggtgggagttcgagtgcgagcccgtgcggggcacgcccaaggaggcgctcgaggcgcggctgcaggccgggctcgacggcatggccgcacgcgtgcacgggcacctcatatccgcgcgcggtgccgtcgccgccgccgggactgcggggctggaggccgccgatgagctcaagctggacaactccatcgcggcctgatcgagctccgagcactcgatgtgcatgccaggcccggttccacctctgtgcgcacgtaccggcgacgtatgtttggttgtgatggtctcgttcctttctcgcggtactacgttgtcggatgatattttatctttgttctgttctgggcctttgttggtttgccgttatgtatgtgcgcgtacgtaccgtttactacagtgcggcagttag

SEQ ID NO: 276 - DNA, 1188 bp, Hordeum vulgare
gttcgctactggcaacattcacgcctgcgcttccgtcccgtgacttgcctggccctgcctctgcggctgcgagcttcggtccgccatggcgcaaacctcatcgattccccgcgtcagcctcggcacccaaggactggaggtgtctaagctggggttcgggtgcatgggcctcacaggctcgtacaactcccccgtcgaggacgacgccggcgtcgccgtcgtcacgcacgccttccgccgcggcgtcaccttcttcgacacctccgacgtctacgggccccacactaacgagatcctcctcggcaaggcgctgaagcagctgccgcgggagaaggtgcaggtggccaccaagttcgggatccagcgggacgcccagggcaagagcaccatctgcggccgcccggagtacgttcgcgcctgctgcgaggccagcctccaccgcctcggcgtcgaccacatcgacctctactaccagcaccgcatcgacaccaccatccccatcgaggacacgattggtgagctcaagaagcttgtggaggaggggaaggtcaagtacattgggttatcggaggcgagccccgacaccatcaggcgtgctcacgctgtgcaccccatctctgctgtgcagatggagtggtctctgtgggcacgcgacatcgagcccgagattgtgcctctctgcagagaactagggattgcaattgttccctacagcccgattgcccgtgggtttttcggtggaaggggagtgacacaacaagtgtctgctgaatctagtctgaaaggccatccacgtttttctgctgaaaacctggagaagaacaagcaactttatctgaaaatggaagaactggccaagaagcaccattgcagccctgctcagctagctttagcctgggttctgcatcaaggggatgatgtggttccgataccagggacaactaagatcaagaatctagactccaacattgactccttaaaggtgaagctcacagaagatgacctcaaagagattagcaatgagatacgcgaagaagatgtggccggtggaaggcaatatacttcatttgcgaaattcacctggaattatgcagatacgccgaagaagtgaaactaaaaaagattgtggagacagtgatatgtgcgagcaaaacatgccatgatatctgctactgtgatgaatggtgc

SEQ ID NO: 277 - DNA, 576 bp, Hordeum vulgare
gggcgaatctcttcagtatgagataaaccaacgcttatcaccatccctttcccccactctccagcctccacccttccgacgaaacccccgcccctctccccaagccaaagccctagccaacgggctagcgagccagccaggacctccctccgtagatctctgctctccgggcgtgctcgcggcgccgatccggcgatgacgaccacggcgaagctcggggagctaatgtgggagcaccggctgcgcgcggcggcggcggtggcgttcctcgccgtcgccgtggtgtcgatctccgccgtcgggcccaggctcggcgccgtggtctccttcttctggccgctgctcgtctccacgggcttcttcctcgtggccatcaccgtgctgctccggatctcgccgccgcccggcggcgccgacgagtccggcaaggagatcatcgacttcgtcgccggatgccgccccgagcacctcctcccggaggcgtccgccaccgtggaggtgccgccggagccggagatctgaagagccgagcaggaggtacgcgcgcgcggccgcgagatgaccttgttcgcttag

SEQ ID NO: 278 - DNA, 1658 bp, Hordeum vulgare
gcagttgtaaccaagtggcagcagtagatagagccatctatctatctctctctctacagatcgcggctaggagatcagcgagcgcgctccctttccggatcaatctcgtccgagaagatagcaggccgtacgggagcagcaagcaaggggggaggaggggaggccatgatgctggagggcaaatcctgcctcgtctcgcgctccctgcccagctactgcgagccggagtccgagtgggcgttcctcgcccgcgaggtctccgtcatcagcggcggcaagcgccccgcgccggaagacttcggcgcggaagacatggaggaggcggacggcggcggcggcggcagcagcgggaagcgcagcaagtcgccttccccgcagccgcacacgccggatatcaccgagagccacggctccagccgccacgcctcctcaggcggcggaggtggggagcagcaaggctctggggccaatcttattggtgagattggtcgcgacctctccatcaactgcctcctccggctctccaggtcggactatggctccgtggccttcctcaacagggacttcaactccctggtgcgcaacggggagatctaccgcctgcggcggcagaatggcatcgccgaacattgggtctacttctcctgcaatgtcctggagtgggacgcctatgacccctacagagagcgctggatccaggtgcccaagatgccaccggatgaatgcttcatgtgctccgacaaggagtccctggccgtgggcaccgagctgcttgtctttgggatggcacacattgtgttcagatatagcatcctgaccaattcgtggacaagggctgatcccatgaactctcctcggtgcttgttcggatcaacaagcgttggtgagaaggcctatgtcgctggaggcaccgatgcttctggaaagatactgagctctgcagagatgtatgactctgtgacacacacttggacaccccttcccagcatgaatagggctaggaagatgtgttctggtgtgttcttggatggcaagttctatgtgatcggtggtgttaccaacaacaaccaggtcctgacatgtggtgaggaatatgacttgaatcgggggtcatggagggttattgagaacatgtctgagggcctcaatggagtcactggtgctcctccactcattgcagttgtcaacaatcagctctatgcagctgattacagtgagaaggatgtcaagaagtatgacaagctgaataataagtggatcgctcttgggaagttgcccgaacggtctgtgtcgatgaatggatggggccttgctttccgagcctgtggtgaccggctgattgtcattggaggcccaaggacttctattggtggcatcattgagcttaattcatgggttccggatgagcaaccgccggtgtggaatttggttgccacacggcaatccgggaacttcgtgtataactgcgccgtgatgggttgctgagtccactgaataaagattggatgcagtggatatttatgaaggatgatagtatgcacaaaggcggcctgttcaattgctccagccctgattcttcgtagcgatttatgccttctgcccggtttcagactttaactggacatctgctgagcggcagcactcatgtaacccttgag

SEQ ID NO: 279 - DNA, 1727 bp, Hordeum vulgare
aaaggatccgcaagagtgcgtccatataagcccatatgttgcactgcctggtgacctcccatctgcatcttcttcttccaatccaagccaagccatggattccctctactgcttcgtgcagctcctctccctcctttgcttcttcgtcttctactaccgccatctccagtccaagaaaataagcaaggcggagccgaccgaatggccgatactgggccatcttttcggcatggtcgccaacctctcccacttccatgactgggccaccggcatcctcaccggcacgcgctacaacttcgaagcgcgcgcggggatcaccggcgtccgcttcttcgtcacctgcgaccccgccaacgtgcgccacatcttcacctccaacttcctcaactaccccaagggccaggacttcgccgacatcttcgacgtcttcggcgacggcatcttcaacgccgacggcgactcctggagccgccagcgtgccaagtcccagctcatcatggccggccctcgcttccgcgccttctccgcgcgctacacccgcgacaaggtggagaccagcctcctgcctttcctcgcgcacgccgccgacgccgggaccccctgcgacctgcacgatgtcttcctccgcctcaccttcgacatgacctgcaacctcgtcttcggcgtcgaccccgggtgcctgcaggtcggcctccccgtggtgcccttcgcgcgcgccatggacgacgtgctggagacgctcttcctccgccacatcatctcccccgcgtgctggaagctcatgtaccgctacgaggtcggcacggagaggaagatggccgcgggtcgccggaccatcgaccggttcgccgccgacaccatcgccaaacgcagggccgaccacaagctccgcgacgagggcgtcaccgactcgtccgacatgctctcgtccttcatctgcaacggtgacgccagcgagtacagcgacgagttcttgcgtgacaccacggtgaacctcctgctcgccggccgggacaccaccggcgcggcgctgtcctggttcttctacctgctctccaagaacccgcgcgtcgagcagaagatcctggacgagctggcgcccatcgcttcccggaagaagcagctggccggcgacatggtggtgttggacgtgagcgagctgagcggcatggtgtacctgcacgcggcgctgtgcgagtgcctgaggctgtacccgtccgtgcccttcgagcacaaggcggcggtggccgacgacgtgctcccgagcgggcacgagatgaaggccggcgacaagatactcatcttctcctactgcatggcgaggatggagggcgtgtggggcaaggactgcatggagttcaggccggagaggtgggtgtacgccgacgggaagctgaggtacgagccgtcctacaagttcatctccttcaacgccggcccgaggacctgcctcggcaaggagatggcgttcgtgcagatgaagaccgccgccgccgccgtgctctggaacttcgccgtcgaggccgtgccaggacacgtcgttgagcccaagctgtccatcattctccacatgaagaacgggctcgccgtcaccgtcaagaggaggaacgtcgcggccgtgcatggctagctagtacgtgcctgctgtgcctgcacttctcggccgcaaggtatacggggcgtacgtacgtagctacacgtagcggacacgtacatacggtaccttt

SEQ ID NO: 280 - DNA, 3983 bp, Hordeum vulgare
tttgaattcattcggcgacgctgctcgccatggccgggatcgacgacggcggggccgccgcgcagctggtgcagaagctggcaatctgtggagttccagaagagcagcagcatcaagaaggcttgctcgtgtatttggaggagcacaatgataagattcctcagatcacggcggccatcttgtcagcaggcacggatttaatggagtccggcaactcatcgaaggataaagatgacagtagcagcagcagcaatgcatacagtgagagtatgttgtggttgcagtggatgatgttcggcagaaatcccgatgcaatgcttcatgacatggagcttagctccgaggatgaccgcgctgtttgcggcactgtatgggggcagaattgccttgcttaccgctgccggacctgcgagagtgactccacatgcgcaatttgcgttccatgcttccagaatggcaatcacaaggatcatgattactccatcatggaaacaggcggtggatgttgtgattgtggggatgctactgcttggaagcctgaagggttctgctcgaggcacaagggggccgaacaaattaagcctcttaccaaggagcttgcgagttccgtagggcctgtgttggacgagctcttgctgttctggaaggagagtatatgtgtgcctcgtgaaaagtcagatgattgcaagaagagggttgcccgagagttgacgatttctattgctgacatgctgcttcgcttctgcgcgtgtagtgaaagccttctaagttttgtgtcccaaaggatccatgagtgccctggtctactggatgcattgatgagggcagaaatgttactggacaagaaagttgtggaaaaattgcatgagttgctgttgaagcttatcgctgaaccggcttttaagtatgagtttgctaaagttttcatacagtactaccctgttgcattttctgaagttattgaagggggcaatgactatgtgctggaggagtatctgctgatacagaacttttctgtccaaatatttaccgtgcctatgctgactacaatgcttgtgcgcgatcacaatttgttgggtattcttcttgaatgtttgacagctctgtttctttcttgcgttggtgaggatggtcatttacagaccagcaaatgggtaaatctgtatgatgcttctattagattgttggaagatgcacgctatgtcctgagacatgaggaggtttctatgtatgttgcttctgagagacctgatctaacaaggtcatggattaagctgttgtcacttgtgcaaggaatggatcctcagaagagagtgacgagtattcatgttgaagatgagaatgagaatctatatgcgccttccacgctaggacattattttgggatcattcacaatcttttgatgaagggagcattttcttctcctgggcaacaagaatcaactgattttactgtatgctccattgcgacaaaaggcatcgaaagtgctgagaaccagcggcttgcaaaagttggcaggatctcccaggagaactcggtatgcaatttaagtaccagaaagagtttttcgagcagtaaattaccatcacctgctgcctgtttaattcgtcagtgcttggaagctattgatagctggctggaacctggtccgctgaggagaaagtcgttgtccgttgatgctatcaggggtggatccgataaacatattggtgagatgggcatgaaggtaaatgaaggatcccaactagacgatgttgcagattattatgaagtaattgatcctcctattcaagaacccgacaacatggtaatgataggtaaaggggggatgcctcacgttggtaacgtcacaggcaagggaaagatgcaagaaactagcagtgtaccggatgtacaattgcactctgaaaatttcattgctgttgctctgaccgatggcagccttttatatgctcacccagattcaagaactgatgaactaggaatactcaacatgacaagctggccacgtgttgtctttgatgtcacttcacaagaaacgtcttttcatattcctttacaccgtatgctttcattactattgcgtgaagcaatgaagaaatgtttcggagaggatgccaaaacagaggaatgttcagttgtgcagtccaatgagttcttctctcaggtacttggaggttgtgagccttgtgggtttgcttcagttgtgatggagcatccattaagattgagagtattttgcgcacaagtgcgtgctggaatgtggcgtaagaacggagatgcagctgtacttagtgctgagtggtaccgctctgtgcaatggcttgaacagggcttggagtcggatttgtttctgcttcaatgctgtggtgcattatcttctccagagttctttgtgaggaccattcaagaaagatttggtttgtcagattatacatctatggatctcacggaacagaatgagtatgaatcagttcttatacaagaaatgctaacttttcttgtgcaactagtcaaagaacgcagattttgtgggcgtcccacagcagacaacttgaagagagaattgatttataagttggccgttagagatgccactcatagccagattgtgaagtcccttccccgtgacctttcgtcaagtgaacaacttcaaaatgttctagattcactcgcagtttattctgatccatctggaaagaaaaagggcaagtatgtgcttcgcgaagcattctggaaggaattggacttatatcacccgcgctggagttcgatggaattagagattgctaaagagagatattaccgttgttgcaaagtttctgctcttggcgctcaactacctcaatggactcatgtttttagccctctgcgcagtatttctaaaattgccacctccaaagctgtccttcaaattgttcatgctgttctcttctatgctgtttacaccgacacatcatcggtatcacgtgcccctgacaatgttctcgtgactgctctgcacctgctttcgttggcacttgacatatgtgaatcagagagtcaaatgtctgcggaccagtatgggatggacttagtgcagcatgatgatgaatcatgggttgttctgtcatctgatgcagtagaggcttttcccatattgacctattctacagaactagtctccccagagtctgacaaactaaagaaggaaagcatgataaccttgcttgtttcactaatgcacaaggaaaagaatgacagcaccttttctggatgcaatattccatctctagttgaaagtttgttgaagagatttgccaagttaagtaagcagtgcatgtctgcagtaagacaaatggcaccacaagtactcccatccattcctgagcatgccagcgccaaacagaatttaggatctccagattcgacgggaaacagccaatgcgaagctacaatcatggcaaaaatgggagcagagcagtcaaaacttgctgaaagtatgaagtcgtcaggaaatgaagggcctgatgttccaacatttgagccagatgcacctagatcaactgccatcgagatgcgaccattttgctctctttgccaggattcggattccaaaagtccactctgctgtttgattcgccttcaggctgctctggaaactatgacggcagagactgctgaagatggtcagaccccaagatcagttgcagagttcgcttccaacatactctcccatgtcggttccacaggctcgttgaagtcgccagctgttgaagttcttgaggataaactcagggcggaaagacggggtgcggccgcgctccgagaagaaatcgacgccttgaagaagcaggcagaaaaggccgacgcggtcatcgccaaaacccaacaagagatggaggaagtcaggaagaagcaagccgagacagaccaggttcttcagcttctcctgcgcaggtctcagggtaaccccggttcttagtctctgtaaaggcctaaa

SEQ ID NO: 281 - DNA, 532 bp, Hordeum vulgare
cgtcttctctgaccccgagaccaaaacgcaccggcgtcggagcggctgcacgagggcggggcccaacgccggcgagcggtggcggcagcgtgctcgccaccatggacgagcaggagtttcggcgcatgctcgatctctaccccgtcgttcggtcccgcgactactgcaaggatgaattggaatcatcaagcaaaggcaccacacagcaagagcaagctcaggagataaaaggaaccaaaaagaaggctgcagaagatctattcctgcggaaattgaagatggctgctgagaaaaaggttggagcaacaaaggcagaactattctgcaagacattcgaagaagctcatgagaaacttgtttacaaagaattggatctggatgctgctcaaaggttcctgagtgcctacaagagttgatgatgaactgttgctagatgcctaaaagatttgatttttattcatctgaaactgctgaaggtgtgatgacgttaagatttctgatatttcctttgtggttctcatcttctgcgaat

SEQ ID NO: 282 - DNA, 1659 bp, Hordeum vulgare
tacccaatcacggatctctagcctcgccaccgcccgctgctccgctctgctcctaatccccctcgcctcgccaccgtccgccgctgccgctgtttcttgtgctgccgccgcgtccaggaggaggaggaggagatgaaggagatgatggtggggtcggtggcgccggtgggcggggtcgggaggtggggggcggcgccgccgcaggagctgctggagcggatgaaggactacggccaggagggcgccttcgcgctctgggacgagctctcgcccgaggaccgcgacctcctcgtccgggacatcgagagtctagatctttcaaggattgaccggatcattcgacgctctatgggatcacaaggctatgtggcgcccgccgagcccgtgccggaatccagcgtctcgagggtggaggagaggtctcccgaggacaaagaacggtggtggaagaagggtttgagagccatctccgaggggaggctggccgttgtccttttggctggtggtcaggggactcggcttggtagctcagatcccaaggggtgtttcagtattggacttccatctggaaaatcacttttccaactccaagcggaacgcattttgtgtattcaaaagttggctgctcagtccagtgatagtccaagaaatactttaccaatccactggtacataatgaccagccccttcaccgatgatgtcacacgcaaattctttgaaagccgtaaatattttggcttagaagctgaccaggtgacctttttccaacaaggcacccttccatgtgtttctgacgatggcagatttattatggagacgccatacaaggtagccaaggcacctgatggaaatggaggagtttatgctgctctgaagtctaagaagttgcttgatgatatgtcttcacggggtgtaaagtatgtagattgctacggagttgataacgtattggttcgtgttgcagatccaacgttcctagggtactttatagaaaagggtgtatcttctgctgcaaaggttgttaggaaggcttatccacaagagaatgttggagtatttgttcaaagaggtcgtggtggacctctttccgtggtcgagtatagtgaaatggatgcggctatgactactgaaattaatcaatcaacaggacgccttcgttattgttggagcaatgtatgcttgcatatgttcagtttggaatttctgaatcaagtcgcaaacagccttgaaaaggacagcgtgtatcatcttgcacagaagaagataccttcgattcatgggtatacaatgggcctgaagcttgagcagttcatattcgatgcattcaattactccccgtccacgacactttttgaggtgctacgtgaagaggaatttgctccagtgaagaacgcgaatggctcagcctacgacacccccgatagcgccaaactgatgctgctccgactccacagcagatgggtagtcgctgctggcggcttcctgacccattctgtgcccttgtacatgacaggcgtcgaggtttctccgctcagctcctacgccggagaaaacctggaggcgatctgccgcggacggacattccacgctcccagcgagatctcattctaggcgcatcggttcatcatagcggcaggaagaagcagtgttgcacagtag

SEQ ID NO: 283 - DNA, 732 bp, Hordeum vulgare
cgtgaagaaacacacaagaagggaggagaggcagcacgcaatcagccagcccagccagccgctcgccctcgccgccgcccaattgacccgatcgaggagcctcccaggcccagcgaaggggcagaggcagccatggccaccgccaacctgtccagcgtggtggtggcggtcgacggcagcgaggagagcatgaaggcgctgcgctgggcgctcgacagcctgcgcctccgccccgacggcgcgctcgtcgtgctccacgtccagccgccgcccggcatcgccgcgggcctcaaccccggccccatccccttcggcggccccagtgtggcggaggtgccggcgttcacgcaggccatcgagtcgcaccagcggcggatcacggaggcgatcctggagcacgcgctcaagatttgctccgacaagaatgtggaggtgaagacgcaggtggtggtgggggatcccaaggagaagatctgcgaggtgacggccgaactcaaggccgatctgctcgtcatggggtgccgtgcttttggccctgtcaagaggatgttcttgggcagcgtgagcaactactgcatcaacagcgtcggctgccccgtcgtcgtgatcaagggcacctgacccatcctccaccaacaaacattcgttgttgcgttccgcatcatgttttctgaggttgccaccgtgttgttgtgtccactcctgtgcaaattcactgcacacttccaatag

SEQ ID NO: 284 - DNA, 812 bp, Hordeum vulgare
aggccgatgcccccaatggcagcgtccctccgctccccgccgcccgtgcccgccgccgccgccgccttccgccgctcccgcgccgccgtcgtcgtctgcgcctcctcctcttcctcctcgtcctcctcctccccctcgaccgtgtcgtccgctcccaaggcgcgcttcgtcgcccgccgctccgagtccacctccgtccagcagctcgcccgccccctcgcggagtacatgggcctgccggcgagccagtactcggtgctggacgcggagcgcatcgagcgcgtcgacgagtccaccttccgatgctacgtctaccgcttccgcttcttcgcgctcgaggtctgccccgtcctcctcgtccgcgtcgacgaggagcccaacggctgctgcatccgcctcctctcctgcaagctggaggggtcgccccttgtggaggcgcagaatgacaaattctccgcttccatggtgaatagggttttctgcaacaacaattcagatgactcgacgcttcaacagcttacatcggatgctacaatcgaggttgcaattgacattccctttccgtttcaagcactaccagttgaagctattgaatcaagtggcaggcaagtgcttgagcagttactccgagtcatgcttccacgatttctgaagcagcttgataaggactaccaagcttgggcttcgggcgattcttcacggaaaccgcttggcaccggcgaaatatgaagctgacccgtatattcataggcgtaacaatagtgttttcttgtttgatctagttaatgtgctcgcacatgatccacttcctc

SEQ ID NO: 285 - DNA, 1647 bp, Hordeum vulgare
gacaaccatctgactaagcagcagcccatggcgccggcggtggggatcaagcggaccgccgcggcgcagacggtcacggtgcaggcgccgccgccgcccgacgcgcggctggtgcgcgaggccgtgcggacctccacgatcgccggggccgtcgcccccgcggccctggaggcgcccgcgcccgcgctcgagggcttcctgtgcctcgaggaggtggacgggaggcggtggaagtacgtggtggatgcggcccccgggaaggcgaaggcgaaggcgaagggcaggggccggggcgggtccgccgtccccctgggggcctccgtccgggccgtgccgctccagtccccgcttccgcccgccgaggaaataatggcatttgtaagatcgtatgttgtgcctgaagggtttccagacagtgttactccttcatatgtcccgtacatgacctggagagctctcaagcatttctttggtggagcaatgggggtgttcacaacaagaaccttgctgagctccgttggagtctctcaaagcaaggtaaccccaggtgccattgctatcaactggatcctcaaggatggtgctggacgtgttggaaaaatgctttttgcacgacaaggaaagaagtttgacaatgacctaaagcagctccgcttttctagtgatctcttgctggagataggcgctgggatagagttagctactgcggcattccctcaatttttcctgcctatggcttgcgttgcaaatgttgtaaagaatgtcgctgctgttacatcgacctcaactcgcactccaatctacaaggcctatgcaagaggagaaaatattggagacgtgactgctaaaggcgaatccgtggggaacattgcagatctgctgggaacgggtttgagcatatttatcacgaaacggaacccatcgttggtgacttcatttgcacttctgtcatgtggatatctcctgagttcatatcatgaggtgaggtccgttgtgctgaataccctaaacagggcaagatttactgttgcagtggattcctttattaggacagggtatgttccctcgttgaaggaaggaaactcacaggagacaatatttattcacccttggcggcatgagccagtttcaataggatcgcgatttggagaagcgtttcaagaacctgtttcgtttgttgccacaaggcctttgtttgaggatgagcgatacatggtaacatataacccaacgaaggataaagtatatgctttgctcaaggaccaagcaaagccagatgacattctcaaagctgctttccatgcccatgtgttgctgcatttcatcaatgtatcacatgaacggaagagaatgagctccaatcgatcagatcactacgggaacccgcacccacggaacatggatttcctggcacacatcgcagaatcttgcaaaattgtatcgtcatcttatggaacattcaggaagaaagcaaaagaacagggttggataatgtcggaatcgcttcttaaccctggaaaggctcggttatgcgtcacgagaccgcagtgacttcactatttccgtgtaccatcgacgggatgataccatctctagctgtcaggctaactttttcgacgaagacgggacatgatgctgatgagtttg

SEQ ID NO: 286 - DNA, 1189 bp, Hordeum vulgare
ttccatttctgttggaggtttgcgatctgggggagatcgaatcctcgcctgcggcgggtctgccgttcgagttcatggccacctcgggcgatcagtcgggcggctgcgggtcggcggcggtgaagggttcaaagctgcggtaccctctgcggtccgcgggccgggtcaagctggagccgccggcggcggcggatgcccctcttagcggctctgcttcgcgaagggccaaaccatctttagatgtcaccaagagctgtgctctcgatctttctgccgtgaaggataaatcagctaaacctccgcggaggcactcaataccaacaaagccaggtgttagtccgaggcctactcctactggaactattactccagtgtcaggggttcgaccgaggaggtcagagaggttggataccccaacatcagaagcatccatgtctacagcaaggcgcaagttcagtacactctcctcagtctcatattggatgacacagattaggcttgcagaggctgcttccaagcactctatctctctgggcttcttcaagctggcccttgagtcagaatgcgagcctctggatagaatgagagaagaactcaaggcttatgtggcccggcatggccttgcaacagaattggaggagccggtgaaggaggttcttcaggtctatgatattgtggaagattttgagaagctaaagatctccctggactcttcacaagagccaaaaaagtctgacaaggctgctgttagtgctaccaatgtgactccaaagggtaatctgaaacctagatctctgaactctgttgcagctcatagtaaagatggcaagaaagagaacattcagaaggagaagcctgatgccaaaatcagaggttcctacaaccggaatccagccaagaatgctcctgcaaaagaaggtgccaaaaataccggcaagaaaaccaagaagcaggctaaggagcagcaagaagattgcaatggaggtagtgaggtttcgccagttgacgcagaccaagaatctgttgatgtggtgaaggagatcacatatgaagataaggagaacatgggggatgctgagatggcaatagacgctggcaacgccgtagcccaagaagtctagaattgacagactgacttcagattcaaaccttttgtttgctgaatatgaagtatcgagtgtggtgcttg

SEQ ID NO: 287 - DNA, 800 bp, Hordeum vulgare
tagcagaatccacccgctatcctatcatggctcctcacgccgctgtcctcctctccctcctcctgctcaccacctgcgcggcggacacgcatctccacttcttcctccacgacgtggtctccgggagcaacccgacggcggtgcagatcatcaagggcccggcctcgtcgtccaacgccttcccgggcatggccttcggcgacacgaccgtcatcgacgacgcgctgacggagacctcgtcgccgacgtcggcgcccgtggggcgcgcgcaggggttctacatgatgtcgtcgcagtcgggcatggtgctgatgatgtgcgtgaactttctgctcaccacgggggactacaacggcagcacgctcgccgtcatcggccgcgacgacatcatgaccaccacgcgggagctctccgtggtgggcggcacggggaagttccggatggcgacggggtacgtgctgtggaagaccaacagttcgaaaggcgccgacgccaccatcgagctcgacgtctacaccaccgccctcaacggcaccaccaccatcgacgccaacgcgccagtctcccccatcgacgggggcggcggcggtacggccggcggggccaccgggaagtcgtcatcgggcgcggcggcgctgaggggagcagtaccttacgggtgggccaacgcgtgggtagccgccgtccttgtagctctggctggttgcgtttggtgagcagctcgatttcgatacaccatgaatctgagtgggtgcgagtggggtccatacatacaacggaatagatcttgattgggcgtg

SEQ ID NO: 288 - DNA, 873 bp, Hordeum vulgare
aaagaattccacaagctatccagtcacgcgtccgcgccgcagatgtcgcctccggcaccatgccagctcctcggcgctgagagcgcccacgcgacggcagagccattccgcgtgtacgtgggctacgactcccgcgaggacatcgcataccgcgtgtgccggcgctcactgctgcggcgctcctccgtgccgctggaggtcatcccgatcgtccagcaggagctccgcgaggccgggctgtactggcgggagcgcgggccaacggagagcacggagttctccttcacccgcttcctgacgccgcacctcgccggctaccgcgggtgggcgctcttcgtggactgcgacttcctcttcgtcgcggacgtggcggagctggcgcgcatggccgaccctcgctacgccgtgctctgcgtgcaccacgactacacgcccaaggaggccaccaagatggacggcgccgtgcagacggcgtacccgcgcaagaactggtcatccatggtgctcttcaactgcggccaccccaagaaccgcgccgcgctcacgccggaggccgtgagcacccagagcggggcgcatctccaccgcttcgcttggctcgacgacgccgacgtcggcgaggtgccattcgcgtggaacttcctcgtcgggcacaacagcgtggacccggcggacgtgggcgggaccgcgccgcgcgccatacactacacgtccggcgggccgtggttcgagctgtacaaagactgcgagttcgccgacctctggatccaggagcgcgacgcgtacgagtcggaggagaaagaaggcgaggtggcaggcacaagagtgccatcatcgtctgcagttgctgtggacgcatgataaaggcctaaa

SEQ ID NO: 289 - DNA, 819 bp, Hordeum vulgare
ctggatcgacgatgatgtggggcgtcgcagccgccgtcgcctccgcggccgccgtcgccgtggcctccggcgccgagctcctcgcctgcgactgcgccccgacggaccccgccgccgccgtcgccgtcggcagatgcgacgacttcctcctccgccagcgggaacccccgtcgtcgagcgcggggagcggcgtcacggacgacaagttcgcgccgcggttcgacggcctgcgcttcatcgagacgctcgtcacggcgcaccgctgaaacccccctgttcctcgggggattctttctcttcgtgcgattcgcggggagatgcgagcgagctgctaccctattaattcggcgattggcggccaacgcgccgccaaatttttgctactaggacaaattgaggttttttcgtttctttttctcttcctttgctgatgacgattatcgtcctattgttgttgagtgatgcgattgaattggaaccttcaagtatgtgatgattgtgtgtaccagtgccagtaccggttctttacctgatccgtcgtgcaagcatggtattggtatgctatgatttcacctccaaactttgccgttctcatgtgtggtaggtctgccgtcctctgtttgtggttggcctcgttccgggattgtcctttcccctctttgctgcacgcgtatcacatggctcaatgcttggagtgcatcctgtccatggattttggggtaaaattagcagctagagcacctcgatgtatgttaatgattactgattctgctcggccaaattagtggctccttgccgtccatgtctgcttcctgattt

SEQ ID NO: 290 - DNA, 2104 bp, Hordeum vulgare
cggccatagaaaggagataaggagacgaaggaacgaaaataaaagaaataaaggctggaggcttttggcgctcataatttttggcctctctctgcgctccccggggagattttccggcgctttctctctttctttccgggtggtgggagagaatccagcctctgaattcgcagtttctggttcacagcgagagagtgttcttgagtcggtgttgatccaatgggcgagatgaaccaccagccggggcagccgccggtgggcgtgccgccgcccatggggatgcagcccatgatgaacgcgccggtcggcgcgggcgccatgcaccagccctacgagcagttcaaccaactcaactactgcgtccactccaatccttcttgggtgcaggtggcagggcttgcattcctccactacctagtgatgttgggctctactgtcatgcttgtgtcaactatagttcctgcaatgggtggtggtcctggtgagaaggctcgtgtaattcaagcgttcctgtttgtgagtggcattaatactatgctccaaacactcgttgggacacgacttccaacagttatgaatgcctccttcgcatttgttgtcccagtgctgtcaattgccagacagtttgacccaaacgactttggcagtaatcacgagagattcgttcacacaatgagagcaactcaaggggctctgattgttgcttcaatcctcaacatgattcttggatacagcagagcatggggggcatttgccaagaaattcagtcctgtaataatgactcctgttgtttgtgttgttggtcttggattatttcaaattggctttcctcaggttggaaaatgtgttgagattgggttgccaatgctaattcttgcaattgttgtgcaacagtatgcgccactttacttcagacatatccatgatcgaaccaccttcttgtttgagaggtattcgttgcttctttgtatcggcattgtgtgggcctttgcagctatccttactgctgctggtgcatacaaccatgtttcactcaagacacaacagcactgccgcactgacaagtctttccttatatcatctgctccatggatcaaaattccataccccttccattggggtccaccgatcttcactgcaggtcattcatttggaatgatgggtgctgtgcttgtttcatcttttgagtcaactggtgcacactttgcaactgcgcgtctagccggtgcaacaccacccccagctcatgttcttactcgaagtattggtttacagggcattgggatattcctggcaggactgtgtggtgctccagccggttcatctgtatcagtcgaaaacatcgggctacttggattaacaaaagttggaagtaggagagtgatccagatatcaactggcttcatgctattcttctccatatttgggaagtttggggcgttctttgcgtcaattccgttgccaatcttcgcagcaatttactgcatcttgttcggtatcgtagctgctgtgggaatctcgttcagccaatttgcaaacaaaaactcaatgaggaacatctacatcatcggactatccttgttccttggcatctcgatccctcaatatttcgccgagtacaccgcttctgctggccgtggacctgcccgaacaaatgcaggatggttcaatgacatcatcaacacagtttttgcctccggcccaacggtggcgctgatcgtcgcgtcgcttctggacaacacgctggacccccgggccaacgaggccgaccgggggctctcatggttcacaccctttctgcgccgccgtaaagggtactcggaccctaggaacgaggagttctacagctacccgatccgggtccacgacctgatcccgcaccggtttctctgattctagaaggaccgctgctaattatcctgtgctgctgtgcgtgcatgtaaatcccctttgttctttttagccttttaccctttgtggcctgcagcgattggtgcagtcacagatttcaggttagttggatatggtacaaggagtcaacgatgttagtactttcgtcgttgccgttgttggccgtttgggccaaggagtggttgacgtagag

SEQ ID NO: 291 - DNA, 431 bp, Hordeum vulgare
ccaagcctaagaaaccacacagctcaaggaagctcttgtttgttagtcatggcgatggcgctcggtaagcttgcggtggccgcgttggtggcgtctctccttctgctcagcaccatcaaggccgccgacttccctgctccagctgctgctccgctcggcccccctccccacaacatcgtagacccctctaaagactgcgggtgggcgtgcaacctgcggtgcagcgccaactcgcggcagaacctgtgcagccgggcgtgcctcaagtgctgcagtgtgtgccgctgcgtgccggcgggcacggccggcaacaaggagacctgcggcaagtgctacaccgactggaccacgcacggcaacaagaccaagtgcccctgaatatcttcggccggcttaaatatcttagtagagtagctaagatttgctcgtgg

SEQ ID NO: 292 - DNA, 1094 bp, Hordeum vulgare
ctaggcctcgaatggcgtaccagcttctgtccaccgtcgcgcaccgcgataccctcccggagggttacacgcggcccgagaacgaccgtccgcagctcgccgatgtggtgacggacaccaacatccccctcatcgacctcgcgtcgctagacaagcacagcatcatcgccgagatcgatcaggcctgccgcacctacggcttcttccagatcgtaaaccatgggatatcagaggagctgctggagaaggtgatggctgtgggtctggagtttttccggctccccccggaagagaaggcgaagctctattctgacgagccatccaaaaagataaggctttctacaagcttcaacgtccgcaaggagacagtgcacaactggcgggactacctacgccttcattgccacccgttggaggagttcgttccagactggccatccaatcctgaaacgttcaaggagatcatcagcacctactgccgcgaagtccggctgcttgggctccgactcctgggcgcgatctccctgggcctgggtctcgacgaggactacatcgagaaagtgctgggcgagcaggagcagcacatggccgtgaactactacccgcggtgccccgagccagacctcacctacggcctccccaagcacacggaccccaacgccctcaccatcctcctcatggacccccacgtctccgggctgcaggtcctcaagggcggcgtccagtggattgccgtcgacccccggcccaacgccctcgtcgtcaacctaggcgaccagttgcaggcgctgagcaacggcgcctacaagagcgtctggcaccgcgcggtggtcaatgcgtcgcgggagcgcctgtcggtggcatctttcctgtgcccgtgcaacagtgcggtgatcggcccggcggccaagctcgtcgccgacggggacgagcccgtgtaccgcagctacacctacgacgagtactacaagaagttctggagcaggaacctcgaccaggaccactgcctggagctcttcacggatcagaattgatccgcatgcacaagcttgcctcgtgtacggttgggtgactatctgcttgggttgggttag

SEQ ID NO: 293 - DNA, 1704 bp, Hordeum vulgare
tcagaaatcctacccggagcggagagcggagagcggagggagcgcccgctcgctcgtcgtcggtggtggtggctccgccctccccctccgcgtcgcccaggtgttagctggtaaaatagaaggggaaaggcgctaccatgggcatttcatccaagtggatcaaatcacttgtcgggataaaaaagcatggaaaagctcagaatggtgaaagcagcagagaaaggagctctgccgctcaggtgctacacaaacggaagcattccgtggatactgaaggtgcccttgcagttgcagaacacacagtgcaaactgaaccattggctagtgacaccaatacacagacagtttcatctcagactgaactaaatacaaaggagcatcaggctgcaacagttattcaatcagcctttcgagcattcttggctaggcgagctttacgggcattaaaaggattagttagactccaggctctcgttaggggccatgctgtacgaaagcaagcagcagaaacacttcagtgtatgcaatcactagtaaaggctcaagctcgtgtcagagcaagacaggttcgtattggtttggaaggtcaggtgacccagaagaaggctcctgaacaaaatgctcacgatgatcatgctcgagaaattgaggaacgctggtgtggcagtattggctcagcggaagatatgcaagctaaagtattgaaaaagcaagaagctgctgctaagcgggaaagagcaatggcatatgctttaacacaccagcggcaggcaggttccaggaaactgaaagctgcagatgtccaagggccagaggcggatgagaaccagtgggggcggaactgggtagagaggtgggtggctgtacgcccgtgggagaacaggttactggacagtaatgccaaagagagtgtaccaattggcgatgataaggaggctgaggaaaatggggacagggatgtaaacaatccaaaaggaaaagttgcagtttcgggcattcagtcaaatggttcaagccagacgaaagatgcaaaacacaagaagtcacattctgatgcaagtggttcttcatcggggcaatctgcggctgcaccacccaccgcttctttgggttcatccaagctgaaaccgaagccatcggatcaaacctctgaggaagtcagccctcaacctacagatccggctccgcggtccacaagtaatcccaaggaaaggccagcacaagtcagtgcaccaaccaagaagcggctatcccttcctaacaacgctgtcggtggcgcggcaagaaaaggccaggtgagcagcagcgagagaactcggtccgtcggttccaagaacacggtgaagggtgcatcgaagcctgaatcgaagcagcgaccgagtcccggtagcgcaaccgcgaagcgggtccaggcacaggcctgatgattcaagccactccctcccatttcattcagaaacttggtcatggcaatgcccatctgtcacggtgtgtcgccgcatcgtctgtgtacataaaaccgagaaataaacaaccccgcatctagatcgccgccatgctccacgccccgccatcggtaggcgtcgtcgtaaccgtttcctcggtcatgcttccgtcatctaccatttctgtgtgtatgttatcttcttcaagccactcttccgaaagaagcaaagaggctagcaccatgttatctgcaagttg

SEQ ID NO: 294 - DNA, 1396 bp, Hordeum vulgare
agaaaccctagccacagcaaggaggaggccatgagggggaagaagccggtcaaggagctcacgctctccgtgccggcgcaggagacgcccgtcgataagttcctgacggcgagcggtacattcaaggatggtgaactgcggcttaatcaaagaggtttgcagcttatctccgaggaaaatggggatgaacaccaatcaacaaaaatgaaggtggaagatgtgcagttatcaatggatgacctcgaaatgattcaggtcattggtaagggaagtggtggcgtcgtccaactagtgcggcacaagtgggtgggcacattttatgccttgaagggcattcaaatgaacattcaggagtcagtacgcaaacagatagtacaggagctcaaaataaatcaagcaacacagagcccccatattgtcctttgccatcaatctttttaccacaatggtgtaatatatcttgttctggaatatatggatcgtggatctcttgcagacataattaaacaagtcaaaaccattctggagccataccttgcagtactttgcaagcaggttttggagggtctgttatatcttcatcatgaaaggcatgtgattcacagggacataaagccatctaacttgttagttaaccataaaggtgaagtaaagattactgattttggggtgagtgcagtgctagcaagttcaatcggtcagcgtgatacatttgttggaacctacaactatatggcgcctgagcggattagtggcagctcctatgactacaagagtgatgtatggagtttgggcttggtaatacttgaatgcgccattggccgcttcccctatactcctccggaaggagaaggctggttaagcttctatgaactattagaagcaattgttgaccagccaccaccttctgcacctgcagatcagttctctccagaattttgctcatttatctcttcctgcatacaaaaggatcccgccgaacggaagtcggcttcagaactcttgaaccatgccttcatcaagaagttcgaggacaaggacctagacctgcggatcctcgtcgagagcctcgagcagcccatgaacgttcccgagtgagggttgccgctcggagaggcgaggctttgcggcgactctcttccagggccaccctcccgacggcaatcgtgtaattgctgcgaacccggtgggttcacagatgatgccccacccctgtatgtgatgatgtttacgttgggaaaaattcgcgtaggagccgaacggattgttaatgtatggtggtgacttgaggcccttttgttgtgtcttgctatgaatgaatgagtgagtgaatgaatctggtgttgctcgtggtgatgttggcgttgccatctggtctgtgtgattcctgctgaga

SEQ ID NO: 295 - DNA, 1648 bp, Hordeum vulgare
aattgcctgccaactccacctccatggcgctagccggcgccgcgaacgccaccttccgcccccgcctggtcactgccgccgccgacacctccgacactcatacacgccgccgccactggaaggccggcgagttcccattccccaccacctccccctcctccggcacgcagcagcgccggagaccccggaccacggagcgtccgcccccacctccaccgtccaagggggaagacccggaggggagagggcgccagaggcactggaaggcgggggaagacccggaggggagaggacgccagaggcactggaaggcgggggagttcccggcggcgggcgagtcccaatcccagtccgggaggaggggccgcgctcgcacccccatcaagaacgtccagaagaggctcgacgcgcgcgccgatgccaaggcctgggcctgcaccgtcaccgaggccctcgccgaccgcatcgccgccaagaactggcaaggggcgcttcaggtcttcgagatgctcaaggagcaacctttctactatcctaaagagggcacctacatgaaactcctcctgttgctggggagatcaggccagccttctctagcacaagaccttttcaccgagatgcagcagcaaggatgccagccaactcccgagctttacacggccttgatcggggcctactgccggaacggcctcctagacgaggcactcaagcttctccaagacatgaaagccaacccgctgtgccagcctgatgtctacacctatagcatactcatcaaggccttcgtcgacgccccaaggttcgacctcgtcgatgctatgtacaaagagatggctgagcgctccgtggcgccaaacacggtcacgcagaacattgttctcagtggctactgcagggccggaaggttggatgatatggagaagctactctccgcgatgctcgaaagtgcaaatagtaaaccagatgtctggaccatgaacattatcctaagcttgtttgggaacagtggccaggttgagctgatggagaagtggtatgagaaattccgaggctatgggatcgagccggagactcggacgttcaacattctcattggtgcttacgggaagaaacggatgtatgacaagatgtctgcggtgatggaatacatgcgcaggctagcgtttccatggacgaccgccacttacaataacgtgatcgaggcatttgctgaggcaggcgatgcaaagaacatggaggacacatttaaccagatgcgctcagaggggatgaagccggatacaaagaccttctgttgtctcataaacgggtttagcaacgcagcccttttccacaaggtggtaggcatggtaaagcttgctgagaggctcgatgtaccgccaaacacatcttttcacaactctgttcttgcggcatgtgcgaaagcagaggatctgatggaaatggagagggtcttcaggcacatgaaacatatgcagtgtgaaccagatgccatcacatactccatcttgttggaagcttatcggaaggaaggaatgaccgataagatgtacgctctgcaacaggagaacccaagtttggtttcgactgagcttgtcatggtgtaaccgacctcatgaattgattatggtgtgagttcatctgactg

SEQ ID NO: 296 - DNA, 580 bp, Hordeum vulgare
aagcatcgcaccagatcgcccgcaccggccggtaggagcaaggaagggagatccacctaacctatcaatggcggccgctgcttcctccagcgcctggaaggccaggtggctccgcccggaggcgtacccgatcttcgcggcgacgggcgtggccgtggggatctgcgtgatgcagctggtgcgaaacatcaccaccaaccccgaggtcagggtgaccaaggagaaccgggcggccggggtgctggacaaccacgacgagggacgccgctacgcgcgccatcccttcaggaggttcatcgacggcaagtccgccgagatcatgcccggcatcaacaacttcttcaccgccccaccaaagaactagacgaagaccacgtcgtcgccgcacagctcttggactccaagagaggaaggaatcattcctccgccgagatttttgttttccccttctcaagaatacggaaatgaatactgttggtttttcctcgaattcaagtatgttattggccatgactaattgtatggctgtacaccattgattgttgtgatcatacacacaaacctcgatctgaataatccc

SEQ ID NO: 297 - DNA, 632 bp, Hordeum vulgare
gacacgtccatcctccactccagctccgctttcggttttcagtccacctccctctcctgcgtcgaccctgcagtccagagcctttacgcgtgagccacctccgcttccaggagcttctcgaaggggggccgccgatgaccctctgatcgtccgtcgccatgggctgcgccggatccacccctaaatctgacggcagcagtaagaagctgaaaaagccaaagccttggaagcacacacaatcaataagcccggtagagctcaaacagatgcgtgaagaattctgggacactactcctcactatggtggacagaaagaaatctgggatgcacttcgggccgctgcggaagctgatctgtctctctcgcaaactatagtagacagtgctggcatcatagtctcaaatcctgacatgacactttgctacgatgaaagaggtgccaaatacgagctaccaaagtacgttctgagcgagccaaccaatttgatccgggaggaatgaattcatataccgtgaaggtgaaaggctcgtgtaaattatgtgaacctcatttgttcagcgactttagtcttcacttgctcaagaggtcaatggacataccacacttaattcataactagaagggcagtgcgt

SEQ ID NO: 298 - DNA, 1158 bp, Hordeum vulgare
gagagagggagaaagaggcaccgggcccgtcgcatgggagcgcggtcgacggcgaccgcgggggaggcggtggcgaggcggggcagcaggaagaaggcagccatggcgccgtcgctgggcggcgtggaggccggcggcaggcgcaggggcccgccgcgtctggtggggtacgaggagctccccgagtacctcaaggacaacgagtacatccgcggccactaccgcgtcgagtggcccatccgcgacgccctcctcagcgccttctcctggcacaacgagacgctcaacgtctggacgcatttgggcgggttcctgctgttcctggcgctcgccgtcgccggaggcggcccggaggccgcacacgaggccgcgccggggatcatgaggtttgtggtgggatcagctaattcgtcatggaagagcgatcagtcgggcctgccgagccatgacgcggcggcggcggtcctgggaggacacggcgtgccgcggtggccgcggatggtgttcctcgtgggcgccatggcgtgcctggccatcagcgcgacggcgcacctcctcgcgtgccactcgcaccgcgccaccgtcgtcttctggcagctggactacgccggcatctccatcatgatcgtcgcctccttcgtcccgcccgtgtactacgcgttcctctgccacccgcccgcgcgcatcgcctacctctccgccatcaccgtcctcggcgcgctcgtcgtggccgtgctgctctcgccgtcgtgctcctcgccgcggtaccgccggctccgcgccacgctgttcctcgccatggggatgtccggcgtcatcccggcggtgcacgcgctctggatcaactggggccacaccgcctgctacatggccctcgggctggaggtggccatggggctcgcctacgcggtcggcgcctggttctacgtcagccgcgtgccggagaagtggcgccccggcgtcttcgacgtcgtcggccacagccaccagatcttccacgtcttcgtgctcgtcggcgccatcacgcactacgtcgccgtagccgtgctgctcgactggcgggagaaggcggccgtctcgtgcggcggcgtgacgtcgtaggcggcttgctggaacttggaacaagaaattaaattgtaagtcgtgccattcgaaatc

SEQ ID NO: 299 - DNA, 1137 bp, Hordeum vulgare
actacttccgggaactcttgctgccatgggtccagttgtgctcctcctcgtcgtcgttgccgttgccgtcccggtcgtgcggccggcggcggccgagctgccgcggctggagcactcgcccaaggcggatgggtcgctgtccatccttgccgtcggcgactgggggaggcgtggggagttcaaccagtcccgggtcgccacccagatggggctggtagcggagaagatggacgccgacttcatcatctccaccggcgacaacttctacagcgatggcctaactggcgtcgacgataaggccttcgaggactccttcaccggcatctacactgccaagagcctccagaagccttggtacacaattcttggcaaccatgactacaggggcgatgcactcgcacagaccagccctatccttgcgaaagtcgactgccggtggatctgcatgaagtctttcattctaaacgcagaggttgcggatttcttcttcgtcgacacgacgcccttcgtcctcacgtattggaccaaccccaaggacagcacgtacgactggagaggcgttgctcctcgcgagacgtacatcacgaatctcctcaaggacgtggaggattcgctgaggcagtcgagggcgccatggaagatcgtcgtcgggcaccatcccatccggaccgccggcaagcacggcgacaccgaagagctcgtgcagctgctcctgccgatgctcaaggcccatggcgtcgacctctacatcaacggccatgaccactgccttgagcagatcagcagcagcgacagtcctctgcagtacctgacgagcggcggcgggtcaaaggcctggggcggcgtctacgcgccgggcgccgacaaggtggagttcttccacgacgggcagggattcatgtcgctgcggctgaccgccacggacgcgcgcgtcgcgttctacgacgtcgccggcgccgtccggcacacctgggggcataccaaggccgcacactactgatcgaataagctgccgtgcgcgccagccatgcatgggcgccatttcgatataatcagcgcagcgcccgcgcgaacaatttaagcatcttcactacgcactcaaattcttattcttgtaagttctccgggttaaactgc

SEQ ID NO: 300 - DNA, 584 bp, Hordeum vulgare
atttgcgtggattccgtgcggccctttctgcgccatgcacttctgatccggggcctctcggatcttgggagggaggcggggcggtgagccggccgggagatggccggcgggaaggagccgatcgaggtcaagttccggctcttcgacggcacggacatcggccccagcaagtacgaccccgccaccaccgtctccgcgctcaaggacttcatcctcgcccagtggccgcaagataaggagataactccgaaaactgtcaatgacctgaagctcatcaatggtggaaagatattggagaataaccggacacttgccgagtcccgtgttacaataggagaggtccctggaggtgtaattacaatgcatgtggtagtgcgccctccacaagttgacaaaaaccagaagcagctgggcaattcccccaagcagaacagatgcggatgcaccatactgtgatacggcaccccccctgatgatgtacgatgcacctagttgtagaatttctcttgtgcttttgttgcgtccacggcgcggtgtgtattcattttgacatccagttcctggagccattgaaactcgatcta

SEQ ID NO: 301 - DNA, 832 bp, Hordeum vulgare
aaagtcgacaacgtttggtggatggaggcgctgggcctcctgggccgcgcgtgccgcctcggccactcctgccgccgcagcacggccactccttccccttcccctcctcgcagcagcagcaaccgcggcagagccgtgcgcgccggagccaaagccgcctcgtcgtccgcgccgcaggcgatggaggccaagcgggaggagaagccgagggtggtgacgctccggccggtggaggccacgccggagtccttcgcgcccttcgggcaggtcatcgccgcctcccccgacggcgaccagttcggcccccacgacgcccagctcgacctcagccgcggcatccctaggttctacatcatgagattggagagcaggccgctcaagttctcggcaatcacccaccacgccagcgtgacgcagtgcctgggctccatcggcggccaggactggtacctcggcgtggccaagccttccatcgtgaacgagcacagtggccaggatggtggcaggagtcccgtgcagtcgcgcgccgggcactactatctgcctcccgatccagccgaggtctgcgtcttccgggtctccggccccaagttcctcaagctgcacgccgggacctggcacgccgggccgctgttcaaggcagacgccgtggatttctataacctggagctgagcgacaccaatgtcgtggatcacaccacgcactgcttcaaggagcacgacggcgtaacctttgcgatcgaggactgaggacccaggcacaacaaaaaaactcggcgcaccgtgcgcctcgctgatgctattcttcagccttgcctctatgggatccttt

SEQ ID NO: 302 - DNA, 916 bp, Hordeum vulgare
acctcaccctcaccctcaccgcgcggcgaggccgagcgacccacccagcggcgagcccggcatgcatcacgaccccaaccccttcgacgagggcaccgccggcgacgaaaaccccttctccaatggaggaggccggggcgggaagcagcagtacggcttcaggcccaccgagcccgtcggcttcggcggcggcggcggcggcggcagcaggggcgacgccaccgtcgatgtgcccctcgacaacatgggcgactcgaatggcaacgcgagggagctctcgtcgtgggaatcagatctgaggcggcgtgaggcggatatcaaaaggagggaggaatcgctcaagaatgctggagtgcccatggaggagaagaattggccgccatttttcccgattatccaccatgacatcgccaatgagataccggccaacgtgcagaagctacagtatctggcgttcgcaagctggcttggaattgtgctctgcctctcctggaactttattgctgtcatagtctgctggatcaaggagggagattcaaagctgttcttccttgctacaatctatgctttgcttggaattcccctttcttacttgatgtggtatcgacccctctaccgtgcaatgaggactaacagtgcattcagttttgggtggtttttcctgtgttatctgatccacattggtttttgcataattgctgccattgctccgccaattgtattccaagggaaatcattaacgggcatattggctgcgatcgacactttctctgagcatttgataattgggatcttttacttcgtcgggtttgcactattttgcttggagacactgctgagcatcggggttcttcagaaagtatacatgtacttccgagggcataagtgaagccgtcatggatgggaaattttctaa

SEQ ID NO: 303 - DNA, 422 bp, Hordeum vulgare
gcaggatgaaggccaaggcgggatcccgcgccggcggctccaggctcgcggtgaagaagagcaaggctgagaaggaccccaacaagccgaagcgccccccgagcgccttcttcgtcttcatggacaccttcaggaaggagtacagggagaagcaccccgacgtcaagctggcctccgtgattggcaaggccggtggtgagaagtggaagtctctgagtgacgctgagaaggctccctacaatgccaaggccgagaagctcaaggccgagtacaccaagaagatcaacgcctacaacaacccacaggcaggagaggcgtccggcgactctgacaagtccaagtccgaggtgaacgacgaggacgacggcagcgagggcgacgcgtgaagcggcagcagggggagggtggtctctggaacgtaa

SEQ ID NO: 304 - DNA, 1260 bp, Hordeum vulgare
atcgtgcctactccctctctccccgccctccaccgaggatggctctgccggctgccaaggcggcgccggcgacgcctttctcgtcgcagacgcacggcggaggcatcctcctccggcgagctacgtcaccgccaccgcctgccgccgcgctgcgcctcggaccactcttctggccgtgggaaaaggtgaatgttgggcccctttcagtttcccccatgggttttggaacatgggcttggggcaaccagctgctctggggctaccaggaaagcatggacagtgaactgcaggagtgtttcaatttggctctgaagaatggcataaaccttttcgacaccgccgactcctatggaactgggaggttgaacggccaaagcgaaaggctgctcggcaaatttatccgcgagtgccaagggccaataaaatctccagacgacgtggtcatcgcaacgaagtttgccgcgtatccttggcgactaacgtccggccagtttgtcaacgcctgcaagtcgtcattagaaaggttacagatcgaccggctcggaatagggcagctgcattggtctactgccaactatgcgcctctgcaggagcgcgctctctgggacggtctagttgaaatgtatgacaagggtcttgtccgggccgtgggtgtgagcaattacgggccgaagcagcttctgaagatccacagctacctagcatccagaggtgtccccctgagctcagctcaggtgcagttctcgctgctgagcatgggtgatgagcagatggagctgaaaaccgtgtgcgattctctgggcgttcgtctcatcgcttatagcccgcttgggctgggcatgctcaccgggaagtacgacgcctctaaccttccaaatgggccaagatctgtgttgttccggcagattcttcctgggctggagtccctgctgtcttgcttgaagagtattgccgaccgaaagggcaaaaccatgtcccaggtggctataaactggtgcatttgcaaaggcgcaattccgattcccggcgtgaaaacagttagacacgtggaggacaacttgggtgcgcttggctggaggctgagccctggtgagatctcagagctggaagccgcggcgatggagtgccccaagaaaatggttcagaacatatttcagaccacatgagcaaactgtagtactccgtattaaacatgacagcaacctgaaataagagcagagcaggttgctttctcttctgtgcctagttcagagttcggtt

SEQ ID NO: 305 - DNA, 395 bp, Hordeum vulgare
aaaggatccgctagcgagcaatggaccgggtcggcagcggcgagaagcacctcgaggactgcaccgtcgccaatgccctcggaacttgggtcttctctgttgctggtgctctccttgccattcctgtgggcataaagaggaagtccttcgctccgctcgtgttctttggcactactggaactatgcttgacatcatcatgggcattagccagtgtgagagggagcatgctgagcggcagatgaagcttttagaagcgcagaaccttgcaacaaatgcttcagtagagggtgagagcttgactgattcatttaccaatgtggataagtgaaatgtgtcctactgtgggttttctttgatgaattcctgagtttaatagtcatgatcctggtaccaa

SEQ ID NO: 306 - DNA, 3603 bp, Hordeum vulgare
aaagtcgacgatctggttctcctcgtgtgtccgtccacatccagggggggtcctggatttggaggcggagattggtacctggaaagcggttgatgtgcctgtcggccttgttgttttgccgggattggtaactggcgggcgggcgagaaaggagtgatgggagcttgatttgccactttgatcttgggattggttgttgggggggcggcggcggttggcccgtttcttggttcttctggggcggagtttgtttgggatcgggagcggagcaagccatttccgggcggttcttgtcgggggaattcgcgccgactgaagcaagttcgtcgggaagatgcggctgactgtgcgtgtgatcggggcgcgcaacctgcgcgccatggatttcaacgggttcagcgacccgtatgtgaaactgcaggttgggaagcagcggttcaagaccaaggtggtcaagatgaacctgaacccggagtgggatcaggagttcagcttcgtcgccgccgatgtccgggaggtgctcaagttagatgtctacgatgaagacatgatcgggactgatgacttcctgggccaggtgagggtgacactggaggatcttctggccgtggagaacttctcgctcggtacgcgctggtaccagcttcttcccaagaccaagagtgacaaggcagttgattgtggggagatttgtcttgcaatatctttagaaacagctggggccacacgatcatggtcagatgatcttgcaactgaactaactggtacacggaaagagtattcattggcatcaagtcaaagcgcaggatcatcatcggctgcattagcttatgaagaaaatgaagcttctaaagaagataatgttaatgagtatttttctgatggaactgaagtccctgaagaggacaaatgtggcgaagtgagagctccagaggacaggtttaatgggattcctactgaaatttctaatgaagccgaaacttctaaaacagaaaagcttgacaagccctcgcttgttgatcgtgtctatcaaatgtttgccaagaaaaatgatgatatttcgtcaacatcattgagaaagaccgaggcttcagaagaagttcaacaagcaacagcagtatttgaggctcctttaagccaaaatagtgacatttgttcagatgttacatttgatgaactactggggtcttttgaatcaaggcacgaagaagtcgaaatgcctgtgaatttacaaggaattcttgttaatcagtcatattttacgtcgcccagtgatttgaataaccttctcttctcaccagattcagatttccggcaaacattggttcagcttcagaattgtactgatttcaaaactgaaccgtggagaattgataatgatggagagtccctgaagagagtgataagttacacaactgcaccatccaaattggttaaagctgtaaaggcaacagaggaacaatcttatttgaaggctaatggaaaagagtattcagttttgttgagtgctagcactcctgatgttccttgtggtacttattttcggacagaggttcttttccgtattatgccaggccctgaacttgattctgagcaacagacttcacatttggtaatttcttggcgcatgaattttcttcagagtactatgatgaaaagtcttatagaaaatggagcaagacaaggcttggagcaaaattattcacagttctctgatctactgtcagagaagatcaagcctattgatgtagacgatgctggatcagataaagagcaggtcttagcttcattgcaaggggggcaggagtctgattggaagatagcattcctatacttctgcaactttggtgtcttgtcctctctttttgttgccttgtacattggtgttcatgtttcactagtgaattcaggtgcagttcagggacttgagtttcctggattagatttgccagattctctcagtgagattgttatgggtgggctattgtttcttcaggtgcaacacatatttaagaaaattatatgtttttttcaggcaagagaacaaaaagttggtgatcatggtgtcaaagcacaaggcgatggatggttgctaacagtcgccttaattgagggaaccaagttggcaccagttgatgctactggtttctctgatccttatgtggtatttacttgcaatggtaaaaccaaaacaagttcaatcaagttccaaacacttgaacctcagtggaacgacatctttgagtttgatgccatggatgatcctccatcagtgatgaatgtacatgtatatgattttgatggaccatttgacgaagttacctctcttggacatgctgaaatcaactttgtcaaatcaaatctgtcagagctagcggatgtatggattcctcttgaaggtaacttggctaagtccaggcaatctaagttacacctaagaatcttcttgaacaactcaaagggcactggtatggtcactgagtatctgagcaaaatggagaaagaagttggtaagaagatgacgttgcggtctcctcgaactaatactgcattccaggagctcttctctctgcccgcagaagaatttctaatcagcagttttacatgctacttgaagcggaaattgcctacacagggccatcttttcttgtctccaagaataattgggttttattcaagcatgtttggccggaaaacaaagtttttctttctatgggaggatattgaagacatacaggcaattcccccatcgctatcgacatggagtccatccctttcaataactcttcacagaggtagaggcatggatgcaaagcatggtgcaaagagcgtagagagtggaaagctgaagttttctctgcaatcttttgcatcatttagtgtggccaataggacaataatggcgttatggaaagcaagatcattgagctccgagtctaaagtacagattgctgaggaacaatctcaaaataatacacttcaaagtgaggacagtggaatttttgtaggtgttgacgattccaagagccttcagatgagtgaagttttctcgtcaaccatttctgctaatatgaattcacttctggaggtgttcgaaggaggttcgttggagatgaaagtcatggagaaagttggatgcctcaaatactcggctacacaatgggaatcagataaacccgatgaatatcaaagacaaattcattacaagtttagcaggaagttgtctcctgttggaggagaagtgactgggacccagctgaaatctcctatgcccaataagaaagggtggattattgaagaggtgatggaacttcaaggcgtccttcttggtgacttcttcacgcttcatataaagtatcaattcgaagaccttgctcctaaacaaaaggtgtgcagtgtccaagtctatcttggaattgaatggtcaaagaccaccaggcatcagaagagaatcgagaagaatgttctttccagttcatctgctcgcctgaaggagatgttcagccttgcatccaagcaactctcgagcaccagataggatcattcatccgtgacaacccatgtgcataatactgaatgaccaaagatttgctgggatccttt

SEQ ID NO: 307 - DNA, 1125 bp, Hordeum vulgare
acggccatgaagcgcttcttccagcccgtagtcaaggacggctcccccgccaagaagaggcccgccggggccgcgacctctgactgcgttgatggcgccgcccccaccggggccgacgccgccggggagggccctcccggcgaggagccacgcaggttcgtcacgtggaacgccaacagccttctgctccggatgaagagcgactggtccgcgttctgtcagttcgtcgcccgcctcgaccccgacgtcatctgcgtccaggaagtgcggatgccagcagcaggttccaaaggggcaccaaaaaatcctagtgagctaaaagatgacacaacctcgtcacgcgaagaaaaacagatagtgctgcgtgctttgtcgagttcacctttcaaagactaccgtgtctggtggtccctttcagattcaaaatatgcaggcacagctgtgtttatgaagaagaagtttgaaccaaagaaagtgtcattcaacttggatagaacatcttctaagcatgatgcagacggtcgtgtcatcattgtggaatttgaatcattcttgttactaaacacatatgctccaaacaatgggtggaaagaggaggaaaattcatttcaaagaagaagaaagtgggataaaaggatgttggagtttgttcaacaagtagacaagcccttaatctggtgcggagacctgaacgttagtcatggtgaaatcgacgtcagccatcctgatttttttagcgatgctaagctcaatggatatatccctccaaataaagaggactgtgggcagccaggattcacccttgcagaaagacagcgctttggcaatatattgtcacagggaaagctagtagatgcttacagatacctgcacaaagaaaaggacatggagtgtggcttctcttggtctgggaatccaattgggaagtaccgaggaaagagaatgcgtattgactattttgttgtttcagaagggttgaaggacagaattgtttcatgtgaaatgcatggtcatggaattgaactggaaggattttatggaagtgatcactgtcctgtttcacttgagctctccaaagaagcagccgaagcaccagaatcgaagagctccggctaacttctataa

SEQ ID NO: 308 - DNA, 1679 bp, Hordeum vulgare
ggaaaatggaggccaccactacactcacgctctcctcgtcccctgccatcgcggcccgccgctcgccagtgagggcgaccatctcccaatcccacctccggcattgccccgtccgcacttcgcgcctccacgttgcccagagcctggcctcacgtcccctctcctcggggtggcggtggcggcggcgggggagcgggctggtggtgcgggcggagacgttcgggcagctcaccaccgggctcgagtccgcgtggaacaagctgcgtggcgtcgatgtgctgacgaaggaaaccattgtggagccgatgcgggacatcagaagagcgcttctggaagcagatgtcagtttgccggtcgtcagacggttcgtgtcgtctgtgagcgagaaggctttaggttcagatgttatccgaggaatccgaccggagcagcaattagtcaagattgtgcatgatgaacttgttcaactgatgggtggagaggtatcagacttggtgttcgcaaaaactggcccaacggtcatcctactggcaggtctgcaaggtgttgggaagacaactgtctgtgcaaaacttgcattctatctgaagaaactggggaagagttgtatgctggtcgctgcagatgtttacaggcctgctgccattgatcaactcactgtactgggtgaacaggtgggtgtgccagtttactcagaaggaaccacagcaaaacctgcagaaataaccaagaatgccatggaagaggcgaaaagaaataatattgatgcgatcgtagtggatactgctggcagactgcagattgataaaacaatgatggttgaattgaaagaagtaaagaagtctgttaatcctacagagattttgcttgttgttgatgccatgactggccaggaagctgcagcattggtcacaaccttcaatattgaaattggtatatccggtgctatattgactaaattggatggtgattccaggggtggagcagcacttagtgttaaagaggtgtctggaaagcccatcaagtttgtagggagaggagagcgaatggaggaccttgagcttttctatcccgaccgcatggcacaacgtgttttgggaatgggagatgtcctttcatttgttgaaaaagcacaagaagtcgttcgtcaagaggataccacggaactgcagaagaagatcatgagtgcaaaatttgacttcaatgacttcttaaaacagacacaaaatgttgccaaaatgggatccatgagccgtgtaattggaatgattccaggcatgaacaaggttactcctgcgcaaattcgggaagccgagaaaagacttgcattcgtagagtcgatgattaatgcaatgacagccgaggaaaaggaaaaacctgagttgctggctgaatcacgcgagaggaggattcgggtagctgaggagtccgagaagacagaacaagaggtgagccaactggttgcacagctcttccaaatgcgcgcgcagatgaagaaattgatgggtatgatgcaagggcaagaagcaattgcaggaatgggagatctcatggactcgcttaacgcggacgagaaggcacctcctggcaccgcacggaggaggagacggcggagtgagccgccgcggcagagggagttggatgcagtgggtggcgccagtaggccttgagttgtgtaa

SEQ ID NO: 309 - DNA, 761 bp, Hordeum vulgare
gctttattgaccattgtcgctcgtccaacacctgacacaaatccacaatggccaccgatacgttcgtcaccgtcgtggacttcgaggacgacgagatcaccgccaccgtcacgtcctccggcgacgccgtgaaggcctggctccgccagatccgctacgtctaccgctgggtctaccacaagctcatcgtggggctggacgtggagtggcgccccagcttcggccgcgcgcagaatcccgtcgcgctactgcagctctgcgtcggccgccgctgcctcatcttccagctcctccacgccgacttcatcccgctggccctccgccgcttcctcgccgacccggacttccggttcgtcggcgtgggcgtgcagaacgacgtcgaccgcctcaacgacgaccacggcctcgaggtcgccaacgtcgtcgatctgcgtagcctcgcggccgacgagatgcgcaggccgtggctccgccaggccgggctcaaggacgtcgcgggcgtcgtcatgggggccaacctccacaagccacgcagggtcacgatggggccgtgggacgcctgccgcctctcccaggagcagatccagtatgcctgcatcgacgccttcgtctccttcgaggacggccggaagctcctcaccggcgactactccgactccgaagaggaggatgactccggctactgaggccatagatcgattgcctcgtcccgtacgtgtcctgcaaattccacctgctgttcccaagtactacctgcctag

SEQ ID NO: 310 - DNA, 407 bp, Hordeum vulgare
gcacaagcgaagtgagagcttttgcacgaggagttcatcagcaaccatgaagggcaccaagctcgcggcgattctgatcctccaggccgtcctggtcatgggagtcctctcgcacgtgaacgccgactatttccccacgtgctgcaacaactgcaggtccttctccggggtcgacgtctgcgacgacgcccatccgcagtgccccaccggctgctcggcgtgccgcgtggtgaccacgaacccccagacgttccgctgcgccgacatgaaagccaccgtcgacggcacctgcggcgggccatgcaagaagtactgatcggctcaggctcacatgagactattgttccgcttggcgcctaaaataaaagctcggatgagatgaccggactcatcttgcctatgcgtgt

SEQ ID NO: 311 - DNA, 1181 bp, Brachypodium distachyon
agccacaagccctcttcttcctcctctagtcaagctagctagctagcatataccaataatccacggccatggctaactcactgcccatcgccgtgctccttctgctgctgctctccccagctgctctcgccacggccgtcttccccgactccggtgactccttccacgccgtgtcctgcccgcagctggacaccatcgtgctcaccaccgtgcaagcggcgctccgtcaggagatcgctctcgccgccggcctcatccggatcttcttccacgactgcttcccccagggctgcgacgcctccgtgtacctcatgggcacgggcgccgacgagatctccctgggcccgaacctcacgctccaacgccgggccatgcagctcgtggagtccatccgggccaaggcccacgccgcctgcggcccaaccgtctcctgcgccgacgtctccgccctggcaacccgggccgccgtcgtcgcctccggcgggccgtcctactccgtgcccctcggccagctcgacagcttcgccccggccccccgggacaaggtgttggacctcccggggcccaggacggccagcgtggcggaactcgtggcgacgttcgcgacgcgtggcatggccgacgtggcggacctcgtggcgctctccggcgcgcacaccgtcggccgctcccagtgcgactccttcgctgacaggtcgggacgcatggacgacaccttctccaggaagctggcagccaactgcagcaagcacaaggaccgcctgcagaacctcgacgtcgtcacccctgatttgtttgataacgggtattacaaggcgctgacgtttaaccagggcgtgttcacctctgacatggcgctcatcaagaacaggacctcggccgccattgtcaggcagttcgcggagagcaaggaggcgttttttgcgcagtttgcgaggtccatgaccaagctggctaacgcgcccaggccggggggtaatgtcggtgagatccgccggaactgcttcacgcgcaacgtccgccagggcgcggatgcgaccatcgagctcgccggggaagaagagggattcaaggcttcagcttgatcttgaaggttgaagatcaagctttcctttctaaattagtagtgcttacttaatgtctgtcgtctgtttcttcagagcttgtacgtgtttcctgtc

SEQ ID NO: 312 - DNA, 1704 bp, Brachypodium distachyon
agctctctcctcgcaatggcgctcgccatcaactccgccgccgccgcagcggccgccgccctctccaacggcggggcagcccagccgccgcgccccagagcggggttactcccgatgaagaggcggggcagcatctctgccgtgcacgccgccgaccccgccaggggcaccgggtccgtcccggcggccgcgaagacctcctccccgacggtggcgcccgaggcggcggcttctccggcggcgagctggaaggtcgacagctggaaggcgaagaaggccctgcagctgcccgagtacccgagcaaggaggagctcgacaccgtgctgcagaccatcgagacgttcccgcccatcgtgttcgccggggaggcgcgccacctcgaggagcgcctcgccgaggccgccatgggccgggctttcgtcctccagggcggcgactgcgccgagagcttcaaggagttcaacgccaacaacatccgtgacaccttccgtgtcctcctccagatgggcgccgtcctcatgttcggcggccaggtgcccgtcgtcaaggtaggtaggatggctggccagttcgccaagcctaggtccgacaacctcgaggagagggacggggttaagctgcccagttacaggggagacaacgtcaacggcgacgccttcgacgtcaagagccgcaccccggaccctgagaggatgatcagggcctatgcccagtcggtggcgacgctcaacttgctccgcgcgttcgccacaggaggctacgctgctatgcagcgggttatccagtggaaccttgatttcatggatcacaacgagcagggagacaggtaccgtgagttggcacatagggtggatgaggcccttggcttcatgactgcagcagggctggggatcgatcatccgataatgacaactactgacttctggacatcccatgagtgtctcctcttgccatacgagcaggctcttacccgtgaggactccacaagtggccttttctatgactgctcggcacacatgctgtgggttggtgagcgcacccggcaacttgatggggctcatgttgagttcctccgtggtattgcgaaccctcttggcattaaggtgagtgataaaatgaaccctgctgaattggtgaagctgattgagattttaaacccttcaaacaagccgggaagaataaccataattacaaggatgggtgctgagaacatgagggtgaagttgcctcatcttatccgtgctgtccgcaattctggacagattgttacatggattactgatcccatgcatgggaacaccatcaaggccccatgtggtctgaagactcgtccatttgattccattatgaatgaggtgcgtgcgttcttcgacgtgcatgaccaagaaggaagccacccaggaggtatccacctcgagatgaccggacagaatgtaaccgagtgcatcggtgggtcacggaccgtgaccttcgatgacctgggtgaccgctaccacactcactgcgacccaaggctgaatgcttcccaatctctggagctcgccttcatcatcgccgagagactcaggaagaggaggatgcagtcagggctcacaaacaacctgccactgccgccattggccttctaaaacaggagaggaggggttagatagtttcgatctgcaagggggtggggcaatgggcattccgttgagtttgtatgg

SEQ ID NO: 313 - DNA, 1201 bp, Brachypodium distachyon
cccatatgcctcaggtcaagtctactgctggtgctggcgcaatgccttccggatctaaaggtggtgatggtgaagtggaggcagggttcgcgaagctgcagggtgaggattttgagtattacatgcagacctactcgatcatgctgggacgtaacagcaagaaatcgtcagtggatgtggatctctccagccttggtggaggcatgaacatttcgcgccaccatgcccggatattttatgacttccagcgccgccgattcgccctagatgtcatcggcaagaacggctgccttgtcgagggtgtcctgcacctccctgggaaccctcctgttaagcttgactcgcaggatctccttcagatcggagacaagaagttttacttcctcctgcccgcgcgatctatctttgcctcatttgccgctgctcgacaagtccctgtgattccgacacagatcccgccgccatcctttgtgcggccaggccacccaaatgtgtccaattaccatgaccagccctttgaaggtgattatggccgagagggtgatgacattcggaatggtatcaatgaaagtggaaccaggggcaagttgataaagagaaccaagaagccttctggagatctgggcatttatggtgggcaccgaatcaatgttgaagcaataggaacactgggtgaaggtgaaaatatatcagatgtaagaccaaggggtgacaaggatatggacaatcagcagctcctgcaaatggaagagaaggaagtcgtgtcatctgttgcgaccgtgttatctgacctctgtggtcctggagaatggatgcctatgagaaaactccatacagagctcgtggaccagtttggcaacgtgtggcaccacagcagggtgcggaagtacctgactgcagaggaatggtcgccggttgaagcaaaggggaggccatggtttggcctgctggggctgctgaggaagtacccggagcactttgtgatcaacaccaagtgcaagggccgggcgatctcggagtttgtctccctggtctccttgctctcctagaggggaccgcagactaccgacgacagccgtctctagggtctgttgtttcgtgccgtcctgttctctgtccagccatgcccagaagggccaagggcagagtggcggcgatggtcctggtttgtcttgtcttgtctgtcctttgagtaaacggg

SEQ ID NO: 314 - DNA, 1345 bp, Brachypodium distachyon
gaaatatccccaaaccctcgcccgccgccgcccgacgaccacttccagatctcggcccatggacgacgacggcgccgcctccccgtcgccatcgccctccccatcgcgctcctcgtctccgctcccgctcgccgaacccgtcaccgtcgccgccgtgccccccggccacctcgccgtcgccctccccatccagaagcctgccccctccagcggcggcggcggcggcggagggggccgagaggacgcctggagcgacggcgccacctccacgctgatcgacgcctggggcgagcgcttcgtcgcgctcggtcgcggcagcctacgccacccacagtggcaggaagttgccgaggtcgtctcctcccgcgacggctactccaagccgcccaagtccgacatccagtgcaagaaccgcatcgacaccctcaagaagaagtacaaggtcgagaagtccaagtcgggctcctcatggccattcttcgaccgcctcgactacctcctcgcccccgtccagaagctcgggggcaattctggccgggctgcaggaaattcgggctcctctaacctcgccgagcggacaaccgctgttatgattccgcgtttcaacttccctacgcgcagccgtacgacctcgcacttccccccctccgcaggtctaaagcgcaggctgccgtcgccgccccaggcctcagcatcgtcggattcgtccgatgggttcccacctgagccaccggttgaggctgccaacggcaagagacagcgtgtcgaggaggctgtgaatggagcagatagcagcgtccgtgtgcagggtctgcgcgacctggcgcaggcgattcggcggtttggtgaggcgtttgaacgtgttgaggcctcgaaaagggagcatgagctccggatggagcgggaccgcctgaatgctgcccgcgagctagaggaccagcgtgtgcagttcttcctcaagatgcagatggagatctcaaaggccaacaatggtaccgcacttggtccccttgctgccgttgctgctgccatgattggcaattcagcacctgccacagtccccgccgttgctgatggcaacggctccaggagaacatctatggcacctgatgtcgggaccagcagcaatcaccatgtccggtaccgtgtgaaggatggcaggcatcatcaatccttgcaacacccatcctaccagtacaaccagaacaatgccggcgaggatgccacaggccatggtagtggcagcaacgacaacaaagaagatgatgaggtggaagatgaagaggaagagagccagtagaatttgtatccagtcaattggcattgtcctggtttgaattgctag

SEQ ID NO: 315 - DNA, 1147 bp, Brachypodium distachyon
tttgatatcctttgagatcatgggagggtcgatgtggatgaggtacgcgccgcacaacatgatgatcctggtgcagctgtcctacaccttgatgtacttcgtcacggaggacgccttcaaccggggcctcaacccctacgtttacgtgacctaccggcacctcctcgtcgccctcctcctctgcccgttcgcctacttccatgaaaagaagttgaggcccaagatgacgttgatgctgttcctggagatttttgtgctctcccttctgggggtgagcttgactctgaacatgtacttcgcgagcctcaagtacacgtccccaacattcgtcaccgccatggcgaacaccgtcgcctccatcaccttcgccatcgccatcgtcctcaggatggagatcgtggacgtgaagagcccgcgaggcctggcgaaggtcgcgggcacggcggtgtcgttcgccggagtgaccaccatgaccttctacaaaggagcagccatcgcgagcccatggaaggcgcccatccacatccacggcagcaacgccgtgcacggtagctgggtcaaagggtcgctcctcgccgtggccagctgcgtctgctggtcgatctggtacatcatgcaggcggggtccgtggagaggtacccggcggagctgtcgctgacggcgtggatggccacggtcggggggatacagtcggctgccttcacggtgttgctgcagcacaggaaggaggactggctcgtagggttcggcctcaacttctggtgcatcatatactctgggatcgcgtgcagtggcttcgcggtgttcgcgcagctgtggtgcacggagaagaaaggccctgtcttcgtcaccatgttcaaccccgtctccaccatcatggtcgccatcctggcctacttcatctgcggcgaaaatctttacgtcggaagcataatcggaggaggggtggtcatactgggcatgtacatgctgctgtggggcaaggacaaagatcaagagtacaacgcgagcagcagcaaggagctgcaggggtccgatctggactgggagaagcaggcaaagatggccgacgtttcttcagtacagaacgattctcagccagagacgaagacgatgacatagaagggttgggtctaggaattcaaa

SEQ ID NO: 316 - DNA, 1416 bp, Setaria italica
ctgaaagggcgggtgaagttaggagcgggctgggtcccttgagcatgccgtcaagaaaccgcgtggaggggagggcgatgagatgagggatgctggccgcagtgatggactacttcagctcctgctggggcccgcgatctcgggccgggcaccggggcaagggctccgacgcggccggccggcaggaaggtctcctctggtacaaggacgccggccagctcgccaccggggagttctccatggccgtggtgcaggccaaccagctgctcgaggaccagagccaggtggagtccggatcgctctccttggctgaccccggcccgcagggcaccttcgtcggcgtctatgatggccatggcggcccggagacgtcccgattcatcaatgaccacctcttcaaccatctcatgaaatttgcaactgagcacaagtgcatctcagtggatgtgatccggaaagctttccaagcaactgaggagggctttctttctctagtcagcagggaatgggctttgaagcctcagattgcatcagtaggctcctgttgcctagtgggtgtaatttgttctgggactctctatgtcgcgaacctcggcgactcacgtgcagttcttggaaggcttgttaaggcaactggggaggttctggccatgcagttgtcgtcggagcacaatgcgtgctacgaggaagttagacaagagctgcagtcagcacatcctgatgatccacaaattgtggttctaaaacacaatgtttggcgtgtgaagggtctcatccagatctcaagatctatcggagatgtatatctaaagagaccggagtttaacagagaacctcttcatagcaagtttcggcttcgagaaaccttccagaagccaattcttagctctgatcctcaaattactgaacacagaatacagcccaacgatcagtttgttatatttgcttctgatgggctatgggagcatctcagcaatcaggaagcagttgaccttgtccagaatagtccccgtaatggaatcgctcgaaagctagtgaaagtcgcgatgcaagaagcagccaagaagagggagatgagatattcagacctcaagaaaatcgaccgcggggtgaggcggcatttccatgacgatataaccgtcgttgtgatattccttgactcaaatgccatgagcaaagctagctggagcaaaagcccctcggtctctatccgagggggcggtgtcacccttcccgcaaaatccctcgctcctttctcagctccagctcagctgaacagcacctactgaagaagttataccggaaagaaaaggcacgatgcagatctgctggagatgagagctgctgctgcaatcaagtgtagtgtaacacctgtcgtgttgcccttctcaaaacctactgtctagactccgcctg

SEQ ID NO: 317 - DNA, 2038 bp, Setaria italica
ggtgaaatgaagtcaacggtgttttctgcagttgttgtttcaattggttatgcattacttggatgggattttgcagcattgttagaggctaacggtcatatggaaaaggaatttgaattggagaatttaccttctattgagggtataaccatagcagtctcagcatttggggctattgtgataacaatattctctggatccctattagattggcttggaagacgtgccgtactggttcaatcatctctgctattattgtcgggtggtctcctgatgctgtggtctcctaacatctatattctacttctagctaggttaattgttggatcaggaagtggtttggttttcacctgtgtccctatttatatatctgaaatatctccttcaactatgaggggattactagtaactatgccacagttcatgttcttcataggaactatcttttcctattgcctgatattctggttaacactgatgccttcacctaagtggagaattatgattggtgcaatctttgctccttccattgtgtacttggctttgttggtgtactacttgccagagtcacctaggtggcttgtaagtgatggaaagattagtgaggccagagtttctctacagtggcttagagggaagaagcatgatatttcaggagaaattagtactattgtggaaggtgtggactttatctctgacacagccattggcactgctcaggctcaaagtttctctagaatcagttctagccagatttggcccaacaatactttttattggcacctttcagacccactagttgatcttcttggaagcattcatgagactatgtcagaagcaacaggaagtagacggaatagtttcttccccgtcttcaacagtttttcttttccagaacatgaacatatgaacgagcatagggatgataacagtgatcaacagaccaggggggtttattatgctggagaagctaataatggagatggtttgcgaacttctctgctttctcagacagcaaatgttgaagttaacgatacaaatacatcttttacttctgaagggagctcttcatatttaagaaggcatggtacatcagcatttgcgcaagagtttgtggcatcttttattgataatgacattgaagaagaagatgaagaaacccatgggatggcattgccttaccagcctgcatatcggtatatggaaaacactaggcgacatccatgcagatatcgaatcctccggctatctgaaacagctgatatgaagtctaaatggcgggtgcttcttcagccaggaatcaggcatgccttgtgttatggcatgctaattcaagctcttcagcagtcagcaggaatcagtgtccttctccgctacactcctgaaatacttgaacaggttggagtggttagtttgttttcagacattggactttctcctcattcaacatcaattctcataagtgcccttaatgctttgctgttgctcccttgtataactgctgcaatgctgctgatggatgtctgcgggagaagggctcttatactggccactactccaatcctgatgttatcactgagcgttatgtctttgtccaccctggtggatatgggatcattggagcgtgccatcctcttccacctcgcgttaaccatttgcttctgctcctacgttgttggtttggggccgatacccaacattctctgctctgagatgttcccaaccaaggcccgtgcgacctgcgtgagcttctgttctctttccttctggttcggaggtctgctttcagcatactgcttccctgtgatgctgagtaccatcgggctcggcggagcatgtgggatctatgcacttgtgtgttgcattcctctttgtctcgtctactatagaataccggagacgaggacgcttaacttggagttaatcgccgaggtcttcaagctttcaaggcagctgccgtatgtacagtaggttgctcaggactgaaggtagaggtagctcaggctgggtgctgaactgctgatggatgatgtgtgta

SEQ ID NO: 318 - DNA, 773 bp, Setaria italica
aggaggccatcaaatcacagggggcgccaggagccggagcgcgggagggtgggagaggaatggagccggcagagcgaatcgagtcggggaaggcgctggggaagcgcccgaggagcagggtgctgccccggacggccagcatggtgacggtgccgtcggcggctaagcagggccgccaggagcggcgcgccggcgtgacgtcgtccacttccctgccagctggtggcgcggggatgggagacggaggatccggcgccgcgacgagggcgttctactccggcggctacctcgccggcgcggagacgacggcggcgttcttgaaggcgtgcggcctctgcaaccgccgcctcggacccggccacgacaccttcatctacaggggcgaggtggcattctgcagccaggagtgccgggagcagcagatcgagtacgacgagcgcatggagcagacgtgctccctaacctccatcaaggaggccccgtccgtctccggcgccagcggctctgaccagtccggcagcggcggggagaccgtcgccgccgcctagcccggcgcaacggcggccgtggtggtgcaagcggcgcatgttgcccgcttggcaccctggagcagcggcaccagatcgagatcagtctgtcccttgttagttttcccgggcaagtgctctagcgtctgtgtatccagcttttagctctagaagtcgtcgtcgtcgctcatgaaccgtagcggcagcgggagatggatcttcaggagaggaatgcgtcagtgattt

SEQ ID NO: 319 - DNA, 980 bp, Setaria italica
gagaagtagcgtgagaacgagggttttcaatatggcgtccaggatcgcactcctgtgccttcttggcttgctggtagcatcacctgctattgctgactccggcatctactaccagcttgaattgatgtggccaggggcgtactgcgagcagagcagcgccggatgctgcaagccgacgaccagcgccaagccggcgcgcgacttcttcatctcgggcttcaccgtctacaacgcgacgaccgacgctccggtgaaccgctgcagcaacaaagctcctttcgaccctaacgagattacggacatcccaggcctgaagcagtactggagcaacatcaagtgccccagcaacaacggccagggcggctggaagaacgcctggaagaagtccggcgcctgctccggcctcaaggagaaggacttcttcgagaaagccctcgagttccgcagccggctcaacccgctcgttcgcctccagaaaaacggtatccagccggacttcgagctgtacagcttgaagaagatcaagaaggtgttccagtcgggcatcaacgcgacgccgctggtccagtgcagcatgggccccttcaacaagtacatgctgtacaagctctacttctgcgcgacggagcagggcacgttcatcgactgccccgtggcgcccaagtacacctgctcggcggagatcctcttccaccctttcaagaggtggatgctccagcagctccagggggaggacgccgagtttgccgccgcggccgacggcgacgaccaggacgccttcgtgctgcccggcgtggccatggatatgtaaccgatggatcgatcggaagcatatgcgtgtcgtcgaggagagaccccacctgatctccgatccatccagatcgtctttcaattcgtgagtttgcgtttcggtggcgtacgcgtgcatggaataatgtcgttgttcctgctcccccgagcaaacaacaacgcagtgtagt

SEQ ID NO: 320 - DNA, 656 bp, Setaria italica
cacgtagtctcccactctcctcttctttccccactccagcgagctggcaaagcgtgacatcttggccggcgatgccggcttatgccctgacggcgaagcaggagacgaggcggtgatcagcagcaaggcggtggtgaagaagctgtaccgcgcgctggagcgtggcgacgtggacgccgtccgccgcctgctgaaccccgacgtggactggtggttccacggcccgcgggcgcaccagcacctggtgctcatgcgcctgctcaccggcggcggcggcggcctcccgttcaagatccggtcgctggacgcgttcgggccgaccgtgctggcggagggcacggacgcgacgggcgcgctgtactgggtgcacgcgtggaccgtgggtcccggcggccgcgtcacggaggtgcgcgagtactgcaacaccgcgctcgtcgtgacaaggctcggcggcggccgcgacatggaggcgcgggcggcgccggcgagcgaggatgtgtgctccaaggctcagcaggtgtggcagagccggctgccggaccaggctcggaggaaccttcctggcctcgtgcttgccatctgaactgatcagatagtgtcatgtaacagaactcctgaggcaaactggccggctgtaatttaactggccacaggct

SEQ ID NO: 321 - DNA, 1212 bp, Zea mays
gctgccttatcctctgctactgccgcaccaaagcgtgagcaagcctgcctcccgcgagagcgctcaaccagccaagccggcgtcagaggcgagcagagaaatggcgggagcgaacttcctctccaccgcggcgctcgtcgcccgcggcgtcgctgcctgctcttctatttcaactccgacacggaggcacccgcaaatccgggtgtgctgccgggctgacgttgaggctatggaggcctatgcccatgaagagcgccttcgattccgtcggagagatttcatcggcacctgcgtcggcaccgctattggtttggaaatgatcgacggctctacgagtttctctggagtggctactgcagctgatctcattgagcgtagacaaaggtcggagttccaatcaaaaatcaaagacaccctttacgtagccataaaggctaagccagagctcgttccatcgttgttgaccatggcactgaatgatgccatgacatacgacaagaccacaaaaactggaggcgcaaatggatctatcaggctagaaacaagcagacctgagaacagtgggctctcttccgcgttggatttgctgactgaagccaaaaaggagatcgattccttttccaagggaggtcccatttcgtttgcagatctgatccagtttgcagcacaatcagcactgaagagatcgtttcttgacgctgccattgccaaatgtggtggaaatgaagagaagggaagaacactgtactctgcatatggttcaaatgggcagtggggtctgttcgatagaacgttcgggagagcagacgcacaggaagcagatccagagggaagagtgcctgactggagcaaggcttctgtgcaggagatgaaggataggttcgtcgctgttgggttgggtcctcgccagcttgctgttatgtcagcgttccttggacctgaccaggctgctacggagggacgactgatagctgatccggattgccgtccatgggtggagaagtaccagcggagccgcgagaccgtctcccggactgactatgaggttgacctgataactacactcacaaagctgagctcccttggccagaagataaactacgaagcctacacataccctaagcagaagattgacctgggaaaactgaaactgtaagagatgattgccgggcacctgcatcggccgtatccaggaatcgggagctaattgta

SEQ ID NO: 322 - DNA, 731 bp, Zea mays
gtgcgatggcggcggcgcctaccgtgcggggctacgggccagcgtcgccgtcgtcgtcgtcggtggcgctgcctcggccgcgatcgcgggtgcccgcaccgctcgtgcccgtgacgacgcggcggggggcgccgtcggtgcgcctgcgcgcggcgggcgcggacacgcctccccgcggcggcctgcagctccagcggcgggaggaggacgaggggctgccggggaccgtgttgggccgaggggaggacgatgaggtgtcggagaaggtcggggaggagaaggtggagaggtggatgcgggactcgatcgcggagatcgtgcggcacgtcggggaggcgccgttcctggtgcacctgttcagcagcggcgagggcgagcgcgtgacggtgcggcgggagcccgcggcgccggagagctggccggacgtgcggcgccggtgggggccaggcggggcgcggaggccggacgggatcatcctggtcgagcaggtggcctcggacggcggcggggcctccgccgcctcggaggcggcgcggcaggtgtgggggctggtggtgcaggcgcgcggcatggagcgcgcgtcgtgctacgtgctttccacctgccgcgtgcgctcgtcggccgggttctgcacgcacttctgcctcgcgcgggcgcagtgcttcggcgaccctgtcgagctccagctccgcaacgcctggctcaaccgcctggccggccgccggtagtag

SEQ ID NO: 323 - DNA, 2743 bp, Zea mays
gggtactgtagagagaccgggtagagatagagaggccaggatgagagtggcggtggtaggcgccggcgtgagcgggctggcggcggcgcacgagctggcgaggagcggcggctcccgggtgaccgtgtacgagaaggaggactacctcggtgggcacgccaggaccgtggccgtcgaggacgccgacgccgccagcaccgtgcagctcgacctcggcttcatggtcttcaaccgggtaacatacccaaacatgctggagtggtttgaagggctcggtgtagagatggagatatccgacatgtccttctcagtgagcacggaattgggggccagcggcagcagatgcgagtggggcagccgcaatggcatctcaggactcttggcacagaaaagcaatgcactcagccctagtttctggcgcatgattcgggagatactcaagttcaagaacgatgctctcaggtacttggaggaccatgaaaacaaccctgatatggaccggaatgagactctcgggcaattcattcggtctcatggatattcacagttcttccaagaggcttaccttaccccgatctgtgcgtgtatatggtcatgcccatcgcaaggagtgttgggattctctgctttctttgtgctctctttctgccgtaaccatcatcttcttcagttgttcggtcgcccccagtggctcaccgtgaagggtcgttcgcactcctatgtacacaaggtaagggaggagttggaaagtatgggttgccaaattaaaaccagctgtgaaatcaaatctgtttcaagttctgagggaggtttcagggttacagtgtttgatggttcagaggagacgtatgacagaatcatatttggtgtccatgcacctgatgctctaaagattctaggagctgaagcaacacatgaagaattgaggatcctaggagcttttcagtacgtctacagtgatatatacctccactccgataaaagtttgatgccacggagtttgtctgcttggagttcctggaacttcctggggacgacaagcaagggggtttgtgtaacctactggctaaatctgcttcagaacatagaatctacaagcagaccttttctggtgacgctgaatcctcctcatgtcccagaccacgtctttcttaaatggtacactagccaccctgtcccatctgtggctgccgcaaaggcttctcttgagcttcatcacattcaaggaaacagaggaatttggttttgtggggcataccaaggttatggtttccatgaagatggactcaaggctgggaaagctgcagctcaagatttgcttggtaaggagagtgaccttttggtgaacccaaaacagatgatcccatcgtggtctgaggctggggcgcgtcttctggtaacaagatttcttggtcaatatgtgtctgtcggcaacttggtcttgcttgaagaaggaggcactatgttcagttttggtgaagtaggcaaaaaatgccatgtgaaatctgtcctgcgagtacatgaccccatgttttactggaaggttgcaactgaagcagaccttggcttggcagatgcctacattaacggttatttctcatttgtagacaagagagaaggtcttctaaatcttttcctgattctcattgcgaacagggacgcaaacaagagtagtagcagcgctgctggtaaaaggggttggtggacacccctgctattgacagctggggttgcctccgctaaatacttcctgcgtcacatagcaaggaggaattctgtctcacaaacacgtcaaaacatctctcaacactatgatctgagtaatgaattcttctctcttttcctggatccatcgatgacttactcttgtgccatcttcaagacggaggatcaaagcttagaggcagcccagctacagaaagtttgcctcctaatcgataaggctaaagtggagcgagatcaccatgttcttgagattggctgtggttggggcagcttagcaatccaattggtgaagcaaactggttgcaaatacactgggatcacattatcagtggagcaattgaaatatgcacagagaaaggtgaaagaagctggattagaggaccacataagcttcatgttgtgtgattaccgtcaaataccaactcagcgcaaatacgacaggatcatctcttgcgagatgatcgaaggtgttgggcacgaatacatggacgatttcttcggctgctgcgagtcccttttggctcaagacggcatatttgtcctgcagttcatctcaatcccagaagaacggtatgaggaatacaggcgcagctcagacttcatcaaggaatacatcttccctgggggttgcctgccttcgttagcccggatcacgtctgccatgtctgcagcatcaaggctctgcatcgagcaccttgagaatattgggtaccattactacccaacgctgatacagtggagggacaacttcatggccaataaggatgcaattttggccctgggcttcgatgagaaattcatccgtatatgggaatactacttcatatactgcgccgctggtttcaagtcacggacacttgggaactaccagattgtgttttctcgccctggcaacgacaaattaggtgacagcggtatacactccttaagcaagctttctggcagctaataatgcgaggatctatatatatgtggtggtagctggatcagtcggagcctacacacctgaacttgagcc

SEQ ID NO: 324 - DNA, 1143 bp, Zea mays
ggcatttgctacaccaccacacccacaccccatcccagcacacaacaagcagcctggtttacggtagctgctagcaaaacaatggagaaccctgctccgagcatcgtagtggccatcgccgcacccgtggcagcggagttcgtgaaactcaccttccgtgccctgtatatgcgccgggctggtcctggcagcagggagatgactgtgccgggaaggccatccgaccagctgggcaggagagtcgtcactgacagccccgtgtacgacggccgtggcgccgacgcccgcctcgtggctcgcatacagggagtcacggtcctggtcggtaacgcagacgccttgttcaccatggtgttcgaaaccgacaggctaaagggctccacgctcgtcatcaacggaatggtcacggatgggtcagacgaatgggcgatctacggcggaaccggggtgttcgccatggccaccggtgtcatgaagagaagaaaccttgccggcggtagcaacgacgggaactctgacgagcttgccctggaagttttctgcccggtgtttggcgcatcacagcaaccaattagcaagcagcaggactccatctcctccgtcaccaagatcggactatggggcggacagggagggtcggcacaggacatcacggcagagcagccaccgcggcgtctgcacagcatcaccgtccgcgctggcgttgccgtcgactccatcgagttcacctacaccgacgacgctgggcagaggcgcactgctgggcggtggggtggacttggcggcaatgttcgaacgatcgaccttggcgacgccgaggatgttagagaagtctcgggaacatacggcgcatttgaaggtgccattacgctgacctcgctcaggctcgtcaccagcagcagaacctggggcccctgggggatcgagaacgggacgcgtttctccatcacggcgcccaacggcagcagcatcgcgggattctatgcgcgggcgggaaccaggctcgtcgacgctatcggtgtttacatacgtccagtggtgccaggcaggcctcggtgaaccagcgagctagcccagtctgatcgactcagctcgctcgtattacgagctgtaggattatggttcggcttgacttgatgtagg

SEQ ID NO: 325 - DNA, 640 bp, Zea mays
actgtatttttctctcctcactcaacgcggcgatgccccctagatcggatcacgccgccggcagcggcgccgcggcggcggccacgcaggcccacttcgactccatcgatccactcttccatgtgctccgcgtgctacccttctccttcctcctgccgccgcgcacccgcctgaggctgccgtcgaacctggcgcttccctctcccatgaccgtcttctccctcatcctgctcacctactttgcggtcgtctccggactcgtgtacgacgtcatcgttgagccccctggcatcggcagcgcccaggaccccggcactggcgccgtccgccccgtcgtcttccttccagggcgcgtcaacggccagtacatcatcgagggactctcctccgggttcatgttcctccttggcggcattggcatcatcctcctcgacctcgccgtcgaccgcacgaggccccggagcctccgcgtctcgtttggaagcgccggcgcagtcgccgttgtcatcgcctacgccatggccatgctcttcctccgcatcaagatccccggctacctctggtgaggttgataaatcttgcctgttaactagaccagatccgtcgcgagatctcgctgcatctaaatagacctgcgtgc

SEQ ID NO: 326 - DNA, 1427 bp, Zea mays
aaagtcgactcagtagtggatagctccgctcgcggtcgcgggcggctcgagtcgcaccccagatcccaatgcgccccgccgcgccgctctaggccgcggaacggaagctaggtgcgtcacacgccggggccggtcgcggtcaccggaccggacgcacaggggcgccgtacgtgcagtcatcggccatgaaggtcctcgtcctcgccgtgctggcgctcgtcgccgccgccgccgccgccggtcagggcgaggaggggggcgggccgccgctgccgttcgcggtgggcgcggcgccggcgggctgcgacgtcgcgcagggcgagtgggtgcgcgacgacgacgcccgcccatggtaccaggaatgggagtgcccctacatccagccgcagctgacgtgccaggcgcacggccgccccgacaaggcgtaccagagctggcgctggcagccgcggggctgctcgctgcccagcttcaacgcgacgctgatgctggagatgctgcgggggaagcggatgctgttcgtgggtgactcgctgaaccgggggcagtacgtgtccctcctctgcctcctgcaccgggccatccccgacggcgccaagtcgttcgagacggtggactcgctgagcgtcttccgggcgaagaactacgacgccaccatcgagttctactgggcgccgatgctggccgagtccaactccgacgacgccgtggtgcactccgccgacgaccgcctcatccgcggcgcgcccatggacaggcactccagcttctggaagggcgccgacgtcctcgtcttcaactcctacctctggtgggtcgccggggacaagatccagatcctgaggggcgccgacaacgacccgagcaaggacatcgtggagatgaagtcggaggaggcctaccggctggtgctgcaccaggtggtccggtggctggagcgcaacgtggaccccggcaagtcgcgggtgttcttcgtcaccgcttcgccgacgcacacggacggcagggcgtggggcgacgacgacgcggagggcagcggcaactgctacaaccagacgtcgccgatcagcgccgcctcgtcctaccgtggcggcacgagccaggagatgctgcgcgcgacggaggaggtgctggccacgtcgcgggtgcccgtcgggctggtcaacatcacgcggctgtccgagtaccgccgggacgcgcacacgcagacctacaagaagcagtgggtggagccgacggccgagcagcgcgccgaccccaggagctacgccgactgcacgcactggtgcctccccggcgtgccggacacgtggaacgagctgctctactggaagctcttcttccccagcaacgatcaggtcctctgatggtgcattggtgcctgcatacatacgcctggaaaccaactgctagggtagggatccttt

SEQ ID NO: 327 - DNA, 929 bp, Zea mays
agaatgggttgggaattatgcctagatcccgtataaatggaaatttcattgataagaccttctcgattgtagccaatattttattgcaaataattccgacaacctccggggaaaaaagggcatttacttattatagagatgggatgttggctcaatccgaaggaaattatgcggaagctttgcagaattattatgaagctatgcgactagaaattgatccctatgatcgaagttatatactatataacataggccttatacacacaagcaatggagagcatacaaaggctttggaatattatttccgggcgctagaacgaaaccccttcttaccgcaagcttttaataatatggccgtgatctgtcattaccgaggagaacaggccattctacagggcgattcggaaattgcggaagcttggtttgatcaagctgctgagtattggaaacaagctatagcgcttactccaggaaattatattgaagcacagaactggttaaagattacgaagcgctttgaatttgaataagaccactctccattttcataaaaagggtggtttggttgaaaatcaaatcaagaatttcattatatccctttcttctaccttcaattttatatcatatttcataaggataaacaatagggataggctctggaacagaagtaataaagtacataaaaatcggcaatctaaatattcctacctaatatatcaggacggtcttattaataattctaatgagttatcttggaattttgaatcgaatcaaaaaatctatattatgctcactcaaggaaagtagatgtagataggggcttataccctcagaaaaaaaatacaccagcttcttaaattaaaacgtaaaaaaagatttttttgttatgtcgggaaataattttccagaataaccaatgtccgttaggc

SEQ ID NO: 328 - DNA, 1137 bp, Zea mays
cgccatctttagcctggaccccacctcccgtgcctcggccattaaagcgggggaggccgacccgggcgctccctgcctcctcgtcccgtcccgtccctcccagcgccccgttccattccaccgccgaccagatccacccccaacacgtccagccatgccggcgccgccgcatccaacgccgctgctgccaccagcgggggagccgttccgcgtgttcgtggggtacgacccgcgggagcacgaggcgtacgaggtgtgccgccgcagcctgctccggcgctcatcgatcccgcttgacgtgcgcccgatccggcaggcggagctgcgcgccgcggggctgtacacccgggcgcgcggccccacggagagcaccgagttctccttcacgcgcttcctcaccccgtacctggcggggtaccgcggctgggcgctcttcgtcgactgcgacttcctctacctggcggacctggccgacctcctcgccgccgcggccgccgccgaccgcgcggccggcgccggccgcattgccgtagcctgcgtgaagcacgagtaccagcccgccgaggccaccaagatggacggcgccatccagacggtgtacccgcgcaagaactggtcctccatggtgctctacaactgcggccaccccaagaacgtggccgcgctcactccggaggccgtcagcacccagacgggtgccttcctccaccgcttcgcctggctcgacgacgacgagatcggggaggtgcccttcgcctggaacttcctcgtgggccacaaccgggtcgacccggccgacccggacacgcgccccagggccatccactacacctccggcgggccgtggttcgagcgctacagggactgcgagttcgccgacctctggctcaaggaggccgaggagctgagggccgacaaggacaaggaaaaggacaagctcaagctcctcaaggaaatggacgacgccaacggcaagcaggaggtggaggaagaggcggcgcaggagaaggaggagaagggcaagtgatggtgatattcatccatggatcggtgatgctgcattgtgtggaagtggattggttcgttctgtgctttgctgctatagaggtttcattctttcatctgtcttcgacacca

SEQ ID NO: 329 - DNA, 1630 bp, Zea mays
gcctctgctctgctcgtcgccagccggccggccgggccatcgcacgtcgctggcaggcaggcatgggaaagaagcacgcggcaggtggcggctggttcgccgccgtcaggaaggtgttccggccgtcgggctccggcggctcatccgcgaccgcgaccaccaccacctcctcgtccaaggacaaggacaaggacgccgtgcagcacggaaaacaggacgccgccgccgccgaagagccagaggtgctgctgctggagcacttcccggcgtccgagacgtcggcggaggcgagcaacgagggcggcgacgcggaggcggagccggcggcggcggcgacgaagggtcgtcgtcgtcgagaggacgaggtcgacgacgaggatggggagatggaggaggagctggccgacgacatggagcgcgcgagggcgctggcggccgcggccgaggctgccgtggccgcggccgaggcggctgccagagtggtgcggcttgcggcgctccggcgcctgtcgcgcgaggagcgcgccgccgtgcgcatccaggcctactaccgcggatacctggcccggcgagccctgcgcgcactacgtggcttggtgcgcctgcaggcgttggtgcgcggtcaccaggtgcggcggcaggtgcacctcaccatgcgctgcatgcaggccctcgtccgagcccaggcccgcgtccgcgcgcgccgcctcacccaacacccgctcctcctcctcccgccgccgacacctccagccagcagtcccaccctgctgttgggtgcggggcgtccactatgcgtcgagctggcattgcagggcgaccacgacgtcggtgacgacggcgaggtggccgatctgttgctccagcagagaagcaggagcagaggcaggtttggaagaggcgacgataacggcggcgcgaggagcccttccggggcctgggacagcagtagccgcaccctggaggacgccagggcggagggcgcgcgccggcacgacgccgccgcacgccgggagcgggcgctcgcctacgcctacgcctaccagcagcggcagtggcagcggcaggaggacgagaaggccggcctgggcttccactggctagagcgctggatggctgcgacgacgcaggcgcagcagcaggagcacgcgcccgaccacgccaagacgcaccagagcacccccaccaggacgtcgtcatcctacgtgacggcggccgctgctttcgcgaacggcatgtcggagaagacggtggagacggagacgacgtcccggagcccactgaaccaggccgccgcggctgctcacgggcggccacccgcgatcccaggctacatggctgcgacaaggtcggctcgagccaaggcgcgccccgcgccgccgtcggctacacccacgcatgccaggagccggtcgggtggcgggctcgccggggacacgtcgagctcgggccagaacggcagtgcggtcgccgggtacagcccggactcgagctgcacaggggactggaccccgccgcggctcggtgtcagcacgcgcaccagcagggtggcctatacttgagccttgacttgagcatggcgacaacatcagttgcatcatcatgaatgtgcgcttgagagttgagactc

SEQ ID NO: 330 - DNA, 2089 bp, Zea mays
gatgatgctgatgctcgtttagttatcttggtttggagatatatcagatatgggtgatcggaatcatggacgctctctccctctactgctctatctacatcttttgctgccaatacttccgtttgctatggcagatatagcctccgagaagcaagcactccttgcttttgcctctgcagtctaccatggcaacaaactgaattggagccaaaatatcccagtgtgctcatggcatggtgtgacatgctcactggatcgatcgtgtatattggcccttagggtgccaggtgctggtttgattggtaccattcctgctgatactcttggcaggcttgtgtccctccaagttttaagcatgaggtctaaccgtttgagtggaagccttccgaacgatgttgtctcacttccttctttacaagccatatttgttcagcacaacgaactgtcaggagacttgcctccatttctctctccaaaccttaatacccttgatctctcttacaactcctttacaggacaaatcccatcaggtttgcagaatcttaccaaattgtctgtcttgaatttagcagaaaattccctgtccgggccgattccggatctcaaacttcctagcttaagacagctaaatctgagcaacaatgaactgaatggttcgattcctccctttttccaaatcttctcaaatagttccttcctagggaactctggattgtgtggaccgccgctaactgaatgttcttttctatcttcaccaacaccgtcgcaagtgccttcaccaccaaaattaccaaatcatgagaagaaggctggcaatggcttggtaatcgtggctgttgctgggagctttgtcatatttctgctagctgctgtgatgttcactatgtgcatttcaaagaggaaggagaagaaagacgaagcgggttacaacggtaaggttactgatggtggaaggattgagaagcgcaaagaggatctcagcagtggcgtccaaatggcgcataagaacaagttagttttcttggagggatgcagttacaactttgacttggaggacttgctgagagcttctgctgaagttctcgggaaagggagctatggaactgcctacaaggctatactcgaggatggctctactgtggtagtcaagaggctaaaggatgtcgtggcagggaagaaagaatttgagcagcagatggagctcatagggagggtaggtaaacatgcaaacatcgcgcctattcgtgcttactactactcgaaggatgagaagcttgttgtttatgagtatattggtagaggcagcttctcagctctgttgcatggtatcaagggcgtgtgtgagaagaccccattagattggaacacaaggatgaagattatactcggaacagcacgcggcctcgagcacatccattcagaaggcggctccaggctcgcacacggcaacatcaagtcaaccaacgttctgctcgacggagaccacaacccttacgtctcagactacgggctgagctcgttgacgagccttccgatcaccacttcccgagctgtcgctggctaccgagctcaggagaccttcgaatcgaggaagttcacccacaagtccgacgtgtacggtttcggcgtcctcctcatggagacgctgacgggcaaggccccgcttcagtcacagggtcaggacgacgccgtcgacctaccgaggtgggtgcattcggtggtccgcgaggagtggaccgctgaggtgtttgacgtccagctgatgaagtatcccaacatagaagacgagctggtccagatgctccgtatcgccatggcgtgcacggcgtggtctcccgaccggcgtccgacgatggcgcaggtggttaggatggtggaggagctccggcactctgcttccgggagtcgcgctctctccgttggcagtcccaaggaatccagccctctgtcagcctgaattgtggttctgattcagaattcgtgtatccatgacatcgatgatcgatggtatcctgcatgtggttcacggtgcacacgttgtctgcctcgtcagatacttcgtactgctgtaactttggttcaatggtag

SEQ ID NO: 331 - DNA, 908 bp, Zea mays
cccccatggcctccttctttgcggacgacggcgccgacgacctcccgcgcgccacctcccaccccttcgactccgacgacttcggtgctgccgcagccgacgacgctagcgccggcgggtacgcctccttcgccgacggtggcgtcgaggaggtggacgaggagatcaccgtagagtcctacggcgtcccgatccgccacgtctccgggggatactcgccattctcccccgacctcgagcccaacggcagcgacggcccgaccctgccgccgcccaccgagatggggcgggaggagggaatccttctccgcgagtggcggaggaaaaatgctatggaacttgagaaaaaagaacagaaggagaaggagctacgtgcccaaataattgctgaagcagaagaattcaagaaagctttttttgagaagaggatacagaactgtgcgtcgaatatggtcaacaacagagaaagggagaagatttttgtagccagccaggagaaattccatgccaacgcagacaagcagtactggaaatcgatctcggatctcatcccgcatgaaatagccaccattgagaagcggggaaagaaagacaaggacaagaagccatccgtcacagttattcagggccccaagcctggcaagcccaccgacctctcccggatgcgccatatcttagtgaagctgaagcacgctccaccgccacatatgttgcaacctccaccagcacctgctgctaaagagggcgcaaaggatggctccaaagaaggtggaaaggatggtggtgccaaagacggcgcggcagccccagcaaacgacgccaagcagcctgcagagagccaagaaaccagcaccgccaatggcccctcggaggccgagaaagagcagcctgcggcgtcggagtgatga

SEQ ID NO: 332 - DNA, 1186 bp, Zea mays
ctggtcatccattccacacacccaacatcacgaaaccacgcgcagatccaaacgaacccgagcccttccaaaccctaagctcgcctcccctcccccccaaacaccaccgcgcacctatggcgaagtacggcgagggcgacaagcggtggatcgtggaggagcgcgccgacggcaccaacgtccacaactggcactgggcggagcgcgactgcctggagtggtcccgcgcgcggctctcttccctgctcgcgggcctcaccatcctcgacggcgagggcggcctcagtctccgcaccgtcgcgctcgacaagcttgatggcgaggcctacgtcaacatccgcaagggcaaggtcatcccggggtacgagctctcgctcaccctctcctgggaggccgaggccgcctcggagtccggagctgcgaaggtcaccggcaccgctgaggttccctacctcgccgacgagaacgccgacgaggaccccgacctccgcgtcaccgtgcgcggcgacgagacgcccctcgcgctccgcgccaaggacgccttcctctcccgcgggaaacccatggtgctcgagaagatccgggagttcgtcgctgccatggccaagggtggaccggccaaggacgagctggactccaagaaaactcccacgaaggtcgccggctccgcaccggcgaaggaggcggtactggctcctgcgccggctgtggagaagaaaaaggccaaggggaaggacaaggagggcttcaagaccattgagatgacggagaagttctactgccgctcaaaggacatatatgagatcttgatggatgagaacagatggaaagggtttacgcagagcaatgcgaggatcagcagagaggttggaggggaatttagcctcttcgacgggtccatcactggcgtcaacgaggagctgcaggaagggaagctgattgcacaaaagtggcggtttggaagctggcctgacggcttgtactcctcggtccggttggtgtttgatgagcccgagtctggagttacaatcataaagctcaaacaaactgatgtgccagaggaagacaagtatggaaattcaactgtggtagagaacaccgagagaggctggagagaactcatattccagcggatacgcggagtgttcggttttgggatctaaagaatctaaagaggcgatttggc

SEQ ID NO: 333 - DNA, 1158 bp, Zea mays
gcaagtgagccatcactgagctgtggacgtgaattgcgatcatccgttctcgctttctggggctcggctgctgtggccatggcgccgccgccgccgccgtacgcgcgggtgatggaggacatggtcaagggccgggagtacgccacgcagctgcaggcgctgctccgggagtcgcccgaggccagccgcctcgtggaccggatcctgcacgccatatccctcaccatccagacggccaaggccgcggccgccgccgctgaggaggaggaggaggaggaggcgtccgaggtgcagagcgaggtcacctgcaccggcaagaggaaggccgctggcggagcgggcaagagggccgccgcgtgtcggaggagagcccagccatcgtcggttgtgacgaagagcgtgagggatctggaggacggacacgcgtggcgcaagtacgggcagaaggagatccagaactgcaagcacccaaaggcctacttccggtgcacgcacaagcacgaccagcagtgcgcggcgcagcggcaggtgcagcgccgcgacgacgacccggacgcctacacggtcacctacatcggcgcgcacacctgccgggacccggccaccgcagccgacgacgagctccacgcggggtcccgcctcatcagcttcgcggcggccaacgccaccacggccagcaccaccaccaccaccggaaacgccagcaaccggcaggccggacacaagggcgccgtgctgcctgcggagcccccgaggcagctggagggcggcggcggcggcggcgagcgggagcaggagctggagctggaggaggtgcttagcagcctcaccccggcggggagctccgctgccacggccgaggcggtgcggaccgccacgcccggcccggaccagggcgacgtgacgtctggcctccagctgcagcagcagcagcagcactggttcggcggcggcggcctctcgggcgtggcgcacttggggtacgacgacacgttcgatctggaagacattgtgttcggctccatcaccggcggcatgtatgctgctgagtactgacggccggacgacgactggtcgacctgctgtgtgttggaggagagtaggagacggtaggtagggtggagtggagccagggcatgttgatggatcgagctgtga

SEQ ID NO: 334 - DNA, 1150 bp, Zea mays
cgaatcctgcctagccttcgccgccttcctccgctcgagcggctcgccgaggaaatagcgaaagggcgctatgagttcagcgaatggtacaaccaatgtccatgggaaagaagcagcaccgtatgaggagcagctgttcaagattggtaaagttagaactgacctaggacaactatctggaaaatcagctctatattgctcagatgcttcaattgcaaggtacctgatagcaaggaactgggacataaggaaggctactaaaatgctgaagaaaaccttaaaatggcgttcagaatataagccagatgaaatccgttgggatgacatatctgatgaagcggtaactggaaaaacttaccgaactgattactttgacaagatcgggcggagtatccttgtcatgagacctggatgccagaataccaagaatgccaatgggcaagtcaagtacttggtgtactgtatggagaatgcaattctaaatctgccacatggtcaggatcagatggtttggctcattgattttgctggtttcaatttaggcaacttgtcaattcaggtgacaaagatgacggcagatgtcctacaaggccattatcctgaaaggttgggtgtggcaattctttttaacgctccaaagttttttgagcctttctggaagatggcaagcccccttcttgagaagaagaccagaaacaaggtcaaatttgtatactcagatagacctgacaccatgaagatcatggaagaccttttcaacatggatgagttagaatgtgcgtttggtggcaagaacccagctactttcaatataaatgattatgctgcgaggatgagagaagatgacaagaagatgccatcattttggagccctgagaattcagctcttgcttctgagccatatcagatgagcagccaaaaagccctaggaagcgtttcaggtgcgaagactgaagatgctggatctggaaagatggacgacatggagactgctcctgaaaagagtgaagaatcgggtactgaatctggagaggaggtacaaacacggactgaatcaagcacagttgagcagaaaaacttgcctggagaagataatgccccagcagataaaagtggcctttaatctgatctccgggtatcaccatgaaac

SEQ ID NO: 335 - DNA, 1615 bp, Zea mays
agaaacttccgtgtgtaggtgacccccggctttacccccgcccttctcgccgtagttttcagtggtacaagcaagggaggaacgaacgtgagggctgcctgcctgcctgcggacatgggctccagcctcaagtaccgatctggcctgtgcctcatcgtcgccgtcgtgctgatctgggtcatctctgccgaggtcacgcaggggatattcacaaagtacagacatccatttgcagttacttacttgggggcctcccttatggtcatatacctccctttgtcatttctaaaagattttatatacaattcgttgagaaggcattctagaaacactagtgcttccaaaattgcaagcaaatcttcctttggtggtagtgcccctttgaagaatggtgaatttcagaagatgttggaaatggaatcacagaaaactatagtggtaaattgccctgatgtgagcatccctgtagtggaagagacaaaaccactcatatgcggaatcactgaaatggatgatggccttttcaaggacaagcaactttccactaaggagattgcaacgtatggattgtatctttgccccttatggtttgtgacagagtatttatcgaatgcagcgcttgcaagaactagtgttgccagtaccacagtgctgtcttcaacttcaggactcttcactcttttcattggtgttttacttggccaagactccataaatgctgcgaaaattattgctgttttcattagcatggctggcgttgtaatgacaactgtgggccagacttgggcatctgatgaatcagaagcaggcaaatctggttttacacagaggactcttctaggtgatatgtttggtcttatgtcagcaatcgcctatggtctatttactgtgctgcttaaaaaattttgtggagaggaaggagaaaaggttgatgtccaaaaactgtttggttatcttgggctttttacccttgttgctctatggtggattgtctggccattaaccgcactaggcgttgagccaaagttttcaatgccccactcagctaaagtggatgaagtggtggtggcaaatagcctaatcggaagtgtattatcagactacttctgggctctttctgttgtttggactactcccttggtggccacactaggcatgtctctcacaattccaatagcaatggttgctgatatgatcatccacggccgtcactattcagcagtatatattcttggttctgtccaggtattttcaggctttgttatcgcgaaccttgcagatcgcttttctcgttctctagggctatcatagtctcataaaacagaacaggcccttattagtgcgtgcatcaggaagctcgaaggtcgggttggttaggccaatacttcagaaaacctggatcgggagatgccagaaattattttccctttgcttctttaaacatagtggaggtgaattttgccgtggtgaatagtgaaaggcagcagatgaagaagaaaacatatgttatagcaaccctttgcaactgtaaattctcttactacaaattgcgcgacagtgtagactgcggccgttctcggcccatgtcaacaggcttgctcgatttcaaatttgc

SEQ ID NO: 336 - DNA, 1662 bp, Zea mays
ggatcctggctgtctcggtgtcaaaggatcctggctgtctcggtgtcatcgtctcctctcgtctcgttctcttctcctcacctccttcgtttctcggagcagagcgagcagccggcaccggacctccaaggagcgcaccgcggaggccagcgaagatgcccgggctcacggcaccgtccgactacgcggaggagccgccgcgtcacccggccctcaagatcaactccaaggagccattcaatgctgagcctcaccgatcagagctagtcgcatcttacatcaccccagtggatttcttctacaagaggaatcatggacccatccctaaagtcgaggacctctcaagatacgctgtttccatttctggtctcgtcaacaagtccattcagctatcgatggctgacatttggtctcttccaaagtacaatgtcacagcaactttacagtgtgcaggaaacaggaggactgcgatgagtaacgtacggaaagtgagaggtgttgggtgggacatatctgctcttggaactgcaacttggggaggtgccaaactatctgatgtccttgagctagttggaataccaaaactcagttcagtcacgtctctaggagggaaacacgttgagtttgttagcgttgacaaatgtaaagaggaaaaaggtggtccttatacagcatctattccattaaatcaggcaacaaatcctgatgctgatgtattacttgcatatgaaatgaatggagaggtactcaaccgggaccacggatacccgctccgggttgttgtacctggcgttattggtgcacgctctgtaaaatggctggacagtatcaacgtaaaagaggaggaatgccaggggttttttatgcaaaaagattacaaaatgtttccgccaaccgtggactgggacaacattaactggtcaactagaaggccacagatggatttccctgtgcagtctgctatctgtacactggaagatgtagatgttatcaaggaaggacaggctaggattgctggatatgcactttcaggtggtggccgtggcattgagagagtggatgtatcagctgatgggggtaagacctgggtcgaggctcgtagataccagaaagacaatgtggcgtatgtgtcagatggacctcaaagtgacaagtgggcttgggttctctttgaggccacattagacgtaccagcgaatcctgagatcgtagttaaggcggtggactcagctgcaaatgttcagcccgagaaggtagaagacatatggaatctgagaggaatcctcaacacgtcttggcatcggatcaaaattcagagatctttgtgcgttgaaagatctaagctgtgaaattaagtacgcagctgatcacttggagcaagcagactcactttaccattgtcccagaataataattagtcacttcaactttctgcgtctgtggagtaaggttgtacgagtgttggggctgtgtcattatgggatttgagctcacttggtttctgtgtaaatgtcagctgctgcggtttttttggtcactggatgactgctgctgttggctggtcaggtttgatatcgagaaatatccattgcattctgcgtttgaaaatactattgcagcataaaacctttctttgggcaaatggcagctctgggaggtacc

SEQ ID NO: 337 - DNA, 2513 bp, Zea mays
gaagcagcagcaggtaaagaaccggaagccaaccaggagcgcattcccactcatcaaccagcagagctcagatataagctcaccagcactaccccttcccatcctctcccactccctcctccctccccctcgtccagtccacacccattgggcgagaagccgagaaggacagggagggagcggaagctagccaggccgtcccgtccagagccgctatgtccggcggcgcgcccctcctggccctgctgctgctggcggcggcggccatgatcgccccgtcgccggccaatgccgccgtgtcgtacgaccacagggccgtggtcatcaacgggcagcgccgcatcctcatctcggggtccatccactacccgcgcagcacgccggagatgtggccgggcctgctgcagaaggccaaggacggcgggctggacgtggtccagacgtacgtgttctggaacgggcacgagccggtgcgtgggcagtactacttcggcgaccgctacgacctcgtccgcttcgtcaagctcgccaagcaggccggcctctacgtccacctccgcatcgggccctacgtctgcgccgagtggaacttcggcggcttccccgtgtggctcaagtacgtccccggcatcagcttccgcaccgacaacggccccttcaaggcggcgatgcaggcgttcgtggagaagatcgtgtccatgatgaagtcggaggggctcttcgagtggcagggcgggcccatcatcctggcgcaggtggagaacgagtacgggcccatggagtccgtcatgggcgccggcgccaagccctacgccaactgggcagccaagatggccgtcgccaccggcgccggcgtgccctgggtcatgtgcaagcaggacgacgccccggaccccgtgatcaacacctgcaacggcttctactgcgactacttcagccccaactccaacagcaagccgaccatgtggaccgaggcctggaccggctggttcacggcgttcggtggcgcggtgccgcaccggccggtggaggacatggccttcgccgtggcgcgcttcatccagaagggcggctccttcgtcaattactacatgtaccatggaggcaccaacttcgaccgcacctccggtgggccgttcatcgccaccagctacgactacgacgcgccgatcgacgaatacggtctgctgaggcagccgaaatgggggcacctgagggacctgcacaaggccatcaagcaagccgagccggcgctggtctcaggcgacccgactatccagtccctcgggaactacgagaaggcgtacgtgttcaagtcgagcggcggcgcctgcgcggcgttcctgtccaactaccacaccagcgccgcggcgcgggtggtgttcaacgggcggcgctacgacctcccggcctggtccatcagcgtgctgcccgactgcaaggccgccgtgttcaacacggcgacggtgagcgagccgtcggcgccggcgcggatgagccccgcgggcggcttctcgtggcagtcgtacagcgaggccaccaactcgctggacggccgcgccttcaccaaggacgggctggtggagcagctcagcatgacgtgggacaagtcggactacctgtggtacaccacctacgtgaacatcaactcgaacgagcagttcttgaagtccgggcagtggccgcagctgaccatctactctgccggccactccctgcaggtgttcgtcaacggccagtcctacggcgccgtgtatggcggctacgacagccccaagctgacatacagcggctacgtgaagatgtggcaggggagcaacaagatctccatcctcagcgcagcagtcggcctccctaaccagggcacccactacgagacgtggaacgtcggagtgctcggtccggtcacgctgtccggcctcaacgaggggaagcgggacctcagcgaccagaagtggacctaccagatcggcctccacggcgagtcgctgggcgtgcagtccgtcgccggtagctcgtccgtcgagtggggcagcgcggcagggaagcaacccttgacatggcacaaggcctacttcagcgcgccgtccggcgacgcgccggtggccctggacatgggcagcatgggcaagggccaggcgtgggtgaacggccgccacatcgggcggtactggtcgtacaaggcctcctccagcggctgcggcggctgcagctacgcggggacgtacagcgagaccaagtgccagaccggctgcggcgacgtctcccagaggtactaccacgtcccgcgctcctggctcaaccccagcggcaacctgctggtgatgctcgaggagttcggcggcgacctgtccggcgtgaagctggtgaccaggacggcgtgaccaggaatggagaggggagggcatgccgcacgcacacaggatgtgaataatttgctgggaagagaagcgagctgagggcagggcgcgcgcgcgcgcagacacgacacgacacgacaccgattctttctt

SEQ ID NO: 338 - DNA, 2142 bp, Zea mays
gttagatcggctgtgcttgttcctcgcttcttgctggatcagaggaggtcatgatcaactaatgcctattcatttattatggacttgcaccagttgttaaagtacagattaactggtgctaacgtctactacgaatttcctacagagaacaacttagcaaacactccttggccagctagtccactgaagtctgagttcagcagctcatcatacactcctctttcatcccagcttgagtgtgataatttgtctgcgctcagcaatactccagataaccagagctccacagaaaccatttcagcacaaccaatatcaccactggaagtagacagctcatacaaacaggcagctatccttcgggagaacacccaagtgagacctgatccattgtacacaacatcaaggcataatatgcaacacgctttacgagaaatagagactgttctgatggcacctgatgctgatgatgcagccactagcaccaagcatgaatttgaggaacataaacctgctcagctgatgaggcagcggtcaaggacatggagtcatgaatctaggcagccatcaccaggagttgtacggacacaacttgcatctggataccccacagcaaggtatgagttccgcccagagaaacggctaagggagttaagggaggatccgcagagcatggtgaagcagctattaaccaagtgtgctgaagcattaagtgaggagaggatagaggagttccttaaccttgttcagcaagctcgtggagttgtatcaattactggggagccaatccagcggttaggtgcttacctccttgagggtttggttgctagacatgcaaactcaggtacaaacatatatcgtgccctgaagtgccgtgagccagagagtaatgaactcttgtcttacatgaagattttgtataacatctgtccgtacttgaagtttggctatatggctgccaatggggcaattgcagaggcattaagaaatgaggacaggatccatattattgatttccagattgcgcaagggacacagtggataacactgatacaagcgctagctgcaaggcccgggggtccaccacacgtgcggatcactggaatagatgacccagtgtcagagtatgcccgtggtgaaggtctggaccttgtagggaagatgttgaaaagcatgtctgaggaattcaggatacctttggagtttacccctctgcccggtatttacgcaactcaagttacaaaagaaatgctggacattaggtcaggcgaagcacttgctgtcaacttcactctgcagctgcaccacaccccggatgagagcgtggacgtgaacaacccacgggacgggctactccggatggtgaaaggcctgtctccgaaggtgaccacgcttgtggagcaggagtcgcacaccaacacgaccccgttcttgatgcggttcaccgagaccttggactactattcggccatgttcgagtcaatcgacacgaacctgccacgggacaacaaggagcggatcaacgtggagcagcactgtcttgccaaggacatcgtgaacatcatcgcctgcgaggggaaggaccgggtggagcgtcacgagctcctgggcaaatggcggtcgaggctgaccatggccgggttcagaccatacccgttgagctcgtacgtgaactcggtgatcaggaagctccttgcctgctactcggacaagtacaccctggaagagaaggatggcgcgatgctgctcggctggaagaacaggaagttgatatctgcttctgcttggcactgacagtaacgttttcagaagaccggaagtacacgtcaactcttacatatatgtatgtatgtatgtataatgaattacctggtctgctttccgcaaaaaaggacgccctttgttgtacatgtacatgatgctgtacccttagttttcctgaagtgcagaccagagaagagaatattgacattagattgtagctgctaagctgtatggtaattacagtttttcttttgctctcatgtattcacccctgtcatggacttctccaagcgtattcttagctaatcagcatgcatacatgctgagatgcttcttagtctttctttcatgctcttgagcgtgcaatgatgtcaacaagtt

SEQ ID NO: 339 - DNA, 510 bp, Zea mays
tggtggtcttcttgttcaatccccatctcgatcggggaggccaccaaccaccatatggcgggagggaaggtttactcgttcgaggaggtgaggaagcacagcgaccgcaaggactgctggctcatcatcgccggcaaggtgtacgacgtcacgccgttcatggaggagcaccccggcggcgacgaggtcctgctggcgtccgtcggcaaggacgccaccgcggacttcgaggacatcggccacagcgcctccgccaaggagctcatgccccagtactgcatcggcaaggtcgacgcggctaccttcccggccaagcccgcctacgtcgtcaccaaggacgacgccaggtcgtccgagaaggccgcgacgagcgccggcgcttgggccacgctcctgcagctcgccgcgcccgtcctgctgctggcgctggccttcgcgctgcagcagaactatgccagggccaaggcggagtagacaagatacagatagataccatcgttgattccgctg

SEQ ID NO: 340 - DNA, 1100 bp, Zea mays
cagtcatggtcgtcatgggcaaggagcagcaacacgaggaggaggaggtgcaagggaaggtcgtccaagaagaagtgcaagtcgtccaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcatcccgcgcagcagcgtggacgtggagcggctgggcccggagctgcaggagatgcgcggcgggctgatccgcctctgcgccgacgcggaggcgctgctggaggcgcactactccgacctgctggcctccttcgacaacccgctggagcacctgtcgctcttcccctacatcaacaactacatcctgctgagccagctggagcacgggctgctggcgcggcacgtgccgggcccagcgccggcgcgcgtggccttcgtcgggtccggcccgctcccgctgagctccctggtgctcgcggcgcgccaccttccgggcgcctccttcgacaactacgacatctgcggggaggccaacgaccgggcgcggcgcctggtgcgcggcgacggcgcgctccaggcgcgcatggcgttccgcacctcggacgtggcggacgtgacccgggagctggcgtcgtacgacgccgtgttcctggcggcgctggtgggcatggcggccgaggagaaggcccgcgtggtggcgcacctcgggaggcacatggcccccggcgccgcgctggtggtgcggagcgcgcacggcgcgcgcgggttcctgtaccccgtggtggaccccgaggagatccggcgcggcggattcgacgtgctcgccgtgcaccacccggagggggaggtgatcaactccgtgatcatcgcgcgcaagcccgttgccgtcgacgcgcacgccaccggcggggtggggcacgcgcacgcgcacgcgcacggcgccgtgctcaaccggccctgcctctgctgcgagatggaggcccgggcgcaccagaagatggaggaggtggccgtcgagcagctgccgtcctagtag

SEQ ID NO: 341 - DNA, 1505 bp, Zea mays
accaatctttctgtccgatcactgcaattttaagcttcagtcccctttttcggaaaatccagtctctgacaaagctgttcggcggctcatgcaccagtagcttcagctaagatctccccatgccacagactcctcctcctccaggaccgtcagccatggtatagagctatagcgctgctccggccggcctgcctgcctaagctgcggaattcgggccccctccccggcttcccgcgccatggacggcctccccgacgccgacacggcgccggttgcggccgcgccggcgcagaagcgcgacgagtggagcgagagcggcatcctgcgcctgctcgaggcctacgaggccaagtggctgctgcggaaccgcgccaagctcaagtggagcgattgggtcgacatcgcccgcgaggtgtccgtgcattgcgccgacgacgccgcagccgcggggaagccccccggccatggcggcggcagcagcgccaagacccccaaccagtgcaagaacaagatcgagtccatgaagaagcggtaccgggcggaggccgcggcggcggcgcgcgcgggccccgccgccgccggcccgacctggaggttctttgcccgcatggacgggctgctcaaagggccgcccgtctgctctgcccaggtgcagcagcccgagctgactagcagcatagacttgcgagctccggcgaaaccagaggccgaggtagaactagccgattttgccacgcagttgcgggaggcagttccagttccaggtgcattctctgatctgatgaacatcgacacgaatggcgctgtcccggataaagcggagaaggttgacaacagcatgcagaaggagagcaggcctgctgatagcgatgccaacgtgagctccccaaggagtaaggtggccgacgaggacgtggaggaggtggacaaggcctgggaccggcccagcaagagaaagagcacagaattcgatatagccaagagcatcgagctgctggctagctcgttcttgaagattgagcacgccaggatggagatgtacagggagacagaaaggatgagggttgaagctgagattaagaagggggagatggagctcaagagaactgagatcatggcgaaaacgcaccttcagatcgctaggctttttgcaaagaaattgaaacagagcagtggaaagaatggtgtcagttcgtcagtaacagctgaagtggacacccttaccaagaaaggcgagaatggttccgggtgatgtggcatgcccggcagttgattctatcctcagcgtacatggcacctcacttttcctgtgcagcaagtgtaccgagtctgattgagaaatagtcagctgtaaacttacagatgcaataatgggagcgaagatttgactgtttggcccattgcgggattatagaagcgatttttgaatcagtgacttcctaagtctgaaagtttctgccctctgttcgtgtagtaatttactgacaagtgacaaccaccatttg

SEQ ID NO: 342 - DNA, 984 bp, Zea mays
aaaggatccgacgacgacgacgacgaccgcgccgccatgaccaccaccaccacggccgcggccgcggtcgcgcagctctgcgccgggccacggcggcgcaagcaggcagcaggggctcggctcgacctgcgctgggcgcgcctgctccgcctcgccgtcgtcaccagggtgctccgcctcgcgcgcgaccagctgctcgcctgctcctcctgcgggggcggcaccgccgcccgccgccggtaccgccgcctcggcccgcccaccagcgccagcgccggtcccgtgctgtcacccgtcgacagggacgacgactgcgccgcggacgccgaggccgcggcccctcgcgacgcggccgacgacgaagacaacgttgtcagcctcaaggtcagcctgctcggcgactgccagattggcaagaccagcttcatggttaagtatgtgggagatgacggggaggagcagaacggcttgcagatgacgggcctgaatctcatggacaagacgatgcccgtcaggggagcaaggattgcctacagcatctgggatgtggcaggagaccaccagtccgtcgaccacgtcccaatcgcgtgcaaggacgccgtggcgatcctgtacatgttcgatctcacgagccgctgcacgcttaataacattgtagattggtacgggagggcgaggaaatggaataagacggctattccaatcctaatcgggacaaagtttgatgactttgctcagcttcctcttgagatgcaatgggccatcgttaaccaggccagagcatatgcaagagcgatgaaggcgaccctcttcttctcgagcgcgacgcacaacatcaacgtgaacaagatcttcaagttcatcacggccaagctcttcaacctcccgtggacggtggagcgcaacctcaccatcggcgagcccatcatagacttctgacgaccccttcctctaactagtaactcggcagcataagaattcaaa

SEQ ID NO: 343 - DNA, 1202 bp, Zea mays
acagcacatctgtttagccaagctgtggccaacctctgcgaggaatggagatggagtcgactcctctcttgacaccatacaagatgggcgatttcaacctggcacacagggttgtgctggcgccgctgacgaggtgccgggcgttcgggaacgtgccgcagccggagcacatggctctctactaccgccagcgggcgacgcccggcggcttcctcatcgccgaggcctgcgccgtgtcggagagcgcgcgcgggtacccggacgttccggggctgtggacccaccaacaggtcgaggcctggaagccgatcgtcgacgccgtccacgccagcggtgccgtcttcttcgcccagctctggcacaccggccgggcctccccctcagaattccaaccaaatgggcaggcaccgatctctagcacggacaagcaaatcccagcacaggtgaaccattccggtgacgtcaacacgttcgcggtgcctcggagactagagacagaggagataccacacgtcgtcaatgacttccgggttgccgccagaaacgccatcaaagcaggctttgatggagtggagatccacgcggcaaacgggtacctgttcgatcagttcatgaaggacagcaccaatgaccgagacgactcctacgggggcagcttggagaaccggtgccgtttcacagccgaggtgatggcagccgtcgcggacgaggtcggtgccaaccgcctcggtgtgcgcctctctccgttcgcggattatatggactgccacgactccaacccagaggcgctcgcgcttcatgtcatcgacgagacgctgaacccgctcggcgtgctttactgccacatggtagagccaaggatgcgggtgaacccagacgacggtattatgactctcgagcacatgctgctaccgttcaggagggcgtttcgcgggacgttcattgctaatggaggctacgaccgtgaggaaggcaatgacgccattgcccgtggccgtggctatgcagatctcatcgcatacggccggatattccttgccaacccggaccttccgatgcgttttgccaagaatgccccgctgaacaagtatgataggagcaccttctatacctctgatccggtggttgggtacacagattatccatttctcgatcaactctaggatgattggcttataaacaatttccccacctggagttag

SEQ ID NO: 344 - DNA, 840 bp, Zea mays
cactcaaatccactgtgactccgtgagctctccctgcctgctgccctgcacactccccgcccagccgcaccagctcagctcagcagtcatggctcgcccctgccgcagcagcagcagcgccgctgcccgcctcctcctgctgctcgccgccgtcgcagcggcgctccaggcagcggccgccacgccgccggtggccagcggcttcatccgcaaatcctgccgcgcgacgcagtacccgtcggtgtgcgagcagagcctcgcggcgtacggaggctccccgccgccgcggagcccgcgggagctggcgcgcgccgcgctggcggtgagcgcggaccgcgctcgggcagcgtccgcgtacgtcggccgcctgtgcggctcccggtccggatccggcgacggcagcccccgccgcggcgccggcgccggcgcgaagaaggggtcggcggccgcgggtcccgtgcgcgactgtctggagaatctagcggacagcgtgggccacctccgcgacgcggcgcaggagataggcggcgccgggatggcccgcgccgggacgcgcgcgttcaggtggcacctgagcaacgtgcagacctggtgcagcgccgcgctcacggacgagaacacctgcctggacgggctctcgtcccgcgccgtggacgccgccacgcgcgccgccgtccgcggcagggtcgtcgaggtcgcgcaggtcaccagcaacgcgctcgcactcgtcaacaaggtcgggcctgggtactagtagcccagggcggcctgggtgctactactactactgcctcctccacgacgttggttgtttcagcctcggcggttaactagttctgt

SEQ ID NO: 345 - DNA, 2133 bp, Zea mays
ccgaagatccaggttgagtcggcgtcgccggcagaggcaagagactccggcgcgatgtcgttggactcggaggcttcctcgcagggtggggactaccgtagcttccgccagatcacgcgagatcgtttattatttgaaatgctcagatcaactaggaagaattcgaaatcaacatggaaggttcttatcatggataagtttacagtcaagattatgtcatatgcatgtaagatggcagatattacagaagaaggtgtttcattggtcgaagatttatataaacggaggcaaccattgccttcactggatgccatatatttcatccaaccaactaaagagaacattgtcatgttcctatccgacatgtcaggaagaagccctttgtacaagaaggcatatgtgtttttcagttctcccgtacataaagaattagttgctcaaataaaaaaggattcaagtgtactacctcgtattgccgcacttagtgagatgaatttggagtactttgctattgattcccagggtttcataactgaccatgagagggcattggaagaactttttagtgaaaatgcagaaggatctcacaagtataatgcttgtctgaacacaatggctactcgtatatccacagtatttgcatcaatgagggaattccctcgtgtacactaccgtattgccaagacgattgatgcttctacaatgacaacactacgagacttagtccccacaaagcttgctgccagtgtatggaattgtcttgcgaaatataaaacgacaatacctgaatttcctcaaacagaaacttgtgagctacttatagtagaccgttcaatagatcagattgcaccaattattcatgaatggacttatgatgctatgtgtcatgatctgctttgtatggatggcaacaagtatgttcatgaggttccaactaaaaatgggtcggcaactgaaaaaaaggaggtcctgttggaggatcatgaccctgtctggcttgagcttaggcatgcacatatagcagatgcaagtgagaggctacatgataagatgaccaacttcatttcaaagaacaaagctgcacaattgcatcaagcacgaaccgatggagaattatcgacaagagatttacaaaaaatggttcaggctcttccacagtacagtgatcaaattgataagctttccctgcatgttgagattgcaggaaaactcaataacataataagggaacaatgtcttcgggatgttggacagctagagcaagatcttgtgtttggcgatgctggaaccaaagaactaatcaactttttgagaacacaattggttgtaagtcgtgaaaataaattacgcttgctgatgatttatgcagcacttaacccagagaagtttgaaagcgacaagggtgcaaaattaatgcagttggcaggattatctgctgatgacatgattgctgtaaataatatgcgttgcttatgtgggcctgataccaaaaagtcttcagtagggggttttacactgaaatttgatgttcacaagaagaaacacacaaatcgaaaagagcgaacaggggaagaatcaacatgggcactctctcgattttaccctattttggagcaattgattgaaaatcttagcaaaggtgagctgccaaaagatgaatataactgtatgaatgaccctagtcctactgttcatggactgccaaccagtagctctgcccgaacaagccccgctcactcaatgcgatccagacgaacaggtggcacatgggcaagacctcgtggctctgatgatggatattcaagtgattctgtgttgaagcatgcctccagtgacttcaggaaacttggtcagcgtatatttgtttttgtaataggcggtgctactcgatcagagttacgtgctgcacacaagctttcatccaagctgaagcgagacatcatccttggttcatctagccttgatgatcctccccagttcatcacaaaattaaagttgatgtcagtagaagaattgacacttgatgaccttcagctgtaaatggtgtccgcccacacggagtgtaaccttttattttctctgttctgtcagctcttatttgtgggggcctgtcatattcattcggtgaaatag

SEQ ID NO: 346 - DNA, 624 bp, Zea mays
ctgatcgaagtgaacaagcaaggaagagccatggcgagcgagcacgcggcggggggcgatgctaagcatcaccagaagcagagcctgatggacaaggcgaaggggttcgtcgcggagaagatcgcgcacatccccaagcccgaggccacgctggacggcgtgacgttcaagggcctgagccgggagtgcatcacgctgcacagcagcgtgaacgtgtccaacccctacgaccaccgcctccccatctgcgaggtgacctacacgctccggtgcgccggcaaggaggtggcgtccggcaccatgccggaccccggctggatcgccgccagcggctccaccgcgctggagatccccgccaaggtgccctacgacttcctcgtctccctcgtcagggacgtcggccgggactgggacatcgactacgagctccaggtcgggctcaccgtcgacctccccatcgtcggcaacttcaccatcccgctctccacctctggcgagttcaagctccccaccctcaaggacttgttctgatctagtagtagctcgcttgccttgtgttctgtgcgggcgcgcaccagcgatctgtacgacgagcttttgcaaataaacgacgcagctccttag

SEQ ID NO: 347 - DNA, 2070 bp, Zea mays
atccatccacttactacgctgctaggctgctacgaacaaaatcctcctaattaagacgggcgtcgttggcttcaaatactggtctctcccctgtccaaaagtctctcgaatctccaccctggttctgcaccggttccagaattttctcccatttacagggtctccccgtttctgtccggcggttctgccgttccactgcttttgatttcggagtgtgaacttacatcttgctggataataaagattggattttaagcgatttgggggtgcttgcctgatctccccctgcgaggtactgccgggggattggatttcggggaagttttggtggtttgagattcggcttggccggagcaggaatgacgatcgacatgtccattcccgggagctccgggctgctgaacgctgcggggaagagggacatgaagttcttcagcaacccctacgtgcttgcgctcacgggcgctgcaggaatcggtggattcctctttggctacgatacaggtgtcatatctggagcccttctgtatatccgcgatgattttccagcggtcaaggacaattacttcttacaggaaacgattgttagcatggccttagtcggagctatgattggagctgctgggggtggttggatcaatgatgcatacggtcgcaagaagtctactcttcttgctgatttgatgtttgctcttggctcacttgtcatgtgtgctgctgctggtccttacattctaattatcggaaggctcctcgttggtttgggtgtgggtgttgcatcagtcacagcaccggtatacattgctgaagctgctccttcagaaatcaggggaggtttggtgtcaactaatgtactcatgattaccggtggccaattcttctcctatcttatcaatcttggctttactgaggtgcctggaacatggcgctggatgcttggtgttgctgctgttcctgccattatacagtttgtgctgatgctattcctgccagaatctccgcgttggctttactggaaggatgagaaggcaaaagctattgccgtccttgagaggatctatgaatccgaccgcttggaggaagaggtagagctgcttgctacatcctccatgcatgaattccagtccaacaataccggaagctatctggatgtcttcaagtcgaaagaattgaggctagctttctttgctggggctggccttcaggccttccagcaatttaccgggatcaacaccgtgatgtattacagccccacgatagtccagatggctggtttctcctccaacaggctggccttgctcctctccctgatcgtcgcggccatgaacgccgccggaaccatcgtcgggatctacctaatcgaccgttgcggccgccgccgtctggccctcacaagcttggccggggtcgtggtctccctggccatcctcgccacggccttcatactgcagtcatcatccggcctctgcatgagcgccgccagcggcacgtgccagggcgcgctaggctggttcgcggtggccggcctcgctctgtacatcgccttcttctccccgggcatggggcccgtgccgtgggccgtgaactcggagatctaccccgaggcgtaccgtgggacgtgcggcggcatgtcggccaccgtgaactgggtctctaacctcgtcgtggcacagacgttcctgtcgatcgtggggctggtcgggaccggcccgacgttcctgatcgtcgccgggatcgcggtgctggccttcgtcttcgtggccacgtacgtgccggagacgaagggcctgacttttgagcaggtggagcagatgtggaggaagagagcgtgggggaacagcggcggcaactgcgagagccttttggcgggtactgctgctgcgccgtaggctacccgttgccagcactggtcaagcgcgtcagttttagtatggccgctctgggcttgatcggctccgtcctggcattagttggaagaaagtaaaaacagattggagatgcagatgcaaactgttgtatgtggtggtgcttatattgctatcctgttgcctgattgtacgtgttgtcgtc

SEQ ID NO: 348 - DNA, 959 bp, Zea mays
caagatcttaacgaccctcacggcccagcgccaggccgccagcatccgacgcatctaaccccttccgatgcgtgtcccgatccaacggtctccgtcgtcccgtccgcgtgataaagcgccggcgcctcttctcgcgtggcctcccgaaggttctaggctcgattgaacaaattggagcggcactacactcctccacgcctccacctccagcctcccactgatctggcctctctcgaggtgagcgcgcctttaatcctagatcaatatgagaaggggctacagttacagtccttcaccaccaaggggctacaggagaagggcgcgcagtccaagtcctcatgatcattatggtggtcgtggtagggatctcccaaccagtcttctggtcaggaatctccgtcgggactgcaggccagaagacctccgtcgcccatttggacagtttggtcgagttaaagatatatatcttccaagagattattacactggggatccccgagggtttgggtttgtccagtattatgatcctgctgatgctgctgatgcgaagtactatatggatgggcaggtagttcttggtaggcaaataacagttgtttttgcagaagagaacagaaagaagcctcaagagatgagagctagggacagagtcaggggtcattcttatgatgacaggaggtattctcgctctaggtcgcctcgttattataggggccgctctccttcacgcagccaaagctactcgaggtctccacctcagaatccaagacacagacttagagagaggtcctactccggctcacctgtggacagcagatcaagaagtgggagcccttatgaggatggatatcgcaaatcatcacggagagagaggtctctttctgtcagcggatgaagcagttttacggtctagagctattgctgtgaatctgcgcatggtggcctacttgctatgtctt

SEQ ID NO: 349 - DNA, 531 bp, Zea mays
aaacattggtatatacagtgcggatagcgtgacagcgtcaacgccagccatggcggcggctcagtcctccaccgattcgttggctccgcacctccgccgccgtccgcgccgcctcgtattcgaccgccgctacggatggatctttgacgaatggacgcaccccgccgaccaagccctctccggcggccgcggaatgttctgtgcgctgacgatggcgcggtcgctggtgagcgctgcggcgtgctcgattaactatgctgtcagttcaatcagcagagttctggaacgccccaaaagactccacaagaagcagcaagcctggttccgtgaacttgaatgctcgggagttgtagctgatcttaagttaatacagacttgaagccattctgaactagaatgcaccacaactggttgcatgtgttccgtaaagaagcatgatcatctgtaagcacggtatcagaaaattatgagacacttatccttagcaaaaagctatttgtcctgtttctactctaatgtggcaatgatggc

SEQ ID NO: 350 - DNA, 668 bp, Zea mays
gatcgatggaggcgaggaggagcagcgcggcgctcgtatccgtggccgccgccgccgccgccgtcgcgctgctgctggtgctcgccgccgagccgtcccgagcggagcggttcgtcgtcggcgacgcggcgcggtggacgtgggggtacaactacacggactgggtcatcaggaaggggcccttcttccagaacgacacccttgtgttcatgtacgacccgccgaacgcgacggtgcacgcgcacagcgtgtacctgatgcgcaccgccgcggactaccagtcgtgcaacctcaaggcggccaagctggtggccagcgtcacgcagggcgccggctccggcttcgagttcgtgctccggaagcgcaagcagcactacttcgtgtgcggcgagcgcggcggcatccactgcaccatgggccagatgaagttcgtcgtcaagcccaagagctctgcctgccgcgacgactgactgacacgccgccggacgccgatgtcggtgcgcgtacgtgtggcctcgatctcgtcctgtctttgttcgatctctgcatgccgccttctcagtcagatcattcctcctgtccaattgttgcgccctgcttgtaagttattattactatcagtcggtgtggatttactcagtgtgttgacgtatgattcgtgctgttag

SEQ ID NO: 351 - DNA, 2081 bp, Zea mays
aagctcataatcgacacacacctaacagagtaacagacaccaaacaacgcccatcactcgcgccgtacatcctgcctcctcccgcgcgcgcgcgcgcgtgcacgctagctagctgccggtcgcctcgccaccatggtgttcgacgcgagcggcagcaggtcggcggcggcggcgtcggggaaccctctccgcgtgatcctgacgcgcgggttcgcgcggcaggtgctcgcggggcggtggttgacggtgttcgcgagcctgctcatcatggcgtcgtccggcgcgacgtacatcttcgggagctactccggcacgctcaagtcgtcgctcgggtacgaccagcgcacgctcaacaccgtgtccttcttcaaggacctcggcgccaacctgggcgtcttctcggggctcatcaacgaggtgaccccgccgtgggtggtgctggccatgggcgccgccatgaacctgtccgggtacctcatggtgtacctggccgtgtccgggcgcaccgcgccgccgccgctgtggctcgtgtgcctctacttcttcgtgggcgccaactcgcagtcgttcgccaacaccggcgcgctggtgacctgcgtcaagaacttccccgacagccgcggggtggtgctcggcatcctcaagggcttcgtcggcctcagcggcgccgtgtacacgcagctgtacctggccctgtacggcggcgacgacgccgagtcgctgatcctcctcgtcgcctggctccccgcggcggtgtccgtcgtgttcgtccacaccatccggtacatgccgtacccgcgccgccgtggcggcggcaggcaggagacgagctccgactccgaccccttcttctgcttcctctacctctccatcgcgctggcgtgcttcctcctcgtcatgatcgtggtgcagaagcaggtgcccttctcccgcgccgcgtacggcgtggccgccacgccgctgctcatcctcctcctcatgcccctcggcgtcgtcgtcaagcaggagtacaagatctaccgggagcgccagctcgacgcggccgacccgccgccgccgaccatcatctccgcgtcggcaacggacgccagcaagaaaacagagcagcagccggcgccggcgccgccgccgacgacgtcgtcgttctgtgggtgcgtgaggaccatgttccgtccgccggctcgtggggaggactacacgatcctgcaggcgctggtgagcgtggacatgctggtgctgttcgtggcgacaatctgcggcgtgggcgggacgctgacggcgatcgacaacatggggcagatcggcgagtcgctgggctaccccgccaggagcgtcaacacgttcgtgtccctgatcagcatctggaactacgcggggcgcgtgacggcgggctacgcctcggaggcggcgctggcccggtaccgcgtgccgcggccgctgctgctgacgtgcgtgctggcgctggcgtgcgcggggcacgtgctgatcgcgctgggcgcgccgcggtccctgtacgcggcgtcggtggtcgtcgggttctgcttcggcgcgcagtggccgctggtgttcgccatcatctcggaggtgttcgggctcaagtactactccacgctctacaacttgggcggcatggccagccccgtgggctcctacatcctgaacgtgcgcgtggcggggcggctctacgacgcggcggccgcgcagcagcgcggccgcggcaggatctgcctcggggtggagtgctaccggcggtcgttcctgatcgtcacggcggccacggtggtcggcgcgctggtgtcgctggtgctggtgtggcggacgtggacgttctacaggggcgacatatacgcgaggttccgggacggagacgagggcccggggcgggacgggcgcctgccggtcgaccagaaacgggaggaggaggagagggagaaggcggcggccaacggcaggaaggcgtgaggtggtgagcgggagcgggaaggcatggtcagggacgacgacgggtggggtgtacatgtacatgtgaatatagtacttttttgttgcattcacccgtgatgaccgacccttgttacctt

SEQ ID NO: 352 - DNA, 1842 bp, Zea mays
catcctctctcctccagtgacagcctccggcgcctcctcgggctgccatccagcccgtgccactgccactgcacttgctgtgccgacccgagctgcggtcgagtgagcaatggagcggcggcggcggcggccaccgaggctgccgctccttgtgttcgtcttagttgccaccacttgccccctcgggagctcagcagggattggaagcttcggagtcggtgcggagagcaatggagcttcgtctagttttaggaccaggagtctgctgcagattggagacagaaacgaagatggcctatttcatctgccacatacacgggctctcacgcacaagagcagatctcatagaaaagttccaacacccgcaccagcaccagagtccgctccagcaccctcaccatccatgtctccaccggacagctcaccgtctccgtcaccacatggttcacacccaatgccacgccaatcaacttcacatcgtcatccatccataacacctccacatttggtcaggcctgggcctaggcaagatggaaatgatcctttggtttatactccagctcattctcggcataaacatttttggacaacctatggtttagttgcagcagggattgcggttttccttttggtatcagcagctagtattctctgcttccgagctaagaaaatgggaaccgtaaggccatgggcgacaggtctaagtggacaattgcagaaagcttttgtaactggtgtaccttcgctgaaacgatcagagctggaaacggcatgcgaggatttcagcaacataattggttctacctctacctgcatgctgtacaagggaactttatctagtggagttgaaatcgcagtggcctcaagcttggtaacatctgcaaaggattggtcgaaagaaaatgaatcgcagtacaggaaaaagataacaaacttgtccaaagtaagtcacaagaattttatgaacttgcttggctactgtgaggaagagcatccctttaccagagtgatggtatttgaatatgctccaaatgggacactttttgagcatctccatgtcagggaagcagagaagcttgactggatggcacggctcaggatatccatgggcattgcttactgtcttgagcacatgcatcagctgcaaacaccagctgcgctgaggaactttgactcgactacagtataccttactgatgacttcgccgcaaaggtctcggatcttgaattttggaatgacgcaaagggacataattctactaccaacaatgaactggctttctccccagacacggaggacattgtgcgcaagtacggcatggtgttgttggagatattgaccggaagagttccttcttccgaggatgacggaccactggaaaattgggtgtctcgctattttgaaggcgggatgcgtcttgaggagctgattgaccctagcatcggcttcttccccgaggacactgcacgagccctttgtgaggttgtgaggtcctgcattgatcgggatccaaagaagagaccgcagatgaaagaggtcgcagctcggatgagagagatcaccgcgctggggcctgatggggcaactccgaaggtgtcaccgctctggtgggctgagcttgagattatgacttctgagagctgagttcgacacatgccagatgatattgtttctcctagtgtgactgagaattctttgagctactacttgctgctgctaatcttgtttgtggaagtggtgattaggtagaatttgttatgtgtgcagaattgcatatagggattggtattgtacttgtacatgtcaagaaggtttaacacacaacatactgatacgcaggc

SEQ ID NO: 353 - DNA, 285 bp, Zea mays
gtccgcagtctctcttccctacgaagttcagaagttgtcacaatgactcgcggcgaccagagggaacgcgaccggcagagggcgcaggcgcggcggcccgcggccaaggggcgcgacgacgggctcaccccggagcagcggcgggagcgggacgccaaggcgctgcaggagaaggctgccaggaaggcggcgcaggccgcgggaggcgcctgcgccaagggcggcaagaacaccggcaagaagtagccggggtctttactctttagttcgcaggatctgctctag

SEQ ID NO: 354 - DNA, 1031 bp, Zea mays
actcatctcatcaccgctttccgtttcgctcgtccgatcctcatcaccagctcgggagggaggtcgggagagagcacggacgatgtggcacgccgcggcggcccccaacaaccttcacccggccgtcgccacaacatcgtcccctgcccttcgccgtgcgaggtggcccatcactcgaccctcgtcgtcggtgaaggtccagtcctccatcaggaacggcaatggctccgctgacaacctggaccacctgcagagggcgtccaagggcaggcagcagcggcagggggcgagtgctccaggcccgagggctagaagggtcgtccgcaccacaccattcgggctgtggtgggacagcttcccggaagcgaggacgctggaccagatggtgcggaccatcatggacgccgacgacgctgacaccgacacccgcttcggcggcgtcgtgcctgcggcggcggcggcggcccccaccgccgtgccgcgcgccgaccacgggcggacgccgtgggaggtcagggagcgcgcgggggagtacctggtccggttcgacatgccagggatggcgcgggacgacgtgcgggtcagcgtgcaggaccggacgctcgtcgtggccgcagagaagaagcaacagcctgctgctgacggcggcggcgacgaggagggagataatgaggaggaggcgtggccgccggcgagcttcgggcggtacaggacgcgggtggagctgccggagaacgtggacgtggagaggatcgccgcagaagtgaaggacggagtgctgtacctcaccatccccaagctgtcggcgggggccaaggtcgtcaacatccaggtgcagtgatgctgtgggtcagattcatcaggacgatgagcacctgctgccgtgcttttcgcagcttctagaatctggatgcttgggacgagagcgatatcgatctagctaccactcttctttttctgtttcgttcctcgattttgtttgctatgtcacacatggtaaatcttggtagttggtgccagaagataaggtg

SEQ ID NO: 355 - DNA, 544 bp, Zea mays
agaaacagcaaagatccagtgcagagagagagagaagcgccatggcactctgaacaagaaaagaaagagctagagagatctcagtcagccagtctctcacaacacaatgccggcaaccaccaagccgatcttgctcccaagggcgtgggcagcagcgccactcctcctcctgctgctgctcgtcctgcacgggagaggaggccactgcgtcggcatggaggcggcggagctggagatggactcggaggcgcaccggcggctgctgtgggaggcgaccacggggcggaggtacatcagctacgacgccctgcggggcgacgtggtgccgtgctccaggaccggggtgccctactacaactgccggatctcgaccaccgccaacccctacacccggggctgcgagagcatcaccaggtgcagggacgcggatccctaggctcttgctttgcttgctccgtcgccttgcaaagggaagtgggtgtggggctgctgctcctcgctccttcgacgctgcagggcggtgttgctgcaaatgcttacttag

SEQ ID NO: 356 - DNA, 1258 bp, Zea mays
gagtgtctccagtctcaagtacagcggaggatggagagcggcttgcttgacaccgccgcggctgccggtctctgcccggtggcggccgggcgccgccgcgtcgggagcacgggcacggcgaggtgcttcctcagctgctcctgcgcttccagagactgcagggtgagcgcgtcctactcccactccatcagccggatgctgagcggggtgcggtcggcggcgcgcaagaggctcttcaggagcgacccggccgagctgctgggcgtcgccaactggtcggagacgggcggcggcggcgccgggggccaccagcactggtggacggcgctggagaacaacttcgtgctggaggccaccgacgacgagtacggcggggtcgtcgtcgacgccgatcggctgccggccgacagggccgccttcgcgcgctccctcgcggcgtcgctctcctactggaagtccgtggggaagaaaggggtgtggttgaaattaccggtggatctagccgagttcgtccctttagcagtgaaggaaggcttcaagtaccaccacgcggaggaagcgtatttgatgatgacgtactggatccccgatgaaccgaatatgctcccagcaaatgcttctcatcaggttggggttgggggttttgtgatcaacgaccaaatggaggttctagtggtgcaagagaagtaccgcggatcgtcgctggatggcgtatggaaactccccacaggcttcattcttgcgtctgaggaaatctacacgggggccagcagagaggtgaaggaggaaaccggggtcgacaccgagttcgttgacgtcgttgctttcaggcatgcccacaacgtggcgtttcacaagtccgacctcttcttcatctgcatgctgaggcctgtgtcgagtgagatcaagattgacgagacagagattcaggcagcgaagtggatggcgctggaggagttcgtgaagcagcccttcatccaggaagaccacatgttccagaagatcatggacatctgcatccagcgcctccgcaagtgctactgtgggctgacgccgcaccacgtcgtctccaagttcgacgacagaacgtccacgctctactacaatgtcgccgagcccgaggacgtgaactgcagcgccgcctgatgtaatatgatgtgagggggagggggagccaccccagcatctactagtctaatttttgctgcgcagaagtttcatgatgcagcagtgttagtcgtgcgattactgagagtga

SEQ ID NO: 357 - DNA, 564 bp, Zea mays
agcatactgtcaggctaccagctagcgaagtagctagccatgctcggccttcccgccgcgcccccggccgccgcagcaccgccgaacccgaagggcaaggggcgatgcagcgccgccccgccaccagcgatgacaggccgggtgtcgctggctgtccctgcggcggctgtctcgctctcgctcttcctctggtctagtccagtgaacgccggcatcctgtccggtttctcgggactggagtcgactcccggccccgacctcccccggctcgagttcctggagaaatggaatgcggagaaccagaagaagtacaccgagttcgataacaggttcaagaagtccaaggtgctgcaggacctgctcgagaagagcaggaagaacaaagagaagaacgagaggatgatccaggacaagtactgtctgcggggcgccgagtggggcgtcggggactgctccacggagggcatgtcagaccaggagagggaggacttcatttcggagctcaagaagagagctggagcagagtagcgagctgaggacgtcattcagtttcaacagacgtag

SEQ ID NO: 358 - DNA, 1489 bp, Zea mays
aaagttgcagcggcagtgttgaggccaaggccaccgacccacctctctcatagcactagcagcaatggaggtggagatcctcgagtcctgcatggtgaaacccagcgacgacatagggacgccgccgccgcccatgcacgtggtctggctctccaacctcgatctactcgtggccaggagccacacgcccaccgtatacgtgtaccggcccagccctgacccggacttcttctcgccgggcgtcctcagtgctgccctgtccaaggcgctcgtccgcttctaccccctcgccggccggctcgcgcaggacggcgccggccgcccgcagatccactgcaccggagaaggcgcgctcctcgtcaccgcgcgcgccgacgctaccctccaggacatccccggcgggttcgccccgtcggatgagctgcggcagatgcttgtcccctcggctgccgacggcgaagaccgcgccggcatcttggccatgttccaggtgacgtccttcaagtgcggcggggtgtgcgtgggcgcggcgatccaccacacggcggcggacggcctagcggcgctcgacttcgtcaacacgtgggccgccatcgcgagcaagggcgtcgacgaggccgcgccggcgccgcgcccgtggctggaccgcacgctgctccgcgcgcgctcccctcccgacgtgcgcttcgaccacagcgagtactccccgcggggcggcggcggtccaaagacggcgagggtcccgttcgactccgccatcctgcccatgtccaagacccaggtggacgcgctcagggccggcaagaaggtgtccacgttcaaggccgtggtcgcccacgtgtggcggtgcgcgtgcatagcgcgcgggctcgcgggagacgaggacacccgtctgtacatgaccgccgacgcgcgctcccgcgtccgcccgccgctcccggaaggctacctcggcaacgccatcttccgcgcgtcagcggtggccacggcgggcgacgtcgtctccgagcagctcgacgccgttgcgggtagggtgtccggcgccaccgcccggctggacgacgagtacgtccggtcgctggtggactacctggagcaggtggtgggcgatgtggcggggctccgcaagggggagtgggtgatgccggagaccgacctgtgggtgataagctggcaggggctgcccatctacgacgccgacttcggctggggacggccggcgttcatgggccgcgcgtgcctccagttcagcggcctcgtgtacctcgtcccgggcccggacggcgacggccgcctcgacgtcgtcgtggccatggagcccaagagcctggccagattcaaggagctgttgtacgagctcaaaggtgcaggtgttccgtgcacggcagactgagctgctgcattccgtgcaggttccttggcttgctaccggctggcaaaacgaaaacctgtttgccggatcgttccttgcattgcctatctacttcga

SEQ ID NO: 359 - DNA, 745 bp, Zea mays
cagaggcagttgtgttgctggtcggtccgtccatggcgcccaagagaccagtgtcggcggcggcggcggcggagcagccgaggctgcgcggcgtgcggaagcggccgtggggccggtacgcggcggagatccgcgacccggtgcggaaggcgcgcgtgtggctgggcaccttcgacacgccggagcaggcggcgcgggcgtacgacgccgccgcgcgcaagctccgcgggcccggcgccgccaccaactaccccgccccggagccgacggcggaggcgttggcggaggctccagcggcgagcgggagcgggagcgccgtggtgtacgagtcgtcgtcggcgtcggcgtcggcgtcgtcgtgctccctgccgctggcggccccgtcgctggacctcagcctggcgctgccggctgcggcggcggccgcagagccgtaccagctgttcgcggacccggcggcggcggccgccgtgacgccggcgctgctgcacttcttgccgcccaagagcgaggagcagcagagctactctgggtcatcgtcgctgtcctcgtcgtcgtcgtctgtagtgttcgacgcggcgccgcccgtgggcctgcggctggacctcaacctggcgctgccgccggccgagatggtgatgtgattgctgccgtccaggaggctaatcgattgctcagttaattagtcaccattagtagctaatcgatcaaggcagccgtcaggcagaggtgtaaataggatgca

SEQ ID NO: 360 - DNA, 527 bp, Zea mays
gagcaacgatgttcaggtgccccagcaatggctacggccaaccgcaccccaccgcgaactaccaccgcacccactccggcgaacacgtcaccaccaaggtcgcccagaaaccctgccatgccggcggcgccgtgcagcagcaccacgttgtccacaaggagtcgtcgttcaaggagctggacgggggtaaccgccgctgcttcgacaactatcccatgaacgctgctaacaacgcgaaccaccaccgctacgaggcctacgaggaaacctacgaggaaaccaactgcgaggaggagacgtacgcgtacggcgccggccgccaccatggtcacggcagcggcggcggcgggcgccgcttccagtaccagacccacgaggagacctacgaggaggaggaagaggaggtcgtcgtgggcgggggcgacggcgccggcgccggctgggcccagctcaggcgcccatcctgccgcgcatgagcagcaggcacctgctcgtacgtggaatgtgtggatgcgatgcgagtctaa

SEQ ID NO: 361 - DNA, 792 bp, Zea mays
gacattccaatcagttccctgcgtgtgagcgatgcagcgggacgcgagaagctggtcgccggcgccggccacggacgccgccggcccttacgcgatgccttcgcccgtgcagccgtcgaccaagagcacgaaggagacggtgaagaatgcgctgtcgcggtgggggcggaaggtcggggaggcgaccaggaaggccgaggacctgtcgcgcaacacatggcagcacttgaggacggcgccgagcatcgcggaggccgcggtggggaggatcgcgcaggggaccaaggtgctggcggagggcggccacgacaggatattccgccaggccttcagcgccccgcccgacgagcagctgcgcaagtcctacgcttgctacctctccacggccgccggcccggtgatgggcgtcctgtacctgtccacggccagggtcgccttctgcagcgacagcccgctgtcctacgaggcttccggcggcgacagaacggagtggacccactacaaggtggcgattcctcttcaacggctgcgggcggcgagcccgtcggccaacaagaccaagcccgcggagaagttcatccagctggtgtcggtggacagtcacgagttctggttcatgggcttcgtcaactacgacggcgcggttgcgcacctgcaggaagcgctgagcgggttccgcaacctgcaggcgtgacatggaggacctcaataaaatgctcagtgttgtcttgtacgtgctcgccacaactgattgatctgcgtgtgttgccgtgctagtgtttgcatcgtgtt

SEQ ID NO: 362 - DNA, 1193 bp, Zea mays
ccctctatatcctcccgcaccgtctctctctctctctctcctcctagcacaccagacgccgccgcgagcccccagcatcccagcccagatgttcctcgccgacaagtacagctcgctgctgcccttccaccaccaccattccaagcccagccgacgccagcagcagaagggggaggcgcaccggttcggcacggcgctggccgcgcgcctccggggcctgctgccgctgccggcctccccgctcgcggcgctcgtgcgggtggccgacctcctcgcgctcacgctcgccgaggcggggcccgcgctcgcctgctccggcgagggcgccgccgtcgccgcccacctcgacgccggcgtcgcgctcctcgacgcctgcaacgccatcgccgcgcggctcgacggcctccgcaggcgccgtctcctcgcgagcctcgcgctccacctcctcctctcctccacctcgccgtccgggcggacgcgcgcgcgcgcggcgctcgcggaccgcgacaccccggcggcgtccccggcccctccgccgctcccttggctcccgttcgagcagccccgcgggcagctcacggccgccgcgcgcgtcctcgccgccgtggacgccgtctcctcgctcgcggcggcggccgcggccaccgtcctcgccggaggacctgccaccttcccctggatctccggcggcggcggcgacgacctcccctgggcggagccgttcaacgcgctgtccggccagctcgcggcgctcggcgccggcgaggtgcgcgccgtcgacgaggccgtccggaggctcgcttcggtgctggactccgggaccgacgacgagggagccgtgcgcgccgcggcgcaggaggttgggaggcgcaccgaggagctcgcgccgcggctggaccgcctgtctgacgccgtcggcggcgtgttccgcgccgcgctgggcctccgcaacgccgagcttgactgcttaatggtgggacccgcggggaagcccgtgtaggagtagtactacttcgtagctgttatactgggatactgcgtaaagttgatttgggatcatgtgtgcgtcagtgtcgaggacgaggaggccgctagttgcaatttgcatgattttggatacgtggcatccactgctgtatcccccattcgtcaactgggactgggagaaagagaaaccatcttcaggttgctgt

SEQ ID NO: 363 - DNA, 1011 bp, Zea mays
caggagctctcgatggtgcccgcggccgcggctgtcgcagcggcgagcccggcagcgctccctcgttcaacgtccccaaggggcagacgtcccagggcccgtgcctgctcgtttcggtgcgctgggccgagcgcacgctcctcagcacttgtgtcctcctataagtcgggttccgccggccatggccatccccggattcggcagctgcgcggacggccggactgcagccggcaggcggaagtgatgggcagcaccgtcgacgacgacgaggcgtgcgagctggtgagcggctcggacctcgtcatcggcgagggagacgacagcgtcagcgcgtaccttttcaaggccgtcaagaacaacaatggcaccggcatcctcctgctctccgacatctttggcttccaggactccgccacgcgggacttcgcctaccgcgtcgcctgcaatggctacaatgtcctagttccggacttgttccgtgggaacccgtggaagctgaacgtcccgttcgacggcgacagcttcgagcggtggcgggcggggcaggccccgggccgggtttccggcgacatcgacgcgtgcacgaggtggctggtggacgagttcaaggccgcgggggtgtccaagaagctgggcgtgatcgggttctgctacggcggcgggcgcctcgtggagacgctggcgcgcgacgccgagagctgcttcagcgcgggggtctgcttctacgggtcccggatggacgcgtccctgggcgaccgcgtcgcggcgccggtcctgttcgtgtgcggcgacggcgacccgctgtgccccgtggagacggtgcgggagctggaggggcgcgcgagaggcgcccgggcggcggtgtacgccggcaggggccacgggttcgcgcaccggccgcagtcggtggaggaggacggcgacgccgaggacgcgttcaacgcgatgcgggggtggctgcacgaccacctgctcgcctgatcggacgatcagacgctgtacacgggttag

SEQ ID NO: 364 - DNA, 1754 bp, Zea mays
gccgagaagaagctaaggctcaggcatgagcttccgggaccaggagagtggcggggaggatgggggcaggacgtcctccgcctccgacctgcggaagccgctcatcaacaccgggagctggtaccgcatgccgccggcgggtggcgtgatgggctcgcggcaatccagcctcatggagcgcttgggctcctctgcgttctctctccgcgacgtcgctatctcggccacgctctgcacgcttattgtcgcgctaggtcccatccagttcggtttcacatgcggctactcctcgcccacgcaggacgccatcattgctgatctcggcctctccctctctgagttctccctcttcggttcattatctaatgtaggggcgatggtaggcgccatctccagtgggcaacttgcagagtatatcggccgcaaggggtctctcatgatcgctgcgattccaaacataattgggtggctcgcgatatcattcgcaaaagattcctctttcttgtttatgggtcggctgctagaaggatttggagtcggtgtaatatcgtatacagtaccggtttatattgcagaaatcgctcctcaggatcagaggggagctcttggttctgtcaatcagctctccgtcacgattggtatattgcttgcctacttgtttggcatgtttgttccctggagaattcttgctgttctaggcattttaccttgttcaatcctgattcctggactgttctttgtgcctgaatccccaaggtggttggcaaaaatggggaagatggaggattttgaatattcattgcaagttctgagaggatttcagacagatatcacagcagaagtaaatgaaataaagagatcattagcatcatcgaggaggaggacaaccataaggttcgctgatatcaaacagaagagatacagtgttccccttgtgataggaatcggtctccttgtcctgcagcagctaagtggtgtcaatggcattctattttatgctgcgagcatcttcaaagctgctggtattacaaacagtaatctagcaacatttggtttaggggctgttcaggtgattgctactggagtgacaacctggttgactgacaaagctggtcgaaggcttcttctcattatttccaccacaggaatggtcattactcttgttattgtttctgtgtcattttttgtgaaggacaacatagctgctggttcgcacttatactctgtaatgagtatgctttcactggctggacttgtggcatttgtgattgcattttctcttggcttgggagcgattccgtggatcattatgtctgagatccttcctgttaacatcaagagccttgctggaagtgttgcgaccctggcgaactggctgacagcatgggccattacaatgacggcaagcctgatgttgaactggagcagtggaggaacatttgctatctacgccgtcgtgtctaccatggccctcattttcgtgtgcttgtgggtgcctgagaccaagggaagaacgctagaggaaatcgccttctcattccgctgacacgtcgtcatgatctaggtatgggaagccacaccacaccatgtgtccttgagtctgccgcggtgcgttcagttcatgaatcccgcagggatcttgcagccattctcttgcttggatgtaccaccatcttcagtgttcataccaatgtacattgtacaatatgacgacgacgccatagcagaaaggcaagtgggtttatgtttgtacg

SEQ ID NO: 365 - DNA, 452 bp, Zea mays
ctgctcgggctagattaggaggacagcttcttcggccggcgacatggcggagaagggcgcgttgcagtcggcgagggagtgggtggtcgaccacaagctccgggccgtcgggacgctgtggctcagcggcatcgtcggctccatcgcctacaactggtccaggccgggcatgaagaccagcgtcaagatcatccacgccaggctgcatgctcaggctctcacgctggctgccttggctgggtccgcgctggtggagtactacgaccaccagcaagggtcaggatcgaaagttcaccaatatgcaaagcagttcctttcatctgatagcaatagcggccaacaaaaggagtagctagccagtgtccttgcgaagtgcaagcagcggagtgggcgttatttcctgatcaaataattttgcctatggcacattctgtggaaactttgacggatct

SEQ ID NO: 366 - DNA, 574 bp, Zea mays
atcgagacagagttccacgaagcagcaccagcacggcgccgcctcagcctatatataaacacacagccgccccccgtcttctactctgactctcatctgaagcgcgcgagagaaacgcgtatacccaggcggcggttgaggaagaggaggagaagaagaagaagatggcttcctccgcatacgcctcatggtccaagcggtggatccgtcccgaggtgtacccgctgttcgtgccgatggccgtggccttgggcatctgctcgtaccagcttgtgcgcaacatcacgggcaaccccgaggtgcgggtgaccaaggagaagagggcggccggcgtcctggacaaccacgacgagggcgagaggtacgctatgcacggcctcaggaagttcgtccgcgggaagaagcccgagatcatggcctccatcaactccttcttcgccgaccctcccaaggacgattaagctagattccgtcatggatggatggatggatggattcccgattcccgatcgtccatagtatgttttaccattcattagctgccggcggcgcgccttgattcgtagccgtcgtc

SEQ ID NO: 367 - DNA, 1420 bp, Zea mays
gctccgacgaaccctaataatcgccggggaccggcggacgatcgcccgccggcatgcaccatcagcagcggatgaagcaggcggcggcggccgcggccgcggcgcagcagcagcagctgatgcagcaggcactgctcctgcagcagcagcagcagtcgcaggcgcagccgcccttgttccccgggcaccacccgcaccccggcctcctcgccgcaccacagatagagcccatagtcagtggaaacctgcctcctgggtttgattcaagtacatgccgcagcgtgtatgttggcaatatccatcttcaagtgacggacacagtactgcaggaagtcttccaaagcattggtccagtagaagggtgcaagctcatcagaaaagaaaagtcatcctttggtttcattgactactatgaccgcagatatgctgcactggcaattttatctctcaatggcagacaactgtatggtcagccgattaaagtcaattgggcatatacaagtactccgagggaggacacgtcaggtcattttaatatttttgttggggatctttgcccggaagtcactgatgctactttgtttgcatttttctctggatactctacttgctcagatgctagggttatgtgggaccagaaaacaggacgatccagagggtttggttttgtttctttcaggaaccagcaggatgctcaaagtgcgataaatgacttgaatgggaagtggcttgggaaccgtcaaattcgttgcaattgggcaacgaaaggtgctaatgctggtgaagagaaacagattctggacactaaggttgacctgtcaaatggttcatcagaatctggaaaagagaatccaaatgatgatggtcctgaaaataaccctcagtttactactgtttatgttggcaatcttcctcacgaggctaccatgaatgatgtgcacctgtttttccattcactgggggctggttcaattgaggaagtccgtgtaactcgtgataaaggctttggctttgtgaggtacagcacccatgaggaggctgcattggcaattcagatgggtaatggccaacttattggcgggaggcagataaagtgttcctggggaagcaagccgactccacaagggacagcatccttgcctctgcctcccccagcactggcaccattctccactggagtgtcggccaccgacttgctggcctaccagcgcctgactctgagcaagatggcctcgaacccagccctaatgggtcagcacgccttgaagcaggtcgctgcattggggattggcggcggagccagccagtccatctatgatggcggcttccagggcatcaatactgccaccggcacaacttccgtccagcagcagcagcagctcatgtactactagagtactactactccatgaggcaccca

SEQ ID NO: 368 - DNA, 1177 bp, Zea mays
tgagttgacatgccgttagttgcgatttgcgaagctagctcccaccatctgcgacgccatgtcttcttcctctgtccaacaaacggcctttcccgagcaagaagccgatgcggaaggcgaaacgaaccctgagctctaccagcatttcgccaacttggtctcctccctgccgagctccaaaggcttgtccaacaacaaattctaccgccacggccaaggctggcactgcagcgaggtgggcatagtgggcgccatggtcaccgacgcgtgcttcagcgcgcgcccgtcggacgtcatcatcgccaccctgcccaagtccggcaccacgtggatgaagtcgctcctgtacgccaccgtgcaccggagagagcgtcccgtcgtcggcgccgccgccgccgaccagcatcctctcaacagctggggcccccacgacctcatcaagttcttcgagtaccagctctacacgcgggacagggtcccggacctggacaggctccccgaccctcgtctcttcgcgacgcacgtccctttcgtgtcgctgccgagctccgtggtcgccacgccgggctgcaagatcgtctacgtgtgccgcgaccccaaggaccacctcgtctccctgtgggacttcgtcaacaaatacttcagggtcaaggatgggctcgagcccctctccgtggaggccgccgccgagctgttctgcgccggcctgaccccgttcgggccgtactgggaccacgtgctcggctactggcgcgcgcaccgcgcggaccccgacaaggtgctcttcttcaggtacgaggagatgcagagggaccccgcggcgcacgtccgcaggctggcggagttcgtcggcctcccattcagctccgaggaggaggacggcggcgtggtggatgccgtcgtggggctgtgctcgttcgagcgcatgaggggcatggcgccgaccaagggtggcaggactgagttcccgatcggcgtggtgcccaacagctcctttttccggcagggcgtggtgggggactgggtgaaccacctgtcaccggaaatggcgcgccgcattgacgcgatcactgcagacaagttcaggggttcgggtctcgtcgtctagctggctgttacggatcaatcattactcatcatcagtgcgccactctaccgtggtttctcaaatgcttag

SEQ ID NO: 369 - DNA, 2019 bp, Oryza sativa
gccttgtcgtcatagaacaaccttctcttcccttccctcacctttcgcgttcacctcagctcagctcgtctctctgactctgatctcgccgtcccgagttcgccggacacgcacgcacgcggccacgacggcggcgatggagggcgccctgctctgcgccgccaaccacgcgccgctcacgcccatcaccttcctcgaccgcgccgccctcgtctaccccgaccgccccgccatcgtcgcctcctcctccgggctcacccgcacctggcgggagacgcgtgaccgctgcctccgcctcaccgccgccctcgccgccctcggcgtccaccgccaccacgtggttgcggtattcgcgcagaatattccggcgatgtgcgagctccacttcggcatcccgatggccggcgccgtcatctgcacgctcaactcccgcctcgacgccgccatggcctccgtcctgctccgccactcggaggccaagctcatcttcgtcgactgcgcgctgctcgacgtcgcccacgacgccatccgccgcatctcccaatcgggcgccacgcctcccgtcctcgtcctcatcagcgagctcctcgacgacccatccgatgccaagctcccgtccggtcgtgtcgactacgagtacgagcacctcgtcggcaatgccgggtcgtcgccggagttcgcggtgcggtggcccgccgacgagaacgagccgatcgcgctcaactacacgtcgggcacgacgtcgaggcccaagggcgtgatctacagccaccgcggcgcgtacctgaacagcctcgccgccgtgctcctcaacgacatggcgtccacgccggtgtacctgtggacggtgcccatgttccactgcaacgggtggtgcatggcgtggggcgtcgcggcgcagggcggcaccaacgtgtgcgtccgcagggtcaccgcggccaccatcttcgacgccgtggcgcgccacggcgtcacccacatgggcggcgcgcccacggtgctgagcatgatcgtgaacgccacggcggaggagcagcggccggtggcgaggagggtgacggtgatgaccggcggcgcgccgccgccgccgaaggtgctgcaccggatggaggagcaggggttcctggtgatccactcgtacgggctgacggagacgtacggcccggcgacggtgtgcacgtggaggccggagtgggacgcgctgccggcggaggagcgggcgcggatcaagtcgcggcagggggtgcactaccacggcctggaggtggacgtcaaggaccccgccacgatgcggagcgtgccgcgcgacgggaagacgatgggggaggtgatgctgcgggggaacacggtgatgagcggctactacaaggacggcgcggcgacggcggaggcgctcgccggtgggtggttccggtccggcgacctggcggtgcggcacgaggacgggtacgtgaaggtgctcgaccggtccaaggacatcataatctcgggcggggagaacatcagcacaatcgaggtggaggcggcgctgttcagccacccggcggtggaggaggcggcggtggtggggcggccggacgactactggggcgagacgccgtgcgcgttcgtgaagctgaggcccggcgcggcggcggcggcgaaggcgggggtggtggaggaggagctgatggcgtactgcagggcgaggttgccgaggtacatggcgccgcggacggtggtggtggtggaggaggggctgccgaagacggcgacggggaaggtgcagaagttcgagctgcgggcgcgcgccaaggccatgggcaccgtcccggcggcggcggcggcgaagtcgaagaggagcaagctctgaatgaatttgtttgcgtcagctgctgacgactgcaatgcaacttcgatgcagcatgcgtgtgtgtgcctgtggaatctcgagacaacaaccaaagaaaaaaaataaaaaaatcatgatttgttgtgatgattcgtgcgagaacaggttggtgtcctttggctgtcagt

SEQ ID NO: 370 - DNA, 1110 bp, Oryza sativa
agattggattagcgccgagccgaggcggcctcgacgataagcttcgcctcgccggccgccgccatgcggaacccgcccgggaggcacctcctccgcgtcgccacccgcgccgtgcgctcctcgtcggcgctcggcagcggcggcggcggagggggcgcctcgacctccgccacgtcccccgtcgccgcctcctcctcatccggtggccgcccgcgcacccgctccggcggccgcctcctgcgcgccacctcgccgcccccgccctccgccatcgccgcggccgcgtgctgggagtcccgcacgatgcgccgcgagggggaggaggagtgggaggaggtcgtcgccggggccgaggaggcggttcatggggcccccgtgcctgttgcggaggaggaggaggagtacagggtggtgttctggtcgccgcccaccggcgacgaggtccgcgcagccttcaccagcatcgaggaggtatttggtgatccttttcgtgcgcattcttatgaaactgaggagcaatcagcattgtccacctcagtacattcgtcatctggcaattcatcaggatcagatgactggattgaacctgctgcctatgctctcaactcaactgctcttctgacaagggaacatagaaatgttttggatgccttccgtttattgcaaaaagatcctaatgttcagaaaatggtcatgtccttgtcatgcgacagggctgtatgggatgctgttatgaacaacgaggcagtgcaagaattcaggagatctttccaggatgacaaagaagcagcaggtagaaagggaaaccctggtggtcctgctggagtgcttaagtggattctgggcaacacccaagcaaaaataatggaattcatgaataatataatgaagattgtgaacatgcttttccactctgatgatgatgaagcgaagcccgacctttacactgatgcagtgaaggtgtcattcatgctctcagttttcatcttcatcgtggtggccattgctcgtatcaattttgagccgtgggatttcaaagtgtggtgatgcaagattctgcaagccgtgtgtgcatgttttgtaggacagctcatgatttccaagctatag

SEQ ID NO: 371 - DNA, 1567 bp, Oryza sativa
agtcttgtatcacccgcatctgcgcgtccctctgcggcggcggcggcggcgacggcggcgatggggctggagatggaggggatggcggcggcgatcggcgtgtcggtgcccgtgctccgcttcctgctctgcttcgcggccaccatcccgacgggcctcatgtggcgggcggtgcccggcgccgcggggcggcacctctacgcggggctcaccggcgccgcgctttcctacctctcgttcggggccacatccaacctcctcttcgtcgtgcccatggcgttcgggtacctcgccatgctcctctgccgccggctcgcggggctcgtcaccttcctcggcgccttcggcttcctcatcgcatgtcacatgtactacatgagtggagatgcatggaaggagggtggcattgatgcaacaggtgctttaatggttttaacattgaaaatcatttcatgtgcaataaactacagtgacggtatgttgaaggaagagggtttgcgtgatgcccagaaaaagtatcgtttggctaaacttccttctttgatcgaatattttggctactgcctctgctgtggcagccattttgctgggccagtatatgagatgaaagattatcttgaatatactgaacggaaaggattatgggccagcccaactccttcaccactattgcctactttgcgtgctctagttcaagctggcgcatgtatggggttatatttgtatctatcacctcaatttccactttcacggtttagcgagcccttatattatgagtggggtttctggcaccggctcttctatcagtacatgtcaggctttactgctcgttggaaatactactttatatggtcactttcagaagctgcaatcattatatctggtctgggttttagcggctggtctgattcatctcccccgaaagccaaatgggatcgtgcaaaaaatgttgatgttttaggtgtcgaattagctacaagtgcagttcagttgccgcttatgtggaacattcaagtgagcacatggctgcgatactatgtttatgagaggttagttcagaaaggaaagaaacctggtttcctccagttgctgggtacacagacagtcagtgctgtctggcatggtctttatcccggatatatcatattctttgttcaatcagcattgatgataaatggttcaaaagtcatatacagatggcaacaagcagtcagcaatccagtcttccacgctatcctggtttttgtaaatttttcatacaccttgatggtccttaactactcatgtattgggttccaggtactgagcttcaaggaaaccctagcatcctaccagagcgtatattatatcggcacaattgttcccattgtagttgtcttgctgggttatgttatcaagccagccaggccagtgaagccaaaggctcggaaggcagaatgagcaacaagttgacctggtcaagtggtcattacatataggagcgacgaagaacatttaatgacgataatgacgaactagtgtccagctattctactgtggaatttcgcaggagaatgtgatgactcac

SEQ ID NO: 372 - DNA, 2433 bp, Oryza sativa
ggtcaaagtttgggagacagagagagctactccagtttttagttagttcgatggtggcgaggatgatgcggtggccgcgcccgccggcggcgcgcaagttccgggtccggctggtggtgcggcgggcggaggggctccagcagccatgcgccgcggcggcggagcacgcggcttcggcggaggcagaggcgccgccgacgagggttgcggcggaggtgaggtggaaggggcccaaggcgtcgcccctcagctcgctgcgccgcaccgcggtgcggcgcaaccgcacgcgggaggcggaggcggaggcggccgcggtggttgcctgcgccaccgccgccgacgatgccgctgccgccgcgggcgccggagacgcggcgggcgtggtggtggctgcgtgggaggaggagttcgagagcacggtgacgctcgctgccgcgtcgcaccgggagcacgccgcgttccagccatgggagctcgccttctccgtgttcactgctgccaacagaggaccaaagatcaagccatcaattcttggaactgcttcccttaacctagcagattatgcatccgccgccgaagagaatattgagataattctcccattgtccgtgccaaatggttcagctgagtcagctccctcgctacatctcaccctgggtatggtggaattaagggcttttcaggaaacatctgatgcttcacaaaggtctgctatggccgctccattatccccatcctctggtgattctgctccagtaggaaaagatgaggtttcagttatcagagccgggctgagaaaggtgaaaatcctcactgatctggtgtcgacacgaaggtccaagaagacatcccaagatgatgaaagcagtgaagaaaaatgctatgttaacagtgatggtgctgaatatccatgtgacatcgagtctctggatgacgatttggatgacagggcacagcaagatgaagttggggattcaactgtcaggaagtccttcagttatggctcactgcagtctgtcaactatgtcggcggcctagtttatgctcatgcaaagattgatggggagcatgaggactggatctattatagtcaccgcaaatctgatgccggttaccatgtagagggaaagccatcatcaactgttgaggaaaccatgctgccaactgtaaaacggagtatccttccttggagaaagaggaagttgagtttgcgatcactgaaggcaaaaggcgaacctctgttgaagaaagcatatggagaagagggaggtgatgatattgactatgatcgacggctgctaacctcttctgatggatctgtttcagagggatcaaggggtgaagatgggtccattaatggtatggtttcagaatttggtgatgacaacttcgttgttgggaattgggaattgaaagagatagttagccgtgatggccatctgaagctctcttcccatgttttctttgcatcaatagaccagagaagtgagcgggctgctggggagagtgcttgcacagcacttgtggctgttattgcggactggttccaatcaaaccaggatataatgcctatacaatcacaatttgacagtttaatccgtgaaggatcattagagtggagaaacctttgtgagaatctgatgtaccgagagcgttttcctgacaagcactttgatcttgaaactgtccttcaggccaagatccgccccctcacagtttcttctagcaagtcttttattggattcttccaacctgaaggtgccgatgacatgcacagatttgatttccttgatggagcaatgtcatttgatagcatctgggctgagattagcaaagcagctgagtactcatcaagtgataaccctaatctatatatagtgagctggaatgaccacttttttctgctcaaggttgagcgtgatgcgtattacataattgacacccttggagaaaggctctacgaagggtgcaaccaagcctacattttgaagtttgacaacgacaccatgattcataagctacctgagaaagcaccatctagtcctaactcaagtggaccgctgaaggattcttcaaggagctcctcggttgagcaggacagtgaagatggcactgaagagaacatactggtttcaaagggcaaggaatcatgcaaggagtatatcaagagtttcttggcagccatcccaatccgggaactacaggttgacatcaagaaaggcctgatggcgtcgacgccattgcaccaccggcttcaaatagagttccactacactgcatcatccccaaaggagattacctcagcccctcaaattctaaccatcgaagccccttttgagttctcatggcctgagccaccaccggcaatggagatcgcgctagcaccagctgttgctgttgtatagcttcctgatggtgatctgtcctgacatc

SEQ ID NO: 373 - DNA, 463 bp, Oryza sativa
ggtagtagatctttcgtacgttggagccggccggatcgacgaccatggggtgcgacgacaagtgcgggtgcgccgtcccgtgccccggcggcacgggctgcaggtgcgcgtcttcggcgaggagcggcggcggcgaccacacgacgtgctcgtgcggcgaccactgcgggtgcaacccgtgcaggtgcggccgcgagtcgcagccgacggggagggagaaccggagggccggctgctcctgcggcgactcctgcacctgcgcctcctgcggctccaccaccaccaccgctcccgcggccaccacctgatccatccatccatgcgcccaaaaatgcccaacgagacgtgtttatacgtgtggttaagcgtgtgtacgtgcgccatgcttagtactcatagctgcttagctaaacagcacagctgataaataaaaagggcttgctgcttgagtcgagtcgtatcc

SEQ ID NO: 374 - DNA, 383 bp, Sorghum bicolor
cggagatgagcgggagcgcgttcaacgcgttcaagtcgcgggtgccggtggcgtggagtccccggctgtacatcactctggtgcggggcctcccggggacgcggcgcctccaccgccgcacgctcgaggccatgcgcctccgccgctgccaccgcactgtcgagcaccgcaccacgccgtcgctcctcgggatgctcacccaggtgaagcgcctcgtcgccgtcgagacggaggagatgtacaacgcgcggaagcaggccgaggcggagaggcgcgcgcccagacccccgctcgtcgtctcccaccacccgccgccgccgacaccgaagccggcagcagccgccgcggagggtgccgctaccactgcgcagtagcctttgtag

SEQ ID NO: 375 - DNA, 1108 bp, Sorghum bicolor
tgacaacgccttcccaacccgcatcgacagcgcgcacttggattcggcgacgccggagcgcggaggaggcaagcgccgatccagagacgatggccgccgcgggctcctcgccgtcatcctcctcaagcaagcggttggaagggaaggtggccctcgtcaccggtggcgccaccggcatcggcgaagccatcgttcgcctcttcacggagcacggcgccaaggtctgcatcgcggacatccaggacgaggccgggcagcagctgcgcgacgccctgggaggcgacgcgcagggcgtcatgttcgtccactgcgacgtgacgtcggaggaggacgtgagccgcgccgtggacgcggcggcggagcggttcggcgcgctggacgtgatggtgaacaacgcgggcgtgacgggtgccaaggtgacggacatccgtgccgtggacttcgccgaggtgcgccgggtgctcgacatcaacgtgcacggcgtgttcctggggatgaagcacgcggcgcgcgtcatgatcccgcagaagcggggctccatcgtgtcgctggccagcgtggccagcgccatcggcgggctgggcccgcacgcgtacacggcgtccaagcacgccgtggtcgggctcaccaagagcgtcgccgcggagctcggccgccacggggtgcgcgtcaactgcgtgtccccctacgccgtgcccacggcgctgtccatgccgcacctgccccagggcgcgcgcgccgacgacgcgctcacggacttcctggccttcgtcggcggcgaggccaacctcaagggcgtcgacgccatgcccaaggacgtcgcccaggcggtgctatacctggccagcgacgaggcgaggtacgtcagcgcgctcaacctcatggtggacggcggcttcacagccgtcaaccataacctcaggccattcgatgattagctcagcttgtttagcagcattattatcactcttgttctgctgctactctgagactttttctttttgaactgtaacaagtgtctgtaagactaataaaccgcatgttacatgattggacattctaagcgacaatgccgaattcgcgtatggtatatggttgctgaatgtgc

SEQ ID NO: 376 - DNA, 524 bp, Sorghum bicolor
gccattatccgaacccaagccgccccaggggtccgaccacagaaccgagcccaaaaatggcggccgcctcctccatgctcaccgccgcgtcgctctccttctccccgctcccagctccgcgcctcccggccgccgcctccttcgctccgccgcgccgcgcggcagccgcactcgtcgtgcgcgcggcggccgcctcgtccaagtccccggccgcggcggagacggccccgaagaagaagagggcgaccggcatcacccagccgaagcccgtgtcgccggcgctgcaggcaatcgtgggcgaaccggttatcccccgcaccgaggccctcaagcgcctctgggcctacatcaaggagcataacctccaggatccttctgacaaaaaggtggtcatctgtgatgagaagttgaaggtcctgtttgctgggcgggagcgagttggattccttgagatcgccaagcttctcaaccctcactttgtgaagtgagaaggcactcccaggagttgagttggcctatggatg

SEQ ID NO: 377 - DNA, 1309 bp, Sorghum bicolor
aatgccatgcgtgtgtgcaagtgtaagttgtgcacacacaacaatatagggcgtgtcttgtcttaagccagcacgcagctccgatgacaagctgcttcaacggcggcgccggctggccggagcccgtggtgcgcgtccagcatgtgtcggacacctgcggcgacacgatccccgagcggtacgtgaagcctccgtcggagcggccctgtctctcaccagcagcagcctcctccggtggcgtcggcggcggcggcggcggtggcccgaacatcccagtcgtagacctgtcaatgctagacgtggacgcgacctcccgcgctgtggcggcggcgtgccgcgagtgggggtttttccaggcagtgaaccacggcgtccggccggagctgctgcgcagcgggcgcgcggcgtggcgtggcttcttccggcagcccgcggtggtgcgcgagcgttacgcgaactcgccggcgacgtacgagggctacggcagccgcctcggcaccgccaagggcggccccctcgactggggcgactactacttcctccacctcctgccggcgtcgctcaagagccacgaaaagtggccttccctcccttcctctctacgggggacgacggaggagtacggcgaggaagtgctgcagctgtgccggagggtgatgcggctgctgtccagcgggctggggctggaagccggaaggctgcaggcggcgttcggcggagagggtggcgaaggggcgtgcctgcgggtcaacttgtacccgcggtgcccgcagccagagctgacgctgggcgtggcggggcactcggaccccggcggcatgaccatgctgctggtggacgaccacgtcaagggactgcaggtgaggagccccgacgggcagtggatcatcgtcgaccccgtccccgacgccttcatcgtcaacgtcggcgaccagatccaggtgctgagcaacgcgtcatacaagagcgtggagcaccgggtgacggtgagcgcggcggaggaccggctgtctatggctttcttctacaacccgcgaagcgacctgcccatcgcgccgatgccggagctggtggggcccggccgcccggcgctgtacccggagatgaccttcgacgagtaccgcgttttcatccggcaacgcggtttggccggcaaggcgcagcttcagtccctgcaggccaatcaaaccgccgccgccgccgccggctcgtcgtccacctgcagctagcagctactgagctagctatatatatatatatacgtatcatcatcggcaaggccagctggtttcagttagctgtgctgtgc

SEQ ID NO: 378 - DNA, 1396 bp, Sorghum bicolor
agctagctgccttcatctatcgagtcaccggtcacatcacagctgatatcgaggcgacgcgccggccgccggcgaggtgctccatccagctcccaccaaaaaccactaatagccatggcgcggctcctcctcctcctcggggccgccatggtgctcttggcgtccgcggccacggcgcaggactgcctgtccgcgacgttcagcggcgggcggaccttcggcaagtgcaacagcatgccgacgctcagcgccagcctgcactggacgtaccacccggagaacggcaccgcggacgtggcgttccgcgcgccgtcggacaccagcggctgggtcggctggggcatcaaccccactagcggcaacagcatggtcggcagcagcgtcttcatcgcgtcgcaggacagcagcggcgtggtgtccgtcctcatgacctacctggagaccacaagccaacccgcactaaccaacaacaccttcaagttcaacgtgcccatcggccccgccgccgagtactccgacggcgcctacaccatctacgccaccgtggagcttcccgggaactccacgcagcagtacacggtgtggcaggccggccctaccagcaacggtgccatcgcccaacacccgctttcgccatccaacagggcaagcacccagagtctggacttcctctcggggtcaagcaccgccgcgtcaaactccaagcttcaccgccgtaacattcacggactgctgaacgcgattgcctggggcatcctgatcccgatcggcgccatcatcgcccggtacctgcgcgtgttcgagtcggcggacccggcatggttctacctgcacatcgtctgccagtgctccggctacatcctgggcgtggccggctggggcctggggctgaagctgggcagcgagtccgcgggcatcacctacaagccccaccgcaacctcggcatcgccatcttcagcctggccaccctgcaggtgttcgcgctgctgctcaggcccgacaagaagaacaagtacaggctctactggaacatctaccaccactccgtcggctactccgtcatcgtgctcagcgccatcaacatcttcaaggggctcgacatcctccagccggccagcgggtacaagaccgcctacattgtcatcctggccacgctcggcggcatcgcgctctgcctcgaggccatcacctggcccatcgccatccggaagcgcaggcggaacgccgccgacaaggcggccgtcggcaacggcaacggctggcagcagggtgcgtagggagtaccagatatcatcgccgggcgtgtgcatagcacagtgcgtgcgtgcgtgtgtgtgttttgatgcgagggaggaatgtgacatcgatgtgctgatggcgttgttcagagagatt

SEQ ID NO: 379 - DNA, 2091 bp, Sorghum bicolor
acgtttctggaagttcgttgaggcatcaaagaattgcctgccctgcgccgtgcgcgtgtgccgtgtgtcggcgcggccgggatgggcaagatgaactgcttctccggcctgctcagcggcaagaggaaggcatccaagggtaagaacaagggcgcttacgtcaagaagggtagtggcaatgattgtcccaaggtgaagccggtggagttcatggacatggcggacactgttgtcgacgacgtcgtcagcagaggcggagacagcagcgttcctgcgtctgcatgcaacagtaggtttgtcgttcacgcagccgcccagctgccacgccatgccagtggcgagaatggcgacaaggccgcagctaagaaggagtcgtccgccgccgacgacgacctcgtcgccggcgttggctcctccggtcacagcagctacggaactggcaacagcgatgccaagagcaccgagccggacgacggcgagcgctccagccttggccgcatgtcgccaacggcatcgccgaagctgatgcgctcctgctccaacatcgagacgacgaggtctgtcgtcccggcagggtccgacctgccggcgaagtcgcgctcctacaacgacctgaagatcctgcctcccggaaggtcgaccgccgcccgcagcggcgcgatcgacgcgagcccgacggcgtccttcaggacctcgtgctccgccgaccgcgtcatgctgaagaagcggtcgtcgaggcaggtgctcccgtccaggagccggaagctgtggtggcagatgttcctctggagccaccgcaacctgcaccggccgggcgcgagcgcgaccatgcccacgctgctgccgccatcgccggggcaagaagaagaagaagaagaaggcggtgccgcgcaccagcacgacgggtacacgtccgacacgctgggcgcggtcaccgcggacgccaagaacaaaggcgtcgccatcgaggcggaccccattacgagccagtgggtcgcgttctccgccgaggcctcgccgctggaccgggtcagcgcgtgggtgaacagcctcggggacggctcgttccacgccgtcgacgaggacgatgccacggggcacggcagcggcggcgaaggcgccgctcgcccgcgacggcagcggtgctccgagatcgtggagctgtcgacggcgacggccggcggcaagaggaacccggaggcgaagcggcgcgcggcggacgaggctgcccaggcgagcggcatcgtgcagacgctcaacaccttctcctccgtcgcccacatcgccggcatggggctcaagaccgtcccgacgattgcggctttctcgaccctccgtgccgtcaatctgtctggaaacacgattgttgaaatcagcgctggatcgttgcccaaaggcctgcattcgctggatctgtcgaggaacaagattgcaatcatcgaggggctgcgggagctgacgaggctgcgggtgctcaacctcagctacaaccggatctcacggatcgggcatggcctgtcgagctgcacggcgatcagggagctgtacctggccgggaacaagatcagcgacgtggaggggcttcaccggctgctgaagctggccgtcctggacgtgagcttcaacaagatcaccacggccaagtccctgggccagctcgtggccaactacggctcgctgcgggcgatcaacctgctgggcaacccggtgcaggccaacaccggcgacgacacgctccgcaaggccgtgtcgggcctgctcccgcggatcgagtacctcaacaagcaggccgtcaagccgcagcgcgcgcgggaggtggccaaggacagcgtcgcgcaggcggcgctcgggaacgccggctggaactcgcggaggcggctcacgcggcgcctcagccagagccccgggtcggcggggaagggcggccggggcagggacggcaacggcaacggcagccgcaggggcagcaggagcaggtccatgaccaggccccagagctcgagcttgccaaggagatgagaggcaaaacgtgcgacgtacgtactgagaaaaaaaaatggtcttcggcttgaagagggagaagaaacatag

SEQ ID NO: 380 - DNA, 1280 bp, Sorghum bicolor
aaactcgagaccgttgcttcttcctgcttctcctcccggcacaaggcacagccaccatcaccatgtgggtgacgtcgtcgatgccgcaggtgtgggacgaggaggccgcggccaagggcggcggcgcggcggcggtgacccccgcgccggcggcggccatgctgggctctctggcggggtggctgtcgcggaccgtgcagccgcagccgcccccgccccgggtgtgcggcaccgagggaggaccccccgtgacggcgcccaggctcaggctccgcgacggccgccacctcgcctactgcgagagcggcgtgcctcgggaccaggccaggttcaaggtcgtcttctcccacggcttcaccggctcccgcgaggacagcgtccgcgcctcccaggaagtggcggaggagctgggcgtgtacatggtgggcttcgaccgcgccgggtacgggcagagcgaccccaaccccaaccggtccgtcaagagcgcggcgctggacgtggaggagctcgcggacgcgctggggctcggccccaagttctacgtcatcggcatctccctcggctgccatgccgtctggggcgccctcaagtacatccccgacaggatcgccggcgcggtaatgatggcgccggtggtgaactactggtggccagggttccctccggagctggcggcggaggtgtacgcgaagcaggaggtgggggaccagtgggcgctgcgggtgtcgcaccacgcgccggggatcctccactggtggatggaccagagctggctgcccacgtcgacggtggtggccggcacgacgccgctgccgaacgcgcgcgacgccgagatccggcgcaacatgcaggcggacggcacgttccagcagaagcgggagcaggcgacgcagcaggggatccacgagtcctactaccgcgacatgaccgtcatgttcggcaagtgggagttcgaccccatggcgctgccggagccgccgtgccccgtgcacctgtggcagggcgacgaggacggcctcgtccccgtcgtcctgcagaggtacctcgccggcaagctcgcctgggtcaactaccacgagctccccggcaccggacacttcctgtcggcggtgcctgggctcggagacaccgtcctcaggacccttttcggtcagaagcagtagcaacaaacagttcattacgacgacgtatggacggtgctaagcttaaagtatactagtagtgtcagtcgtggcgcattagttcatttgttattgtaaggccgatggttggaattcttt

SEQ ID NO: 381 - DNA, 846 bp, Sorghum bicolor
gaagagataagcccgggtaaagccggtgagccgcaacagtcgccgatgtcgccgccgccgtcgcctctcgtggtgctccccatcctcctcctcctcctcctcctcctcgccgctgcatccccctccctcgctgcggccaatgcggcaggcgccgttgcccctgctccggtgccgacgccgtggccggagcagttccacgcggtggtgttcaccaacctcaccgagagcggcggccggctgcagctgatcgacctctactacgactggcccaggggccgcaacctcaacctcatccgggaccagctctccggcgacccgctctacgacgtcgagtggaccaacggcacctcctactacttcgactccgggtcctgccgcaccatccgtttccccgtgggcctcctgccgcccgactggctcgccgccggcgccgtctacctcggccgcgagcacgtcgacggcttcgactgccacctctggaccaaggtcgacttcgtctggtactacgaggaagtcgccaccggccgccccgtccgctggaatttcttcaatgggatgcagcagcatgtgatgagctttgaggtcggaggagtgctggaagactccaagtggcaggcgcctgcttactgcttcaatggcggcaatgccgacaccaccaatgtggctgcaggtggagttgatagcgaagccggtagggttgatgtgatgaacagcatgatcaggttcgccggggctccagctgcagctgtagctgcatcatttgaccaatgagaattttcttttttttgatgaattggctgatgagaggctttgccaacggtgatccacgtcctgttgattctgtta

SEQ ID NO: 382 - DNA, 1125 bp, Sorghum bicolor
gcttcaacaagaggacaagaggtggaggagcatactgcatacatacagacgttcagtacatacatagagtttcttttttttttggttcgtgttagtccttggtgcatggactacgctcgtagcatgatcagcagctccgctgtgccattccgtgctgccggcgacggcgatggcggcggacaggtgtttctctttggcggccgcggcggcggcggattccttcgaggattgccgttggtgggtggcgccagcgctgctgccggtgcggcggcggacggccggcgcaagcgggcgtttcagctaacgacggcgcacgaggagccgcagctggagctgggcgacgacgagctgtgcggcggcttcgactacgagctcctccacgggccgcagcagcaggagcggacgaagcggcggctgacggcggagcaggtgcgggagctggagctgagcttcgaggaggagaagcggaagctggagcccgagcggaagagcgagctggcgcgaaggctcgggatcgcgccgcgccaggtggccgtgtggttccagaaccgccgcgcgcgctggaggaccaagcagctggagcaggacttcgaccgcctcagggccgcgcacgacgacctcctcgccggccgcgacgcgctcctcgccgacaacgatcgcctccgctcacaggtgatcacgttaactgagaaactgcaagcgaaggagtcgtcggcgtcagagccggaagagtttacagttgccactcaagagacagcctatgctcttttcgaagaagacaagctctgcctctgctccgagatcgccaccggcagcactgcagcggcggcgccagggagcaacgacagcccggagtcctacttcgccggtgcgtgctcgcctccgtcgtcgccagaggacgacggctgcggtggcgccgacgaccgcaccttcttcctcccggacgccctgctcgccacgggcgtggaggagagcctcgagcgcgctgccgaagaggacgatggcgctgggacgcagctcaacaactgggcatggttatggaacgatcagcagtattagggaatgcacgcatgatattattgcagtgcaaatttggtctcgagctttgctgatgttgatacggtg

SEQ ID NO: 383 - DNA, 1499 bp, Sorghum bicolor
caggaatagcgcaacgagacgagatcggagggcgacagggcgtggccgcgaggggaaatgggatcggagggacgggcctggaacggcgccgccggcagcagcggccatggcggcggcggcggcggcgtagaggcgaaagcgatcaccgcggctctgtcggccgcggaggttcccaggatggcggtctccgtcgacatctcgctgccgctcccggagatgtcgcctgacatcatatatctctgcaagcaattggtcattgggtggtgtaagattgacagctcccgcttctccatcgagaccgtgtccggaggcatcaccaatctattgctcaaggtttctgtcaaagaagacgacggcaatgagtctgctgttactgtccggttgtatggaccgaatacggacttggtgattgatcggaaaagggaattgaaggcgataccgtatctctcagctgcagggttcggggctcagctacttggaatatttgggaatggagtagttcagtcattcatctatgctcgaacactgtcacctgcagacatgagagatcctaaaatagcagctgaaattgccaaggagctacataaattccatcaagtagacataccagggtctaaacaaccgcaattgtggaatgatatattcaagtttttgaagaaagctgcagcattgaagtttgaggataacgagcagcagaagagatatgaaaagatctcatttagagaaatacaagatgaagttcaagaacttaaggatctcttggacactatgcatgcgcctgtggtttatgcacacaatgacttgctttcaggaaatctgatgctcaatgatttggaagggaagctatattttattgattttgagtatgggtcatacagctaccgtggctatgacattgcaaatcatttcaatgagtatgctggacttgattgtgactataatttgtacccagataaagatgcccagtataacttcttcaggaattatctacgccctgatagacctagtgaggcacaggcacaagatatggaagtactttatgtggaaacaaacactttcagactagcatcgcacatttactgggcattatgggcccttattcaggcaaaggtatccccaattgactttgactatcttggatacttcttcttacggtatggtgagtacaagaaacagagggagccctgcttctccttggcacaaagctttctctccaagccaagaaatgtctagagcctgagaatctgttcatgagtttatactgttgtgcgcatatactcggggcgggtacgccttgtgatcatctgctgctactcagaaactctattatagtgttggtagcagccccgcattgttgtatccgatgttaggttcgtcattgcctgataggaaagtcgcatgatccgtcctcgggagcacagggtggcaagatctgttatatttgtaataaacacaatcctggagggtcctgccctgtgcaatttgttgtgcacataagc

SEQ ID NO: 384 - DNA, 1136 bp, Sorghum bicolor
gagccatgccaaactggccaaccatattgttggtatggtcatatggagaaacctgcgagttgcttctctctcgggttcggcagatgccatgcctgctgtattcctctttgtggcgatctctagctgcgacctgtgactgtgagagcccatgccaaactggccaagcatggtatggagaaacctgctggagttgcttctctctcgggttcggcagatgccatgcttgctgcattcctctttgccgcgatttccagctgcgacctgtgactcagagagtgaatggcgcacctgctctgtctcagacttcgctggggcctggccagggagccagacagcaggcagccagtcatggcgcgtacaagggactcaaaattcccgccaaatcagcaggcagccactgcgtacaagggactcaattcccgccaaatctgctgaaatcccgaatccgtggtatatcccaacaaaaagtgggtcacactccgcagcaaaaccatactcctcgtcctcgtctcctcgtgcctgacaccacttccactggtcctcttcgctcttgtgctcacggaaccacggccgtctccctgacgcggagctcgcccgcagccgcaatgtcgtggctcctggtcgtcgcggtgcttgccggcttcgcgcttggtccgtccgcgggcacggaccacatcgtgggcgccaaccatgggtggaaccccaacatcaactactccctctggtccggcaaccagaccttctacgtcggagacctcatctcgttccggtaccagaaggggacgcacaacgtgttcgaggtgaacgagacggggtacgacaactgcaccatggccggggtcgccggcaactggacctccggcaaggacttcatcccgctccccgaggcccgccgctactacttcatctgcggcaacggcttctgcctgcaaggcatgaaggtcgccatcaccgtccacccgctcccgcacaacgccacctccaagggctccagcacccgtgggggcaccggcgcacaggaagaggccgccgcggcggcgcttggggccaggagcgccgcgtggctggcgacgctcgcagtcgccgcagtgtctgctatctgctaggagctttattccaagcattctctgagctag

SEQ ID NO: 385 - DNA, 1690 bp, Sorghum bicolor
gtcttcctgcttgaggtttctggttgggtcgcgatggccggcggcgtggttgtgaacgccggagggggaaaggactaccccggcaagctcaccatgttcgtgctcttcgcctgcatcgtcgccgccaccggcgggctcatcttcggatacgacatcggcatctccggtggcgtgacgtcgatgaacccgttcctgatgaagttcttcccgtcggtgtaccacaaggagcaggaggcggagcggaaccagagcaaccagtactgcaagttcgacagccagctgctgaccatgttcacctcctcgctctacctcgccgcgctcgtggcctccttcgtcgccgccaccgtcacccgcgtggccggccgcaagtggtccatgttcggcggcggcgtcacgttcctggtcggcgccgcgctcaacggcgccgccaaggacgtcgtcatgctcatcctcggccgcgtcctcctcggcatcggcgtcggcttcgccaaccagtcggtccccgtctacctgtcggagatggcgcccgcgcgcctccgcgggatgctcaacatcgggttccagctcatgatcaccatcggcatcctgtgcgccaacctcatcaactacggcaccgccaagatcaagggcggctggggctggcgcgtcagcctggcgctcgcggccgtgccggccgccatcatcgccgtgggcgcgctgttcctgcccgacaccccaaactccctcatcgaccgcggctacaccgacgacgccaagcggatgctcaagcgcgtgcgcggcacggaggacgtggaggaggagtacaacgacctggtggccgccagcgaggagtccaagctcgtggcgcacccatggcgcaacatcctgcagccgcggtacaggccgcagctcgtcatggccatcgccatccccatgttccagcagctcacgggcatcaacgtcatcatgttctacgcgccggtgctcttcaagacgctgggcttcgccgacgacgcatccctcatgtccgccgtcatcacggggctcgtcaacgtcttcgcgaccttcgtgtccatcgtcaccgtcgaccgcctcggccgccgcaagctgttcctgcagggcggcacccagatgctcgcgtgccagatcgtcgtcggcagcctgatcggcgccaagttcggcttctccggcgtggccgagatccccaaggggtacgccgccatcgtggtgttcttcatctgcgcgtacgtggccgggttcgcctggtcctggggacccctcggctggctggtgcccagcgagatcttcccgctggagatccggtcggcggggcagagcatcaacgtgtccgtcaacatgctctgcaccttcatcatcgcgcaggcgttcctccccatgctctgccgcttcaagttcatcctcttcttcttcttcggcgcctgggtcgtcgtcatgaccatcttcgtcgcgctcttcctgccggagaccaagaacgtgcccatcgaggagatggtgctcgtgtggaagtcgcactggtactggggccgcttcatccgcgacgaggacgtgcacgtcggcgccgacctcgagatgccatccgccaacggcaacggcaaggtcggagcgggcaagctcgtcggcatgcagtagccatggcggcgcctgggcgtccctcgctgctgatgcctgatggtgggcaataatctactca

SEQ ID NO: 386 - DNA, 6591 bp, Sorghum bicolor
aaagtcgacctcccatggccaacctcggcggcggcgccgaggcgcacgcgcggttcaagcagtacgagtaccgcgccaactccagcctcgtcctcaccaccgactcccgcccgcgcgacacccacgagcctaccggtgagcccgagacgctctggggcaggatcgaccccaggtccttcggcgaccgcgccgtccagaacaagccgcccgagctcgaggagaagctctccaagtcgcgcaccaagaagtctaagcgcgacgctgctgctgcggcggaccccgccgacctcccccgtcgcgacgccaagcgcaggcgccgcgccgcttctacccaggaggtctccgtcctctccctcaccgacgacgccgtctacaagccccagaccaaggagacgcgcgctgcctacgaggccctgctcagcctcatccagcagcagcttggcggccagccccttgacgtcctcgccggggcagctgatgaggtgcttgccacgctcaagaatgacaaggtcaagaaccctgataagaagaaggacattgagcagctgctcaaccctatctccagccagctctttgaccagcttgtctccatcggcaagctcatcaccgacttccatgatgcggcggccggtgacgctgccggtgtgccttctgccgatggcacggacaccaccctggatgatgatgttggtgttgctgtcgagtttgaagaagatgaagatgaggagagtgattttgatcaggtgcaagatgacctggatgaggatgatgaagatgacatggctgagttgaatggtcctggaggtatgcagatgggcggcgagttagacgatgatgacatgcagaacgccaaccaggggctggccgtcaatgttcaggacatcgatgcttactggctccagaggaagatatcccaggcatatggggatggggacattgatgcccagcagagccagaagcttgccgaggatatcttgaagatcattgctgagggcgacgatagagacgtcgagaatcgccttgtcatgctcttggactatgagaagtttgatctcattaagttgctgctgcgcaaccgtctcaagattgtttggtgcacccgcttagccagggccgaagatcaggaacagaggaagaagatagaggaagagatggcaagtgacccaagtttggctccaatattggagcagctacatgcaaccagagcatctgcaaaggagaggcagaagaacctggagaaaagtatcagggacgaggcgaagaggctcctcaacaatgatgctggcgctgatggtgccagggaccgcagggcagctgagcgggacatggagagtggatggctgaaaggacagagacagctgcttgatctcgaaagcctctcgttccatcagggtggtctctttatggctaacaagaaatgtgaactgccgactggatcgtttagaacccctcataaggggtatgaggaggttcatgtgccagcactgaaggctaagccctatgaaacatcggagaagattgtcaagatatctgatatgccagagttcgcacggtcagctttcgatgggatgacccagctgaacagagttcagagcagggtctatgatactgctcttttcaaaccagacaatatccttctctgtgctccgactggtgctggcaaaacaaatgtggctgtgcttaccatccttcagcagatcggtctgcatatgcaggatgatgggcagtttgataataccaagtacaaaattgtctatgtggccccgatgaaagcgttggttgctgaagtcgttggaaacttgtcgaatcgtttggcaggttacaatgttactgttagggagctcagtggagaccagaacttgaccaagcaacagattgatgaaacacagattatcgtcacgacacctgagaaatgggatattgtgaccaggaaatcaggggacagaacctatacccaaatggtgaagctgttaatcattgatgagatccatctgctacatgataacagagggcctgttctggagagcattgttgctaggacagtcaggcagattgagacgaccaaggagcatattcgtctggttgggctctctgcgactctaccaaactatgaagatgttgcattattcttgcgtgttcgcaaagaaagcctcttctattttgacaacagttaccgaccttgccctcttgctcagcaatacattgggatcactgtgaggaagccactacagaggatgcagttgatgaatgagatctgttacgagaaggttatggctgccgctggtaagcatcaagtgctgatatttgtacactcaaggaaggagacggcaaagactgccaaagccatcagagatacggcgttggcaaatgacacagtcagccgctttctgaagaacgagagtgcaagccaagagatccttggcactcatgctgaacttgtcaaaaacaatgatcttaaagaccttttgccttatgggtttgctattcatcatgctgggatggcaagagttgaccgtgagcttgttgaggagctttttgctgacaagcacattcaagtacttgtatccactgctacccttgcatggggtgtcaatttgcctgcacatactgttatcataaagggtacgcagatttacaacccagaaaaaggtgcttggacagaactaagccctctggatgttatgcagatgcttggtcgtgcaggaaggcctcagtatgatacacatggagagggaataatcttgactggccacagtgaattgcagttctacctgtctcttatgaaccagcagttgcctattgagagtcagttcatatccaaattggctgatcaattgaatgcagaaattgttctggggactattcagaatgctcgtgaagcatgctcgtggcttggctatacttacctctatattcggatgctccgcaatccaacattgtatggtttgccagcagatatcttggagagtgataaaacgcttgatgaaaggagagctgatttgatacattccgctgcaaatctactggataggaacaatctgataaagtatgacaggaaaacaggatactttcaagttactgacctgggaaggattgccagttattactatatcagtcatggaactatttcaacatacaatgagtacctaaaacctacaatgggtgatatcgaactgtgccgactgttttctcttagtgaagaatttaagtatgtcggtgtcaggcttgatgagaaaatggaactggctaagcttttggatcgtgtaccaatacccgtgaaagagagcttggaggaaccaagtgcaaagatcaacgttctgctgcaagcatatatttctaggttgaaactggaaggcctttctcttagttctgatatggtctacatcagacagagtgctggccgtctcttacgagcactatttgagattgttttgaagaggggatgggctcaactagcagagaaagcgctgaatctttgcaagatggtcgataaacaaatgtggagtgttcaaactcccttgcggcagtttactggaattccaaaggagatcttgatgaaactcgagaagaaggagttggcttgggagaggtactacgatctgtcctcacaagaaattggtgaactgatccgctatcccaagatggggaggcagctgcacaagtgcatccaccagttaccaaagctgaatctttcagcccatgtccagcccattactcgtacagttttgggttttgagctgacaattacacctgattttcagtgggatgataaggtacatggatatgtggagcccttttgggttattgttgaggataatgatggcgagtacattcttcaccatgaatatttcatgcttaagaaacagtatgttgatgaagatcatacattgaacttcacagtgccgatatatgagccactgcctcctcagtatttcattcgtgttgtgtctgacaagtggcttggttctcagacaattctccctgtctgctttaggcacttaattctaccagaaaaatatgctccaccaactgaattgcttgatctgcagcctctgcctgttagtgcattgagaaatgcaagatatgagggcctctatagtgcttttaagcatttcaatcccatccaaactcaagtattcactgtcttgtataacagtgatgacagcgtgttggttgctgcaccaactggcagtgggaagacgatatgtgcggagtttgctatactaaggaaccaccagagggcagtgtctggtgagagcaacatgcgggttgtttatatagctcccatcgaagctcttgcaaaagaaagatacagggactgggagcggaaatttggagagtttgccaaggtagtcgagctcactggtgaaacagcagctgatttgaagcttctggataaaggtgagatcataatcagtactcctgaaaagtgggatgcactgtctcgccggtggaaacagcgaaagcacatccaacaggtcagcttattcatagttgatgaacttcatctacttggatctgataagggacatgttttggaagtcattgtatctaggatgaggcgcatttccagtcacattggcagtaacatacggatcgtagcactttcagcatcacttgctaatgctaaagatctcggtgaatggattggtgccacttctcatggccttttcaacttccctccagcagtgagacctgtgccattggaaattcatatccagggtgtggatatagcaaactttgaggcaaggatgcaagcaatgacaaagcctacctacactgccatcacacagcatgcaaggaacagtaaacctgccctggtgtatgtaccaacaaggaagcatgcaaggttgactgcactggacttgtgtgcgtactctagtgttgagggtgctggaacaccatttcttcttgggtcagaagatgagatggatactttcaccagaggtgtcgaagaagagacgcttaagaatacacttaaatgtggtgtaggctatttgcatgagggtctaagtgagcttgatcaggaacttgtaacccagttgttccttggtgggaggatccaagtgtgtgttgcaagcagcacaatgtgttggggaagaccattgcctgctcatttggttgttgtcatggggactcagtattatgatggccgggagaatgctcacaccgattatccaattacagatctgcttcaaatgatgggtcacgccagcagaccacttcaagataactcagggaaatgtgttatattgtgtcatgcacctcgcaaagagtactacaagaagttcctttttgaggccttccctgtcgagagcaatcttcaccatttcttgcatgatcacatgaatgctgaggtggtggttggtgttgtagaaaataagcaagatgctgtggattatcttacttggactttcatgtatcggcggttgacaaagaatcctaacttctacaatcttcagggtgtaagtcacaggcatctgtcagatcatctttctgagctagttgagactgtcctgaatgatcttgaatcaagcaagtgtgtggctatagaggaggacatgtacctgaagcccctcaaccttggccttattgcttcatactactatattagctacacaactattgagcgttttagttctatgctgacccagaagactaaggtgaaaggactcctagagattctagcatctgcttcagaatatgcagagcttccgggtcgtcctggtgaggaagaattcattgagaggcttgttcgccaccagaggttctctatcgagaaacccaagtatggcgatccacatgtgaaggccaatgctctactgcaagcccatttttcaaggcacacagtggtcgggaacctggcagctgatcagcgtgagattctcctttctgctcataggttgctccaggcaatggttgatgttatatccagcaatggttggcttagtcttgctcttagtgcaatggagctgagtcaaatggtgacacaaggcatgtgggatcgggattctgtgctgcttcaagttccacacttcacaaaggacttggctcggaggtgccaggaaaatgaagggaagcccattgagagtatctttgatcttgctgagatgggtgtcgatgagatgcgggatctcttacagctatcaaactctcagctgcaagacattattgaattctttaagcggttcccaaatgttgatatgacctatgaggtccgtgagggtgatgatataactgctggtgacaatgtaaccgtgcaggtaactctggagcgtgacatgactaatgtgtcatctgaggttggtccagttcatgcgccaaggtttcccaagcctaaggaagaaggctggtggctggttattggcgacagctccacaaaccagttactggcaatcaaaagagtggcactccagaagagggcgagagtgaaacttgagttctctgctcctgcagaggctgggagaaaggattacatgatttacttaatgtcagactcttacttgggctgcgatcaggagtatgagttcaccgttgatgtcaaggatgctggaggggattgatgatgaaggctgtgacacccccgggaaa

SEQ ID NO: 387 - DNA, 931 bp, Sorghum bicolor
gacgctcttcctcctcctcctcctcctcctcatctcgccgccccgcaagcaatggcggtggcgcggctgcgcgcggcggccgccgcccggctgccgccggcgctctcccgcggagagaggcggccgctcgggacggcggcggaggtggccacgaccgcggggccaggggccgcgaggtgggagctcatgggggcgcgggagtactacgactaccggcgggccatctacggcgacatcacgcataaggccatcctcgtcgacgccgccggcacgctgctcgcccccaccgaacccatggcccaggtgtacagaacgataggccagaagtatggagtggattattcagaggatgagattctgatgcggtatcgccgggcttatgcgcagccatggggtagatcacgtctgaggtatgttaatgatggaaggcccttttggcaatacatagtgagttcatccactggctgttcagatctacagtattttgaggaactgtatcagtactatacaactgaaaaggcttggcatctctgcgatccagatgctggacgtgtttttgaggcattgaggagggctggtgtcaaaacagctgtcgtgtccaactttgacactcgtcttcggccacttctacaagcactgaaatgtgacggctggtttgatgcagttgctatatctgctgaggttgccgcagaaaagccaaaccctacaatattcttgaaggcttgtgagctgttgggagtgaaacctgaagaagctgtgcatattggtgatgaccgtaggaacgacgtatggggagcaagggatgcaggctgcgatgcctggctttggggcagtgatgtgtactccttcaaggaggttgcagagaggatcggggttgaggtgtagtaagtgttctcctgagccgtaataggagtcatccgagcttgtacat

SEQ ID NO: 388 - DNA, 1377 bp, Sorghum bicolor
aaaggccacctaccttaaccagggtgctccgcctccactcccgagctcgtcactccggcaaccgagcagaagcaggccggtggttccggtgacctcccgatggcgtctctcgctgccgtcaagaaggtgctggtgctggtgccgatcacggcgggctcggagcccgtggaggcgttcgtccccatcgccgtcctccgccgcgcgggcgccgacgtcaccgtcgcggccgcgggtgccggagccggcctgcgcgtccacgccatgtacggggtcaccgtcgtcgcggacgccaacgtcgccgactgcgccgacgcctcctacgacctcgtcgccctccccggaggcgtccccggcgcggacaacctcggcggctgcgcggcgctggagagcatcgtgaggcgccaggcgctcgggggcggcctgtacgccgccatctgcgccgcgccgccgctggcgctggcgcgctggggcctgctcgacggcgtcaaggcaactgcgcatccggcgttcgtggacaagttcccggcggaggtggccgccgtggacgcgaacgtggtggtcgacggcagggtagtgacggggcgtggcccggcgccggccatggagttcgcgctcgctctcgtggaacagctctacggcaaggacaaggttgacgagattgccaaaccaatgatggtcagatatgaacccgggtacgccttcaaggaactgaacccggtccagtggcagtgcagcggcacgcccaaggtcctgatcccggtggccaacgggagcgacgagatggaggtgctcgtgaccgtcgacgtgctgcgccgggccaatgcggacgtcgtggtggcgtcggccgagggcggcgacgccgaggtcgtcgtcgtcgcgcgccacggcacgaggatcgtcgccgacgcgctgctggtcgacgccgtcgccgccggccagcagttcgacttcgtcgtcgtgccgggcggcatggccggcgccaagacgctggccggcacggaggcgctcgtggcgctgctgaaggagcatgcggcggcgggcagggcgtacggcgccatcggcgccgccacggcggaggtgctggagccgcacggcctcctcgagctcgagggcaagaaggcgacgacgacgtgcgcgtccatggcggactcccgcgagtgcgggagcagggtggtggtggacgggaacctggccacgagcagcggccccgggacggccatggagttcgcgctggccgtcgtggagaagctgctcggcgccgaggcggcaagggaggtggcggaagccctgctgttcgtctgacgacggaccacgggcggagatgagctgtgcctgtgctatttgatcctttgcagtagagatcatggaacgtggtag

SEQ ID NO: 389 - DNA, 456 bp, Sorghum bicolor
actcctaatcagcgcttaatcagcagcagcagcagccagcagggaaggatgcaggcggtgggcatccggcgtggtctgaccatcgacccggcgggggaggaggagcccgcggcggcgcgcgtggggcggctggtccaggagagccccgtggtgatcttcgcccgccccggctgctgcatggcgcacgtgatgaagcgactgctgcaggcggtgggcgcgcacgccaccgtcatcgagctggacgccggcgccgccgaggaggaggagctcgcggcgggggccgagggcgcaggcgtcccggcgctcttcgtcggcggcgaccccgtcggcgggctcgagggcctcatggcgctccacctcagcggacgcctcgagcccaggctcagggagctcggcgcgctctgcgcctagctgtccgcttgcttctccgccgtcgatccatgtgtccggtcataa

SEQ ID NO: 390 - DNA, 1474 bp, Sorghum bicolor
agacagatagcagaacacacgcgccgtgcacgcttgcgcaaacccaaggattgccgctctgttcttggtctcctcctcgggtgaccgcaggggcaatggcgattaacggggaggaggcgccgcctctgctactggacgaggccgcgcgcccgcgccgcgtcgcgctcttcgtcgagccgtctccgttcgcttacatctctgggtataagaaccggttccagaacttcattaaacatttgcgagaaatgggggacgaggtcattgttgtgaccaaccatgaaggagttccccaagagtttcatggtgccaaggttattggttcatggagcttcccatgccccatgtatggaaaagtacctctttcgctggcactcagtcctaggatcatttcagaggttgcaaagttcaaacctgacattattcatgcatcttctcctggaattatggtttttggtgctctagctattgccaagctactcggtgtccccctagtcatgtcctatcacacccatgttccagtatacataccaagatatacatttagctggcttgtagagccaatgtggcaagtcataagattccttcatagagctgctgatttaactttagttccatctgttgctatcagcaaagattttgaaactgcccaggtcatatcagctaacagaatacgcctttggaacaaaggtgttgattctgcaagcttccatcctagatttcgcaatcatgagatgcgagtcaggctaagtgacggcgagcctgaaaaaccactagtaattcatgtcggacgttttgggcgtgagaaaaatctggattttttgaagatggtaatggataggttgcctggtgtaagaattgcatttatcggagatggaccatacaggtgtgaactagagaagatgtttgaaggaatgccagcagtgttcacaggaatgatgcagggtgaggagctctcgcaggcatacgccagtggtgacgttttcatcatgccatcagagtcagaaacgcttggccaagtggtcctagagtccatgtcatcaggagtgcccgttgtcgcggcccgtgccggtgggatccctgacataatcccagaggaccaggagggcaagacgagcttcctgttcacccctggcgacctggacgactgcctcagcaaggtccagcagctgctgacgaacagggagttcagagacaacatggggcggactgccagatccgagatggagaagtgcgactggcaggcagcatcgaagacgatccgcaacgagttctacaacgccgcgatctggtactggcgaaagaagcgtgcggagctggtgaagccgctgcagtggctagcacagatgttcctgccggcgcctgaggtccgcagcatcaagcagtgctgaggcctctctccacttgtgggacgatggtgttgcttgcagccatgatccagacaagtgatggatggatggaaagcaagacatgcata

SEQ ID NO: 391 - DNA, 988 bp, Sorghum bicolor
gggccaagacagatggtgcttctgcgcgtctgccaccgcttcggccgccccccgcgcttcccctccttcctctccatggcggcgccccagcaacctgctcccctctccgggtcggcgcccaagaggttcagggcgatggccacagacgtcgcggcggcggcggtggatcctccagccgccaggggctgccccgctatgaaggcggagttcgccaagcacgccgagtacctcaacgccctgaatgacaagagagaaaggcttgtgaaagctagtcgggatgtgacaatgaacagcaaaaaggtcatctttcaggtccacagaatcacgaaagttaacagggacgaagttctctccaaggcagaaaatgatcttgctgcagtggttaatcaatacattgcaaaactagtaaaagaattacaaggaactgacttctggaagctcagaagagcctacacctttggtgtacaagaatatgtcgaagctgcaacactgtgtagattttgcaagactggcactctattaagtcttgctgaaattaatgattctttactagcactaagtgataaatctgttgagcccttacagttaaatgtgcttgactatcttttaggggttgctgatttgtcaggagagcttatgaggctcgcaataggccgtatatctgatggggaagttgaatatgcaaaaactatctgtgcttttgtacgtgatatttacagggagctgactcttgtggtacctctaatggatgacaataatgagatgaagaagaaaatggaggtcatgctgcaaagtgtagtaaaaattgagaatgcttgcttcagtgttcatgtgagaggttcagagtacattcctctgctaggatcatcaggagacccagattattcctttttcggtgcctcagactttgaccaatgaatgttttgaagcaagaagaactaattgagtgttaaaggagcttagatcgatttaaggagagtggttgcgt

SEQ ID NO: 392 - DNA, 791 bp, Sorghum bicolor
agacgatggcgaacctgttcctgaagcaggcgaagcagtacgtggcgacgcggccggtgtacccgccggagctcttcgacttcatcgcctccaagacccctcgccgcgacatggcctgggacgtcggcaccggcaacggccaggccgcagcatcgctagcgacgctgtacgaggccgtggtgggcacggacacgagcgcgcagcagctcgcctacgcgacgcgcctccccaacgtccgctacgtccacaccccgccggacctgccgctggaggggatccacgccaccgtcgccgcgccggcgtccgtggacctcatcaccgtcgcgcaggccttccactggctcgacctcccgcgcttctacgcgcaggcgcgctccgtgctgcgccacggccacggcgtgctcgccgcctggtgctacaccgagccacgcatcgacgccgccgtcgacgccgtgttctggcgcctgtaccacgggtcggagaactactgggcgcccaaccgccggatggtcgacgacgagtaccggagcgccgacttcccgttcgaccccgtcgagggggagacgcacacggggccgttccagttctccacgcaccggcggatggacctggatgactacctcatgtacatcacctcatggtccgcgtaccagacggccaaggataacggcgtcgagctgctcgacgaggacaccgtgcaggagttcgccgcagcatggggcggcgacggcaaggaggtgaagaccgtcacgtaccccatcttcctcaggattggcaaggtaaggtgatga

SEQ ID NO: 393 - DNA, 2755 bp, Sorghum bicolor
ctcactccctgtctgccatcccgagcgattctccgtgcgaccaagccatggcctctaacggcggcggcagctccccaccctccatatcgtcgccggatggtcgaccgtcgagcccactcccggtcaccaactcgtccccatcgcagcccacccgccgctccggtgggcggcgccgccgcggttccgccagcccttatgcttcgtccccttccctcgggggattcgagacgccgccgcaccccggccgccgcacgccgtccggtgccggggctggcgccgccaggcagcagcgtcagaactggactggccggttcccgccgacgccctccaccccaatgtccaccgatgacatcccgccgtcctccgaagccggggacgacgagaccgacggtggtggcggcggcggcgtcgacgccaccccggtcttcgtttggggcaccaacatcagcgtgcaggacgtcaacgccgccatcctccggttcctgcgccacttccgcgacccgcgtgacgccggccgcgtcgacccggtcatggatgagggcaagtacatgcgcgccatccaccgcatcctcgagctcgagggcggagagtcgctcgacgtcgatgcgcacgacgtgtttgaccacgacccagacctctacagcaagatggttcgctatccgctcgaggtgctcgccatcttcgacatcgtgctcatggacctcgtcgcacgcatcgagccgctcttcgagaagcacatccagaccaggatctacaacctcaagtcgtccatttgcttgaggaatctcaacccatctgatattgagaagatggtatctatcaagggtatgataattagatgcagctcggtcataccggagctcaaggaggctgttttccgctgccttgtttgtggtttctactcagaacctgtcatggttgatagagggagagtaactgagccacacgtttgtcagaaagaacaatgcaaagccacaaattctatgactctagtgcacaaccgatgcagattttcagacaaacagatcataaagttgcaggaaacaccagatgagataccagaaggtggcactccacatacagttagtgtcttgatgcatgataagctcgttgatgctggaaagcctggagacagggttgagataactggaatatacagggctatgagtattagagttggaccaactcaaaggacagtgaagtctatattcaagacatatattgattgccttcacataaagaagacagacaagtctaggcttcatgtggaggacaccatggatattgataattcgaatgctagcaaatctactgaagaggattttcttagtgataaggttgagaaactaaaagagctttcaaagttgcctgatatctatgacagattgactagatcattagctccaaacatatgggagttggatgatgttaaaagaggtctcctttgccagcttttcggcggcaatcctttgaagcttccttctggggctagcttccggggtgacataaatattttacttgtgggtgatcctgggacgagtaaatcccagcttctccagtacatgcataaactgtctcctcgtggtatctatacaagtggtagaggaagttctgctgttggtcttactgcttatgttaccaaagatcctgagactggcgaaactgttctagaaagtggagcacttgttttgagtgacaaaggtgtttgttgcatagatgagtttgataagatgtctgataatgcccgaagcatgttacacgaggtgatggaacagcagacagtatccattgcgaaggctggaataattgcatctttaaatgcgaggacatctgtcctcgcatgtgccaatcctaccgaatcacgttacaacccaagactttctgtaattgacaacatacacttagccccaacactactttcaagattcgacctgatttatcttatcttggacaaggcggatgaacaaactgataggcgcctggcaaagcatattgtttcgttgcattttgagaatccaaatttagaggagctcgaggtcttggacttgcagacattagtttcctacataagctatgcaaggaagtatattcagccacagttatctgatgaagctgcagaagagctaactcgtggctatgttgagatgaggaaaagagggaatagccctgggagcagaaagaaggtcataacagcaactgctagacaaatagagagtttgattcgtctcagtgaagcattagcccgaatgcggttctctgaagtggttgaggtgcgagatgttgtggaggccttcaggcttcttgaagttgccatgcagcagtctgcaacggatcatgcaactgggacgattgatatggatctaatcatgacggggatatctgcaagtgaaaggcagagacgggagaaccttgtttctgcaacccgtaaccttatcgtggagaaaatgcagcttggaggcccctcaatgcgtatgattgagttgctggaagaacttaggaagcagagctcaatggaaattcatctgcacgaactccgcggtgctcttggcaccctgatgactgaaggtgcagtggttatccatggagacaacgtgaagagagtttgatgtttaactgccatgagcggtgatgcttctataagctcaatctgccacttccttgaacagacaaggttgtgaagatttgatcaattgtagcacttagccctaacttatgtggtctgttgtctaaactggtccagatttgtgtaactccc

SEQ ID NO: 394 - DNA, 1117 bp, Sorghum bicolor
aacaagctcgacgacacaaagcagctagcatcgtagccgcccagccgcgctaaaaaccagccagctaaacccatggccgggatcgtggtggtgttcgacttcgacaagacgatcatcgacgtggacagcgacaactgggtggtcgacaacctgggcttcaccgagctgttcgagcgcctcctccccaccatgccctggaacacgctcatggacaccatgatgggtgagctccacgcggccggcaagaccctgggcgacgtcgccgaggtgctgagggcggcgcccatcgacccgcgcgtgcccgccgccatcaaggccgcgtacgcgctgggctgcgacctgcgcgtgctcagcgacgccaacgccttcttcatcgagaccgtcctggagcaccacggcatccgtggctgcttctcccagatcaacaccaaccccagccacgtcgacgccgacggccgcctccgcatcgggccctaccacgccgccccgcacggctgcggcgtcggcacctgcccgcccaacatgtgcaagggcctggtgctcgaccgcatcctccgcgaggcggccgccgggacgaccgggaggtcgacgaagcgcgtcatctacctcggcgacggccgcggcgactactgcccgtcgctgcggctggcccgggaggacttcatgatgccgcgcaggggttaccccgtgtgggacctcatccgcgaggaccccgcgcgggtgcaggcggaggtgcacccgtgggccgacggcgccgacctggaggagacgctgctgcgcctcgtcgggagggcgctcgtggaggaggccgcgctgccgccgccgctcgactgcaagctcgagtccaccatgcccgttgccgcgcaggacggcggcatgcccatcatgccgctcggcgtcaagaactgatgccgtcttgtctctggttgagaatctgatattattgccggttcgggttcgttgtgagagctcgagcaagtgcgggcgaggcacggcgtacgatacgatggattaatagtagcgtttgttaactgtattattgactaattttgtgtgcgtgtggtgtattccctccggatcgagcctgtcactgctgaattggctatggctcgttgta

SEQ ID NO: 395 - DNA, 438 bp, Sorghum bicolor
gcaaccaaggcaaaccagcacgatgcgtcgcgagggccggcagcacgggtgggtgttcaccgtcgaccccagcctggtcgacgcggagggcaagcagtgccgttcccgcgcggtgcaggtcgacggcgcggcggcggccaacggcgggttcgtcagggcgccgcggaagcccaccaaccacaccaagcccgccgtcggccgcgcctacaaggcgctgatcggcaagggagaggctgggtccggcaggggcaggcacaagttcaagcacgacgaggccaagatgtaccacctctacctcgagggcgccgacgacgcctacgcggatgcgatgctggagttcgactggtagtcctactgacatgggtgtgtgaatgcggtgctggatcggagttcgacgggcctcattgccaggaagtgcagagatcgatgttaggcttc

SEQ ID NO: 396 - DNA, 1614 bp, Sorghum bicolor
cggagagggccaatagaataaagaaagcgaagccaatgcaggtcgccgtcaacaccagcactgtcggcgctcaccagcacccaacaaagtcctccttcctccggccatcccctccttgccgcgtctacttccacgcttctccacgtccgaagaacctgagggcgattgccatggccaccaagtcgcagcttcaggagcaactggtcatcactcggcccgacgattggcatctccatcttcgtgaaggcggtgtcctcgaggctgtagtgccacacagcgcgaggcattttgggagggccatcatcatgcccaacttgaagcccccggtgaccacaacggcgcgggcggtggaatacagggaggagataatgagggcgctgccgccagggagtagcttcgagccgctcatgacactgtacctgacagacaacacaagtccagaggagatcaagctcgcaagaaagagtggtataatctttgctgtgaagctatatcctgctggagcaactaccaattcccaagatggcgtcactgatatatttgggaagtgcttgccagtcctcgaggagatggtcaggcaggaaatgccattgcttgttcatggagaagtcacagatccacatgttgacacctttgaccgtgagaaggttttcattgacaaaatattggcaccacttgtacaaaaacttccacagctgaaaattgtcatggaacatatcacaaccatggatgcagtgaacttcatagaatcatgtgaagaaggtcatgttgctgcaacagtgactccccagcatctcctcctcaataggaatgctttatttcagggtggcttgcagccacacaattattgtttgcccgtactgaaaagagagactcataggcaagctattgtatctgctgtaacaaatgggagtagacggtactttcttggtactgacagcgctccccatgataaacagaacaaagaatgttcctgtggatgtgcaggaatatatagtgctcctgttgccttgtctctttatgcgaaggtatttgaagaggctggtgccctagataagctagaaacatttacaagcttcaatggccccgatttttatggcctcccaaggaacacttcaaagattgtcttgagaaagaatgcctggaaagttcctggaacttataaacacagttcaggggagattgtgcctatgtttagtggcagcacccttgagtggcttccatctgatcagcctaaagagtaaacagtatgcattattttacccagcagttgggggaatcaataggtggagtttttctagttctttttcctttttctgttagaatcagcatagcaaactattcagccataagcagcaattcctgaaggcaattgaaagcaactgcgaaagatttgcttgtcgagttgttattggattgcagtacaattctggaagtagttaaaaggtcacattgtatggttatcaagggtagtctactgctctagacaccatagcatccatggtttcaaaggcgacgaggcgtccacgtgagagctgggtgtgcctggacacctaggtgacaaggtgccactgttccccaaggcgagctgggtatgcctggtgcctaagtgac

SEQ ID NO: 397 - DNA, 813 bp, Sorghum bicolor
agaaggaagctcatcaatctcgccgctggcctcctcacctctgcttttgcgtcgctgcgttatcgtctctgcatccgagtgtcgctatcttcctggtgcctggtgctgcctgtgttcacgagctggaacttgtccgagcttcagccaagtcaagctcgagcctgtctagccaagcagaacggcacggtggtgctggtcgacgcctcctctgaggaacacgtgccggtcgacgcttcctcttggcggacggtctcgagtttggtcgggaggatgggtggcgggagctgctgcgtctgcaaggaggcgccgcccaagtacaagtgcccctcctgccgcacgccctattgctctgtcacatgctttaaaaagcacaaagaggaatcttgccaaaagacatcgcctcaggaagaaattagcaagtcaccactgcaggaggaagttacagcactgaacaccacatgcattgcagaatctccaaatacagtgggccctacaaaagctcttgaagttgaggacccaagctgggttgttgacaacaatagactaaggtctttagcggaactgaaagggatccaagatgctctcagggatcctgaactgcagaaaatgatacttaaaattgatgggtctttggaaccagaaaaagaattggagaaattgatggaaggtcaagcttttggccagttcgctgataagattcttgacattgtcagcccacaagaataatcgcctgccctgcctgtttggtgggattgatgctggagtaaatagaagcatccaggcaaacaagcgaaagtggacgagctgatctct

SEQ ID NO: 398 - DNA, 1987 bp, Sorghum bicolor
tggtagcaaggagaaatgttaaggagatgggtaagaagggaaattggttcactgcactcaagaaggccttcacctcaagccccaaggagaagccaccaaatgtgcatcagctggtagcgcagtacccgtcttcgcacgggcacggcagggacaagaagcgatggggaggcttcgggcggacgcggtcgcacgcggagccggcgtcgccggcggcgggcgcgctgatcaacatcccgctgtaccgcgagccgagcagcatcgagaagatcctcggcgacgcggagatggaccagcagcgccagtactacgccgccaccagggcgcagtaccagatcacgccggcgaggcccaccaccgccgtcgccgctagtgctgccgcgccgctgccacagccggtggtgggaacagcacgtgagcgtgagcgtgagcgcgagcgcagcagagaggacaagccggccgccgtggtgctcccgctgccgccgccgtcccctccaccgctgatcaggaggttcgaccatgacagggagcagcagcagaagctccagcagctgcagctgcagccgcagagcagggccgagacggagtggcggcggcagccgcagccgcagccgcagccgaggcggcaccgcgcggcgaggcagcgcgccgcaccgccggaccgcgcgcgcgccgcggccgtggcgatccagtccgcgttccggggctacatggcgcggcggaactaccggtcgctgcgcgggctgatccggctgcagggcgtgatgcggggcgccagcgtgcggcggcagacggcgcaggcgatgcggtgcatgcagacgctggtccgcgtgcaggcgcaggtgcgcgccagccgcgtcgaggccatggagcggcgcaaccggcagcaccacggcgccatgctcagggacggcggcaggtggcgcgccggctcacaggacggcggcatttgggacgacagccggctgacgcgggaggaggcggacgcgcggacgaagcggaaggtggaagccgtgatcaagagggagagagccctcgcctacgcctactcccatcagctgctgaaggcgacaccgatggcggcccacgcgatcctagcggacctgcagtcggggcggagcccctggtggtggacgcccatcgagcgccaccacgagccggggagctaccgcccagtggagcccgccatcagcaagccccggccggcgctcgcgatcgcccaccgcgagacgacgccaatggcgatgacggcggcgacgacgccggcccggtcggtggtctcggcctactccaaaacaaggaccacgaggcccgtgaccaaggtgggagcccccccggcgccgtcgttgagctacgtggggagcatccgcgacgacgagagcctgacgagctgcccggcgttcggcggcgtgcccaactacatgacgcccacgctgtcggcgtccgccaaggcgcgggcgcgggcgcacctgcagcagcagcagaaggcggcccaggagaagcccaggttctcgttcgggctggggcagagcatcgggagttgggccaagagcccgttctggaaggccggcggcggcggcgggctgccgtcgtcgagggtggccacgccggcggcgtcggtggccggcgggcggcaccggtcgacgcggtcgatcagcgggctcagcgtggactccaccgtgtccatgccggccgggatcggcaggaggccgttcaagtagatatatatatacacgtgtcggactcacggttgcttgcattgcatcattcttcttgttcttccatctcctttcgacgcatttgtgcttggaatttgtacgtacgtgattgggtggtgtggcttgttgtgggttaccattgcgtttgctgattcgctgctctttgctagctccctgtttgctggcctcctttgtccccagccttattttggtttttgaggggccagtgagctgtagcgtgtaaactcggcgactccatcgaacaaacctac

SEQ ID NO: 399 - DNA, 1774 bp, Sorghum bicolor
ttcccacgtaacgttaatctccggccgcgatacgataaataccctcccgggaattatctcttctccggcgagacggcagcgagctgagctgagctgagcacgacgaagcccggaccccctcactcaccacgcccggccatggaggactggctcttctactccctcaccacgctcctctgcctcctctgttcactcctgctgcgtgcgcgcaccccaggcagcaaggaccgccatgccgactcctcctccgcgctccctcccctgcccccgggcccgacgccgctgccggtgctgggcccgctgctcttcctcgcgcgccgcgacttcgacatcgagcccgtcctccgccgcatcgcgcgggagcacggcaaggtcttcaccttcgcgccgctgggtccggcgcgcccgggcatcttcgtcgccgaccgcgccgccgcgcaccgcgcgctcgtgcagcgcggcgccgtgttcgcctcccgcccgccctccacggcctccagcgccgtgctcaccagcggcggacgcaacgtcagctcctccccctacggcgccacgtggcgcgcgctgcgacggaacctcgcctccggggtgctcaacccgtcgcggctccgggccttctcccccgcgcgccgatgggtgctcgacgtcctcgcctcccgcgtccgcgccgacggccgccacggggagacccccgtcgccgtcatggagccgttccagtacgccatgttctgcctcctcgtctacatgtgcttcggcggcgaccgcctcggtgacgacgcgcgcgtccgggacatcgaggccacgcagcgggagctcctcgcaaacttcctcagcttccaggtcttctccttcctcccgtcggtcaccaagctcgtgttccggcgacgctgggagaagctcgtgtcgctgcgacgtcggcaggaggagctcttcttcccgctgatacgagccaggagggaggccggcgccgacggggactgctacgtcgactccatggtgaagctgaccatccccgaggacggcgggaggccgctgacggacggcgagatcgtgagcctctgctccgagttcctcagcgccggcaccgacaccacggccaccgcgctgcagtggatcctggcgaacctggtcaagaacccggcgatgcaggacaggcttcgggacgaggtgtccagcgtcgtcgttggcgccgacggcgaggtgcgggaggaggacctgcaggcgatgccgtacctcaaggccgtggttctggaggcgctccggcgccacccgccgggccacttcgtgctcccgcacgccgtgcacgaggacacgacgctagatgggtaccgcgtgcccgccggcgcgcccgtgaacttcgcggtgggggacatcgggatggacgaggaggtgtggaaggcccccgcggagttccggccggagcggttcctgcccggcggcgagggggaggacgtggacctcaccggcagcaaggagatcaagatgatgccgttcggcgccgggcgccgggtctgcccggggatggcgctggcgatgctgcacctcgagtacttcgtggccaacctcgtgagggagttcgagtggcgcgaggccgacggcgaggaggtggacctcaccgagaagcttgagttcaccgtcgtcatgaagcggccgctcagggccagggccgtgccgctgcggtcaccgccgcccgccgtcgcagctgcttgatgcagggttgctagtacgtactgtacgtagcatcatggcaacgaattggcagttgagtctgctt

SEQ ID NO: 400 - DNA, 820 bp, Sorghum bicolor
gccttcccttgtcgaagtccacccggcggcagagcagagcctcgttgctgaggagggggagatggcgggcatgggagatatgccgatgaggccggcgcggccgggcccgccgatgcagcaccgcgggccgccgccgatggcgcgcctccgccccgaaccaatcgaccgcgagaagacctgtcctctgctgctcagggttttcacaagggttgctggtcaccatcaaaatgaagagtttgctgtgagagggaaggaaccaaaggatgaagttcagatttacacatggaaggatgccactctccgcgagctcactgatcttgtgaaagaggttgctcttccagcaaggaaaaggaatgcgaggctttcttttgcatttgtatacccagacaagaatggtcgttttgttgtcagacaggtgggttcgaccttcgcatatggtcatggaagaggtgatgatgccaaaactcttgcagagctcgggttccagattggtgattacttgagcgttgcaatcatgtagacggtgcccacaatgaattcagcgactgtaccagatgtaactgctgtgatgtcaaaaggctttagttgcaacaatcaagggttgaatttctgttagcactaggaagtggaaccaaaattgtctgtaatactggtagtatcaaattaattacctagacacttcgaacgagcaactgagcaaggcttctggtatggttgcttttgcttgtataatatggcacttatctgtgcctctgtggtgcctgaagtttccaaatctggacaacgtgcgttttcaatggagaatgttaagttgggctga

SEQ ID NO: 401 - DNA, 1490 bp, Sorghum bicolor
aggcatatgttgtgatttgtcgatggcgaggagatgaagcaagtgtgggggcggagcagcaaggacatgacagccatgccccctctgcgccaccgaggcgctgctaagaagcccatgtggatcatagttctattgtcattggtttgtgttgcccttatgggggcctatgtatacccaccacggcgctactccgcatgctacttctttgcttcgagtgtctgtactccgttcaaggattggctacctgctgttgctcgggagcgaaccgatgaagagatagtttcatccgtggttattagggatcttctttcgatgcctatggctgtgtcaaagaacccaaagattgcctttatgttcctgacaccaggtacattgccttttgagaagttgtgggagaaatttttacagggtcatgatgggcgatattccatctatatccatgcatctcgtgaaaaacctgtacattctagctctctgtttgttgggcgtgaaattcacagtgaaaaggtagtatgggggaggatttcgatggttgatgcagagaagaggctgttagcaaatgcattggaagatgttgataatcaaattttcgtcttgctttctgacagctgtgttccactacatacatttgattacatatataattatctgatgggaaccaatgtcagcttcattgattgcttcctcgatcctggcccacatggaactggaaggtattcgatggaaatgcttcctgaaatagaacagagggacttcaggaagggtgcccagtggtttgctataacacgaaggcatgctttattgattctggcagacaacctttactacaataagttcaagctgtactgcaagccagcagagggacacaactgtattgctgatgagcattatttgccaaccctcttcaatatggtcgatcctggtggaatagctaactggtcggtgactcatgttgattggtctgagggaaaatggcatccaaggtcatatagagctgcagatgttaactatcaactcttaaagaacataacgtctgtcaatgagaatttccacattacaagtgatgataagaaagttatgacacggactccatgtatgtggaatggaacaaaaagaccatgctacctttttgctagaaagttttacccagaatctctgaacaacctgctgaagctattctccagttacacataggcttgagttctacatgatttttttccccatttggcctaggtgattcccctaggatttcttttttctgctttatgtaaattgtgaaattgatacttagaggcttaacacacagttacagatccagggccagtgatgtaattctgagtcccttggtagggctgaggtgctgtttgtttagtatttacgctgccctcactgtcattcgtggtgccctctgtatgactgtatgcttctgttagcccttcacttctctctctctgctctctcattcttagattcctagctcccatttcctg

SEQ ID NO: 402 - DNA, 365 bp, Sorghum bicolor
ataaaccacgcacactcctctcccagtcccccccttctccacgccccctgctcgactgctcccgtgatctgatctgatctgatcggcgatcaactcggcatggcggactggggccccgtggtggtgggcgtggtgctcttcgtgctgctgtcgcctggcctgctctgcgagctcccgggcacgcaccgccacgtcgacttcggcggcttccacaccaacggcaaggccatcttcgtgcacaccctcatcttcttcgccgccttcaccatcctcacgctcgcgctccacgtccacatctacaccggctagtactagtctatatgtatgtgtggtggtcgatctgggacttgcagaggtcagatcag

SEQ ID NO: 403 - DNA, 1504 bp, Sorghum bicolor
acttccagggagggaaaccacacaaccggacccgaccccccgacgcccccgaggcgagggcgagggcgagcggtgagccggccggggcggggaccaagggggatcccctcggcggcggcggccatgggtgcgccctccccggcgatgtgggccgggctggtgctggtggcgttattggccgcatcggggccggcggcgacagcggcggcggggctgccgaggttcgccgaggcgcccgagtacaggaacggggaggggtgcccggccccggtggcgggcgcgggggtctgcgacccgggcctggtgcacatcgccatgacgctcgacgcgcactacctcaggggctccatggcggccatctactcgctgctcaagcacgcctcctgcccggagtcgctcttcttccacttcctcgccgcggagggcggcggcgcgccggccgtcgccgacctccgggccgccgtgtccgcctccttcccgtcccttcgcttcgagatctacccgttccgcgccgacgcggtcgccgggctcatctccgcgtccgtgcgcgccgcgctcgaggcgccgctcaactacgcgcggaaccacctcgccgacctgctcccgcgctgcgtcccgcgcgcgatatacctcgactccgacgtgctcgccgtcgacgacgtgcggaggctctgggagacgcgcctgcccgcagccgcggtcgtcgccgcgcccgagtactgccacgccaacttctcccgctacttcaccgaggccttctggaacgaccccgtcctcggcgccagagtctttgctggccgccgccgcgcgccctgctacttcaatacgggcgtcatggtcatcgacctccggagatggcgcgttggcaactaccgccagcgcatcgagcgctggatggagatgcagaaggagaaaagaatctacgagcttggctccttgccccccttcttgctcgtcttcgccggcgagattgaggctgtcgaccaccggtggaaccagcacggcttgggcggcgacaacgtcttcggcagctgccgccctctccataacgggcccgtcagcctgatgcactggtccgggaagggcaagccatgggaccgtctcgacgccggcaagccttgcccgctcgaccacacctggaggtcgtacgacctctacattggcgagaatgattcatcatcagcatcagggccgtcccggtcagccttgtcatcatcggcggcatggtagaagttcagatatacacacaataattctttgatttggggatgccgtggttcttggccggtaatggaattgccttgcaatgcattgccactgctgccacagctgctgctgctgctgcaagtcagctgccgccttcggctgtacaggggaggggcggtatacagattgcagcagcagcaaggggatgaagacagtgaatagggggggagcaaattcttgttcattttgcactatgattcggattgattcattaggctctggtttggaggttgtgact

SEQ ID NO: 404 - DNA, 675 bp, Sorghum bicolor
ttgctttgcctctcctagactctctagtcgtccggtccggccatggccaccatcctggagaacatccagaaggcgaggttcctgccgaccaggccgctcaaggacgagctgcccaccttccagggcggcggtggtggcaaggaggagagccacctcatgggcctgaggaagcggctgtcctccttctcgggcaagatccagcccatctcctccgcgtcggccgagtgggcgttccggcgctccaagtcggcgccctccctcggcgccgcgttcgccgcggggggcggctccctgaggcagtggtggcagtggggcgtcggctggctcctgtccaagaagcccgggttcgcgggcgacctcgagatgaacgaggaggaggtcgccgcgctgggccgccagagcaggggcagctggggccacatcctctacaagatgcgctccggtgtccggcggctcgtcatgtccacgcactcgctccctaccacgcacaagcagtcgtccctgccgtcgtcggcgtcggcggtgcacaacaacgtccagtgcaagccggcggcggcgttcgcctacgcgcagcggcagagcttccaccacaccggccacgccatggcgcactaaggagcgccgtcgcggttgcaggtgctgtttgcagccgatctcctccagattcagaagtag

SEQ ID NO: 405 - DNA, 1329 bp, Sorghum bicolor
cactcctacgctacctacctgccagtgtcactactactcctcactagcacgcttgcagaggttgcagctccagcgagcaacaaggatcgatcaggtccatccatggcggcccccaggaaggtcctcatgctctgcggcgactacatggaggacttcgaggccgccgtcccgctctacgccctctccgccctcggcatcaccgtcgactgcgccgcgcccggcaagcgccccggcgactcctgcctcaccgccgtccacgacttcctcggcttcgagctctacacggagctcacgggccaccgcttcacgataaccgccgacttcgcggcggcggcggcggacccgtctcgctacgacgcgctggtcatcccgggcgggcggttcacggagcagctgagcgcggacgcggccgtcgtggacctcgtcgcggcgttcgcggcgctgcggaggcctctggtgctcacctgccacagccagctcctgctcgccgcggccggcgggctcagcggcggcacgcgctgcacggcgttcttcagcttgcgccccgtcgtggagctggcggggggcgcgtgggtcgacccggatcccttcgagctctgcgtcgccgacggccacgtgctctccgccatcgggtggcccgcgcacgcccagatcctcgccaagctcctcgacgccttgggcgcccacgtcgtcgccgccgacgccgggcgcggtggccagcgcgtcctcatcctctgcgccgactacgtcgacgactacgaggcgaacgtgccgttccgggcgctggcgggcgtgggctgccgtgtcgaatccgcgtgcccgaccaagcgcaagggcgagaccgtcgtgacggcgatctacgacgccgccggcacgccggcggtcacggtgagcgaggagaggcggggccacaacttcgtggtgacggcggactgggcggacgccagcgccgacgacttcgactgcgtcgtcatccccggcggccgcgcgccggagctgctggtgacgcacgacagggcggtggcgctcgtgaaggagttcgcggacaagggcaaggtggtggccagcatcggccatggccacctgctcctcgcagcggcggggctgctcaggggcaggaagtgcgccagcggggtgcccatgcgggtcgtctcgaggctggcgggcgccgaggccgtggaggccgcggcggccgtcgttgatgggaggctcgtgacggcggcgagctggacggacctcgcgcagttcgtggctcgcgtcattgacctcctcggcatctccgtctccttctgaatgcctgttgtgtctctgctcttcaactctgggtag

SEQ ID NO: 406 - DNA, 673 bp, Sorghum bicolor
aaaggatccggcgctataccaaccatgagcgacctgttaacctacatttccaaggttatgtgcatcaaggcaagatcggaggcaacacaggccggcgatgacggcggttgcccagcggatgagtgccgcgtctgtctgtcaaagattcggctcgccgaggctacccggcgtctgccatgtcggcatgttttccaccgggactgcgtcgaccgatggctcttgtcctgcaagcggacctgtccgctctgccgagtttatgtgaccgatgggaacaagcagccggtggcggcgaagcacaccagccgtgaagcacaggcactcgccgacgacctggtgatctggttctccaccgtgctcgtccccggtttctgatgccaaatcccctcttttgttcgctcgatcgaatgcttggtgtgtattcttttatatatttcaacacatgtacgtacctatgttatacttatcgatctttagaacagtttttagaaaatgtgtgtattgtagcatcttgttggatgaattttattcgaacttttgcacttggagctgattactgcaaataagaagtccgagaaaatgttgtcggcatttattgtactatatatggtgttgtttgtgtgtacaaatgttagcataaatgtagtttgttgcacgagtgttcactggtaccttt

SEQ ID NO: 407 - DNA, 1001 bp, Sorghum bicolor
gcaccatggcgggatccgcgttcctcaacgccctcgtcctccgcgcgccatccccatccccgtcgctctcgtgctcgtcctcgtctacgcgccgcagcgccggcgccttcgcgttcccgaacccaccgcgcctcccatctctgcgttctgcgcgccgcgtcgtccttgcgcgggcggcggcggcgccgccgggcgcgggcggtgaccccgagcccgaggacgacgagtgggggccggagcccgagggcgggtccgctgtcacgggagcgaccgcggtggcggaggcgcctgaggcgccggaggcgagagaggtcgcggagctcaaggcgcagctgaaggacgcgctgtacggcacggagcggggcctgcgggcgtccagcgagtcgcgggccaaggtgctggagctcatcacgcagctcgagacgcgcaaccccacgccggcgcctaccgaggcgcttacgctcctcaacggcaagtggatcctcgcgtacacatcattttcccaactgttcccactattggggtttggcaatctgcctgagctcgtgaaagtggaggaaatatcacagaccattgattctgagaacttcacagtgcaaaactgtataaagttttcaggacctttggctacaacctcagttgccaccaatgcaaaatttgaaatcagaagccccaagcgcgtgcagatcaaatttgaagaaggcattgttggtacaccacagttgaccgactccattgtgctaccagagaagtttgaattgtttggacagaacatcgacctgagtccactgaaaggcatatttacatctatcgaaaatgcagcatcctcggttgcaaagaccatatctgatcagcctccgctgaaaataccaatcaggacaaacaacgctgaatcatggttgcttacgacctaccttgacgaagagctcaggatctccagaggcgatggcagcagcatctttgtgctgttcaaggaaggaagtactcttctaaactgatga

SEQ ID NO: 408 - DNA, 570 bp, Sorghum bicolor
catccttcctccagactccagaggcaccccacacacacacacaccaatggctcccagcaagctcgccgtggtcatcgccttggtggcgtctctcctcctgctcaccaacatcaacaccaaggctgctccgggtccgggcggctacccgccggctcctccgctcggccctccgccgcaccagatcgtcgaccccgccaaagactgcgggggcgcgtgcgacgtgcggtgcggcgcgcagtcgcggaagaaccggtgcgcccgggcgtgcctcaagtgctgcagcgtctgccgctgcgtgccggcgggcacggccggcaaccagcagacgtgcggcaagtgctacaccgactggatcacgcacggcaacaggaccaagtgcccgtgagtgcggctgcggggtggcagcggcggtcagcgtgttccccggccgaaagcagcctcagttccatgggcgcaccactgccacgccacgtcttgtatgatccgaccccgtccgcgccgtagatgtactagctatctactccgtagtagtctacagtagctagctcctggttgatgatgctatgctgt

SEQ ID NO: 409 - DNA, 1230 bp, Sorghum bicolor
tatcctcttgctctgttcgtccggctcttcgccctcgccggcgcgcgggactactaatccaaattggcgacgaccctctgccgcccgccccactgcagattcggggagcgcaccgcccgctccaatggcgattagagtcccgtccatggagctccaccgctcctcgccgctgctctccggtggccgagggaggaatacatgcccacagaagaagcccttccttgtccaagcaaagagactaggggggttggagaaagcgagtacgaggttaggaacacaagagtctggacaaccaaagaaaagagcacccctggttcgtggaactgttagcccacctcttccagtaccaggaaacatacctcggcctccttatgttggcacaaaatatgtaccagagatagcaaaagaggtacaaatgcacgacaacgagagcattgtccatatgagagctgcttgcgagcttgccgcccgtgttcttgactatgcaggaacattagtgaaaccctctgtaacaacagacgaaattgataaagcagtgcacaagatgatcatcgatgctggagcctatccatccccacttggatatggtgggtttccaaaaagtgtatgcacctcagtaaatgagtgcatgtgccatggaattcctgattcacgcgagctacaggatggagacataattaacattgatgtcactgtctacttgaatggttatcatggggatacctcaaaaacatttctttgtggagatgtcgatgaagcaagtaaacaacttgtgaaggttactgaagagtgcctgctcagggccatatcaacatgcaaacatggtaccagcttcaagaagattggcagaagaataagtgagcatgctgaaaggaatgggtttggtgtcgtggagtgttttgttgggcatggagttggcagagtatttcactcagaaccaattatctatcaccagcggaacaacaggccgggtcagatgattgaagggcagacgttcacaatagagccgatcatatccatggggagcatcgactgcgacatgtgggacgacggctggactgccgtgacgacggacggcagcttggcggcgcagttcgaacacacgatactgatcaccaggaccggagctgagatcctcacgaaatgctaggagaagtgttgcttgtgcccgttagttgttgccacggcaatctgtatccgtgctgatgcctgacgtggtcgattgtctat

SEQ ID NO: 410 - DNA, 724 bp, Sorghum bicolor
atctcgtgtaggctctccactccgcactcccacgcctgataccattccgccgccgccgccgcctctgaacccacggtgcggcggagatccagccgggcctggatcggcctactccgacactgctttgtgaagataaacaagactgcttgctgtctgctgggaagtggactaagctcacggctgatatcatctgccttgagggaaccagtgggagaaaagggagtggacagggcccaatcagaagcatggacaaaactgccaatgtggtattggatattgaaggtctgcctcaaccacctgataaatgctgctccggaagtccaaaaatgattagggccttatcacgcaagggttcaaataggatggaaaggaggggcagtgatgagctggagcaagaggatttggcgaaaaaacttatcatcaaagttgtgccgtctcaactggagcagcccctgggccagatcaaggctctggttgctccacattgtactccctgcacacctgttcttattgattctggggaaggaaggagcaaaaggttcagccgattcacgtctatcaaccctcggaaaatcctcctcttattcgcaacgctgtcgagtgtggggacgacaatactgatctacttcacactggcaatcaacagcaaagcggaggcgtagtcgtttgcagacaccaccaccatttgcttcggcggcagcagcagtacattccgagcttgagt

SEQ ID NO: 411 - DNA, 1400 bp, Sorghum bicolor
aaagtcgacactgccaagtgctcaacaccacgcgaagaacctcccgtcccaatccggcacggcacactcgccgccatgctccccgccgccctccttccctctccgccggggcgcctcctcgcttccatccctctccgctgccacgctccgacccagcagccctccaccgccgccgccgccgccgcccgcggcctcctcctcggcggcgcgcgctccccggtcgtcaagcgcgtcccggacggtggcgggtggctcctctggcaccagtccggcccccgtgtcgcgctctccacctctatggacggcctccgctggagcgccctcgtatcccccgacccactgctgcccacagaggactggtgggcgttcgacaccgcctctgttcgcccctccgacgtcctcctcatctccggccccgcggcgtcatcccgccgcttcccgtcctccgccgtgtactggctctactacacgggctccaccgacgagcggttcggctccccgtttccggacgccgacgtccccgcgctccccggcctcgctatcagccaggacggccgccactgggcgcgcatcgagggggaccaccacactggcgcgctgttcagcgtcgcggaggatggggaggaaccccgagggtgggagacgcgctgcattgtcgcgcccaaggtggtgatgcacgcagacggggacctgcggatgtactatcactcgttcgacgaaacgtcgcagaggcctgcgatcggtttggccaggtccagggatggcatccggtggaagaagacggggaaggtgcttgaggccgggcgtgctggatcctttgatgaatgcggggtacgacatggacatgtggtccgtgaccgtgctgccgggcggtatgtcatggtgtttgagggtgttgatgcagatgggagagtgagcattggaatggccgtttcagaggacgggcttaaagactggaggcgctccagcgagattccagtgctgtgcccttctgacgatgatgacgggtgggatggcgctggggttggttcaccatgcttggtgcaaatggatggggcctatgattggaggctgtattacatgggtgttgggagggacggcgaggcttccattgggatggcgcattcagagggtcaggctcttctgaaattcgagaagtgtgatgctattctcatgtaagatgtaaggtgaggtcttagtagtttctggggatgtacatgtggatatgttttgacctttctgggggtgttcaattcacattcacttgaaacaaaacaaaatgttacgatttaaaaacttttacctcagcttattgcattagtattgtactgttcttatttgctatatctgcgtcttccataaaaaaggtggtcctattgaagtccattagtgaattcttt

SEQ ID NO: 412 - DNA, 890 bp, Sorghum bicolor
caaggcctcctcctcctcctcctctccaccgaggtcgcgccgcgcgctcgccgtcgcgatggccgcgtcgctactcgtgctcgccgtggcggtcctggttgccgttggccccggcggcatcgatgggggcgcagctgctcccgtggaggtggagggctccgaggtgacctacgggagtgtgatcaagctgatgcacgagaagacgaagcaccgtctgcactcgcatgatgtgccctatggctcaggcagcggtcagcagtctgtcaccggctttcctgaaggcgatgactcaaatagctactggatcataaggcctactccagattcatcgtctaagcaaggcgatgccatcgaaactggtggcatcatcaagttgcaacacatgaggacacggagatggttgcacagtcacttgcacgcttcaccgttatctggtaaccttgaggttagctgtttcggtggggatgaattgtcagatactggtgactattggaggctagaaattgaaggaggtggaaaagtatggaaaagggatcaaaaggtacgacttagacatgtcgacactggaggttatctgcatagtcacaacaagaagtacaatcgccttggtggtgggcagcaagaggtctgtggtgtccgagagaagcgagctgagaacatttggttggcagcagagggtgtttatctcccagttaccggaagcaagtgaaaaagcagttaccagttttaatgttaattagtataggatcagatattttacccgctttcatccgttcttgttttttcttgagaaaaatgaacatgggacctgacccctagtcatatgttgaagttggaatgtttgatatcgatgatgtcgacaaaatcaggacagtgcatgcttgtaactg

SEQ ID NO: 413 - DNA, 1492 bp, Sorghum bicolor
gcattcaacactcatcaacagccaacagctagcgagagagagagagtacagacgagagggggacagacagacagagacgatgaaggtcgacgtggtggggacgacgctggtggcgccgagcgaggacacgccgcgccgggagctgtggctgtccaacctggacctggccgtgcccaagacgcacacgccgctcgtgtactactacccggcgccggcgccggcggccgccacgggcacggacgacggaggagaccgggcggccttcttcgcgccggagcggctggaggcggcgctggccagggcgctggtgccgttctacccgctggcggggaggctgggcgtcggcgtgggcgagggcggacgcctgcgcatcgactgcaacgcccagggcgcgctcttcgtcgtcgccagggccgacttcgccggcgaggacgtgttcggcgacaccgacggcggctacgagccgtcgccggaggtcaggcggatgttcgtgccgttcgtgccgtccggcgacccgccctgcgtcatgtccatgttccaggtgacgttcctcaagtgcggcggcgtggtgctaggcacgggcatccaccacgtgaccatggacggcatgggcgcgttccacttcatgcagacctggaccggcgtggcgcggggcctcgacgtcgccgaggcgtgcggcccgctgccgccgttccacgaccggacgctcctccgcgcgcgctccccgccgacgccggccttcgaccacccggtctactcgccgtccctgctcaacggccggccccgccccttcgtcacccgcgtgtacgccgtctcgccgaagctcctcgccgacgtcaagtcccgctgcgcgccgggcgtgtccacgtactgcgccgtcaccgcgcacctgtggcgctgcatgtgcgtggcgcgcgggctggcgccgtgctccgacacgcggctccgcgtcccggccaacgtccgccaccgcctccgcccggcgctcccgcggagctacttcggcaacgccatcgtgcgcgacctcgtcgtcgcccgcgtggaggacgtcctggaccgcccgctcgggttcgtggcgcaggccatcaaggacgccgtggaccgcgtcgacgacgcgtacgtgcgctccgtggtggactacctggaggtggagtcggagaagggcagccaggcggcgcgcgggcagctcatgccggagtccgacctgtgggtggtcagctggctcgggatgcccatgtacgacgccgacttcggctggggcacgccgcggttcgtcgcgccggcgcagatgttcggcagcggcacggcgtacgtgacgcagcgcgccaacaaggacgacggcatcgccgtgctctttgggctggagcccgagtatctgcagtgcttcgagaaggtgttctatggggagtgagtcgtgagattactacacttgactaatgactagtgccatccgcgtttcaccgtgagcaccgagtgtggtggttacagtagc

SEQ ID NO: 414 - DNA, 606 bp, Sorghum bicolor
ctctcgcttactagaaggtccaagaacactagagcgacaatggcgccgtcctcctcctcctcgtcggcggcggccgtgctcctcctggcggtggcggtggccgccatgctcgccgcctcgtcgacaccggtgctcgcggacctgacgcacgccaactgcgccaagaacaagaaggtgacggtgcagaacctgtgcagccacgacgtgacgctgacgctggagccgctggcgaacagcccggcgctgttcgccggcgcctacacgctgcacccgcacagccacgccgagttcccggtgtgctggtggacggggcggctccgggcgggcgccgacgccgccgtggtggagttccacgtcggcgtcgacggcgggtccttctacctggccccgaacgcgcagcccgggcagcgcgtcccggtctccgtcacgccgcacgggtcgccgctccaggggagatgccccgccgtcgggtgcgccgtccaggggaggtgctccgtgcaccaggtgcccagcggtgactgccggaacgtgcaggagatgaagatcatctactgcaacccgcacgtgtgatctatctatcctccattgttatgcatgctagcttag

SEQ ID NO: 415 - DNA, 2612 bp, Sorghum bicolor
tacgatctttctgtgggagtttggatttccggtcggaggttgttggtagtgtggtcgccgggagcctttttttttgccggaaggcatcggtttcttcgccggaggggcgggctgtttgaccgaccgccggtacggtgatggtggcgaggatgatgcggtggcctcggcccccgccggcgcgaaacttccgcgtccgcctggtggtgcggcgggcggaagggctgcctccgccgccttcgcccctctcgcctgaggggtctcccgaggccgaggcgaaggtgtttgtagaggtgagctggaagggccccaagatgtcgccgctcacctcgctgcggcggtcccagcggccgcccaggaaccagacgcggaaggaggcgctgccggccgtcgccacggccgacctcgaggatggcgccgccgccgctcctgctccggcggcggtgtcggcggtggcctgggaggaggagttcgagagggatgcggcgctcacggcgacgtcgcaccgtgaccccgctgtgttccatccctgggacgtcgccttctccgttgtcagcgaatcaaataaaatgtcaaagagcaaacttgttctggggactgcttcactgaacctagcagattatgcatctgccgctgaagaggaaatcgagataatcctaccattgtctgtgcctagtagtgcaatggacctggccccatcactccatcttactttaagcctggtggaactaaggatatctcaacaatcgcctggtgcttcacagcgttctgttattgccccattgtcaccttcctctggtgactctgttccttctggaaaagatgaggtttctgtcattaaggtggggctgagaaatctgaaaatcctaagagatctagtatctacacggaggttcaaaaagactaaccaagattatgacggcagtgaggagaagtattatgttcacagtgatggtgcagaattttcttgtgatactgactctcttgatgatgacctggatgatagagagcaggatgatgagtttgggggttcagcagtcaggaagtccttcagctatggctcactgcagactatgaatgtcggtgccctactttatgcacctaggattgatggagatgacgagggttgggtacattacagccaccgaaattctgatgtcagttatcatgttgagcaagtgccatcctccacagctgaggagcatgcttccatcccattgcggcggaagaggagcctacttccagctcgatggagaaagacaaaattaccaaaggctaaaggggagcctcttttgaagccatatggagaagagggtggtgatgatattgactatgatcggcggctgttgaccccttctgatggatctgtttcagagggatcaaatggctctggtaatagtatggtgtcggtatttggtgatgatgattttgttgtggggaactgggagtcgaaggaagtatttagccgagatggccacctgaagctttctacacaggtgttctttgcatcaatagaccagagaagtgaacgggctgcaggggagagtgcttgcacagcactggtggctgttgttgcagactggttccaagcaaaccaagacctgatgccaatcaggtcacagtttgacaacctgatccgagaaggctctttagaatggaggaaactttgtgagaatgagacctacagagaacgctttcctgataagcactttgatcttgaaaccgtccttcatgcaaagatccgcccactcacagttgcacccagcaagtcgttcattgggttcttccatcctgaaggtactgaggatgtatctggatttgacttccttgatggcgcaatgtcattcgataacatctgggatgagataagccgagcagcagagtgctcctctggaaaacctaccatatacattgtcagttggaatgaccacttttttgtcctcaaggttgatgttgatgcttattacatcattgatacacttggtgagaggctgtctgaaggttgcaatcaggcatacatattgaagtttgatgacaccaccaccattcacaaagtgcctgctgaaaagaaggaatcaaatcctgataccgatggacgccacaacaaggattcctcagagatctgctcagctgagcaggacagtggaacggacactgaagagtgtgagcttgtgttgaagggtaaggatgcatgcaaggagtacatcaagagcttcttggccgctatcccaatccgggagctgcaggctgacatcaagaaaggtctcatggcatcaactcccctgcaccaccgcctccagatcgagttccattacacggaatcttgccctgccgagatcagcgtgcctgctccactgtccccattcgaagccccttttgagttctgttggcctgagccaccatcacccccacctgccactgaattcgctgtaacctatcctcctgccatggaggtcgccataacccaggccgttgccgttatatagctgaccttggttgctgctgtgactagggcagtggctgcgtagtttataacatatagagagctgcgcttttcagagcgaattgtgaagtggaccagatcgaagatttggcttcgtttctagtttgctcgt

SEQ ID NO: 416 - DNA, 1401 bp, Sorghum bicolor
aaaggatccgttgctgagctaatcgagctgaggccgcccgccgcccttgaagaagacgaaggcgaagacgactcctcccaggccggcaggccctccttctttcttgatcgaattgaagcagcatctcccatgctgatcggcatgccgcagggagcagcagcaacagccgtggacagcaacggcaaggacggcggcggcggcgccaaccccactagcacggcccggccagcggcggcgctgcccctgaagctcctccgccctctcctcctcttggcggtgctgggcacggggttcctcgccgtcgtggtcctgttcctcggcggcccgacctactcggccatgctcccgcggctgtccctcgccccggacgccgtgctgcctgcgccagcgtcggcggggaaggcgccgctggaccggtggaagcgggcgcccgcgtccgcctggcacaacatgaccgacgaggagctgctgtgggcggcgtcgtggcggcccagcgtccggcggtacccgtaccgccgcacgcccaaggtggccttcatgttcctcacccgtggcccgctgccgctcgcgcccctctgggacaggttcttcgccggcgccggggacgccgccctcttctccgtctacgtgcacgccacgccgggttaccgccacgacttcccgccggcgtccgccttccaccgccgcttcgtgcccagccaggtggctgagtggggcaaggcgagcatgttggacgcggagcggcggctgctagcgaacgcgttgctagacccggcgaacgagctcttcgtgctgctctccgagtcgtgcattccactctacggcttcccggcggtgtacagctacctgacgcggtcgagggcgagcttcgtcggcgcgttcgacgaccctgggccggcaggccgtgggcggtaccgggctgggctggcgccggaggtgcggcgggagcagttccggaagggcgcgcagtggttcgagctggaccgggaactcgccgtcgacgtggtcgccgacgagcggtactaccccaagttccgggatcactgccgcccgccgtgctacgtggacgagcactacctgccgacggcgctctccatcgaggcgcccgcgcggatcgccaaccgcagcgtcacgtgggtcgactggtcccgcggcggcgcgcacccggccacgttcgccgggaaagacgtcgacgaggcgttcctgaaacggctcacggcggcgcccgcgaagcagaactgtacctacaatggccagccgtcggaggtgtgcttcctgttcgctaggaagttcgcgcccagcacgctgcggccgctgctcaggctcgcgcccaagctgctaggatatggctgactgtcactgtcactgtcactgctctgctctgaatcttaggaattcttt

SEQ ID NO: 417 - DNA, 554 bp, Sorghum bicolor
ccaatcaccaatctcgcctctcgcatcgcaatcgcaacacccaagcaaagcaaagcctcgcggagaaggaagcaaccggccgatcggaatggcgatggcaccgtgcgcaccggtctcctccgttcccttggccgcccgcccggcggcgacggggtctccttcgtctgtccgtccgcgcgccgccgccgccgccgctggggtggtccgcgcggctggggcgacggagggcggcaggtggtgggcgccgctgctggggtggtcggggaaggccgactacctcgaggccccggcgccggcgccggcggtggcgcaggacgacgaggcgggcgcgcgcggcaggcagttcgtgggtggcctgacggaggagaaggcccggcagctgcgtgcgcggatggcgcagaccgagtccttccacgacgccatgtaccactccgccatcgcctcccgcctcgcccgctccgcctaaaccggaagcccgcccggccgggaagcaagtcgccgacgtcgccgtagatctagagctccacccattgtcgtcgtgtgttgtatatagg

SEQ ID NO: 418 - DNA, 597 bp, Sorghum bicolor
aaaggatcccgagagatggagaagcaggcggcggcacaggcgcaggcgcaggagcaggagcaggagcagtggcagggcgcggtggaggcgactctgccgtcgacgccagcgtccgcggcgtggccgcacatcgccagcttctgcgcgctgcaccggtacctcgcgagcatcgacgtgtgcgagctcgcggaaggggaggacggccggcccgggtgcgtccgctacgtggcctccctggcgccgggcaccaccacgggggagatcggcatctgggcgacggagaagctgctggagatcgaccacgacgcccggcggctcgcgtacgccgtcgtcggcagcagcttggggttcggcagatacgtcgctactatgagcatcgtcgctgctgacgacgaggacgacgcggggtgcaggctggtgtgggcgttcgagtgcgaccccgtgcaggggtggagccgggatgggatgctcgcctacctcgacgccggcgtcaagggcatcgccgcgcggatcgaggaagcccatgccgccgccgccagcgccagtgccggaggagacggcggcgtcgctgcttgacaactccattaagaattcaaa

SEQ ID NO: 419 - DNA, 1765 bp, Sorghum bicolor
tgtataaatcggcctttgcttctttgtaggcacactcaaaagcagcgtttcccctgtagggtggcgtgatctccactgttctataagtggagcagccacgaaggctgtcggaacctccttcgctgttatatattggcaggctagagccccaagtttcctgaaggctttgctgccctgttctagttggcgaagatgtcgttccgcagcatcgttcgtgacgttcgggacagttttggtagcctgtcaaggcgcagctttgaggtgactatcgctggcctttctggactcaccgtgcatcatagggggaaatctcagagcacggtgcatgaggtctgtgatacggatctcataatccaggagagccgttgggctaatctccctcctgagctcctccgcgatgtgatccggaggctggaggccagtgagagcacctggccaaatcgcaagcatgttgtgtcctgcgctgctgtttgtcgagcatggagggagatgtgccgggagattgtgctgagcccggagttttgtgggaagcttacattcccagtttctctaaagcagcccgggcctcgagatggaatgattcaatgtttcataaagcgagataaatcaaagtccacatatcatctctacttgtgcctcagcactgctgtacttatggagaatggcaagttcctcttatcagctaaaaggaaccgcaaaacaacctgcacggagtatgttatctcaatggatgctgagaacatatcgagatctagcagcacatatattggaaagctaaggtcaaacttcctcggcaccaaatttatgatctctgacacgcagcccccttataatggggctgtagtccctcatgctggccggacaagccgaagattcaactccaagaaggtctcccctaaggtgccaactggtagctacaacatagctcaggtgacatatgagctaaatgttcttggcacgagaggccctaggcggatgcactgcgtcatgcactctatacccgcctccgcagttgagcctggtggcatagtccctggacagcctgagcagattctgccccgggcattagaggagtccttccgcagcaccacctccttctccaagtcatccatcatggaccggtccatggatttcagcagctcccgtgacttcagcagtgcccgcttttctgacattgccggaggcgccgccatagctggcgatgaagagggacagaacaaggagaggccgcttgtgctccgcaacaaggccccaagatggcacgagcagctgcagtgctggtgcctcaacttccgtggccgtgtaaccattgcctcggtgaagaatttccagctgatcgctgcgccaagcccggcccctgcccctgctgccagggctccaaccccatcgtcacaacctgttccgcaggaccaagataagatcattctccagtttggtaaggtggccaaggatatgttcactatggactaccgctacccactctcagccttccaggctttcgccatctgtttgagtagcttcgacactaaactggcctgtgagtaaatatagaccccgtggaagcaatggaacaacccggagctggcaatgcacaaggggagagatgcatttagccctaggattttagtttgatgcttttgcaatttgttgttttctctctgatggttgtattctgcttcctgttaacctggaaccggacctctaggctctaagcatgtatgttttcacctgctggcaccatggtaggtgccatttcgtgtaatgt

SEQ ID NO: 420 - DNA, 323 bp, Sorghum bicolor
tgtccgcagctcgagagcggatgccgccgctggcgccgacgacgacgtcgtcgtcggagccggaaccgccgttccggccgcgggagaagatcctggagaagcagaggtacttccagagcgtccacaggccgacgtacctcaagggccgccacgacgtgatcacctccgtcgccatcccgctcgccctcgcactctccagcatgtacctcgttgggcgcgggatttacaacatgtcccacggcatagggaagaaggaatgagctctcgtagatgatggcgatcgcgctacgtcggtgctactgttgtctctgtagggtaccttt

SEQ ID NO: 421 - DNA, 1418 bp, Sorghum bicolor
gcatttcctcgtttccagctgccttccaggcaacgacgcctcgcctccccgcccattccattcccggaccgaatccccctcgaaacggtcaaagccaaaaaccaaccgcgcgcggcggcggtaacgagaacgagacgcgcttgctgaatcaggagtaggagagtcgccggcgagcagcaatgccttactgcgaggtgggcagttacgccgacggcgacaagtgggagggcgtccgcctcttctaccgccgctacggccgcggcgcgaccaaggtgctcctcatcatcggattggcggggacgcacgactcgtggggcccgcagataaaggggctgaccgggtcgctggagcccgccgacgacgaggccgtgcggccggacgaggaggccggtgtcggcgcggccggagcggcggaggcggcccccgcggaagcggacgaggccgccggcggcggcgatggcatcgaggtctgctgtttcgacaaccgaggcgtcggccgcagctccgtgctccccaacaaatcctactactcgacggcaatcatggcgacggatgccttggccttgatggatcatttggggtggaagaaagctcacgtctttggccactccatgggtgccatgattgcttgcaagctagcggcaatggcacctcacaggctatgttcgctggcattgcttaatgttactggaggtggctttcaatgcttcccgaagctagatgggcagatgctatctcttgcattccgtttcttaagggcaaaaactccagaggaaagagctcttgtggacttggaaacacattatacgaaggaataccttgaggagactgttgggtcagttactagaagaatggtcctctatcaagaatatgtgaagggcatatcatctacagggatgcaatctaattgtggttttgaagggcaagtcaatgcatgctggactcacaatatgactactaaggaactagatacaatacgatctgctggttttctagtttcagttattcatggaaggtatgatattattgcacaattgtgccatgcaaaacgtctagcagaaaggcttcttcctgttgcaagaatggtagaacttcatggtgcacatctagtgagccatgaaagaccagatgaggtgaacaatgcacttatggatttgataaaggccaccaaatctgcgatgaaacctgaagagtggtcagcccagcctgagaacatatcggaaaccggggcactcatttctgcgagacccattaccgtcacgatgcaaacagatgaaggggtgatagtcatggggtttgagcacatgaggaacattgtaaaggtaatgaagccagtaagggttgcagcagttgagtcataagatccgaaggcatgtaaactattctcgagaccttgtgggagtcgagatgatacttag

SEQ ID NO: 422 - DNA, 695 bp, Sorghum bicolor
tcagctactactcctagctcccaaccgaaccgaggagaaggacgccgtgcaggtgcagctcgggcgcgcgcgcggcgagcgccaggaaggagaagaagaatgtaccaggccatcccgtacagcgccggccggccgtggccgcagcccgcgccggcgatgggcgtcgaggcgacgacggcagcagcggaggagaggctgctggcggctgtgcggcagcagcagccggcgccggaggcggaggcggcggcgagggaggaggaggtgcggcgtgcggtggcggagtgccccgtgctcgtggtgggcaggcgcgggtgctgcctgagccacgtggtgaagcggctgctgcaggggctcggggtcaaccccgccgtgcacgaggtcgccgacgccgaggcggagctcgccggggtcgttgacggcggcgacgtcgcgcttccggcggtgttcgtcgggggcaggctcctcggcggcctcgaccggctcatggccgtgcacatctccggcgacctcgtgcccatactcaaggacgccggcgcgctgtggctctgatgtgaagaccaagccgttgttgttgcctctccatcgtcagcacttctttcttttttggtttccctgtccttgcttggaattaaacgatgatgtgttgttaacttatttttatttactcctagatcgactagatagacaggcatgca

SEQ ID NO: 423 - DNA, 1330 bp, Sorghum bicolor
aaggaagcggcagtggagccggccggcagctgcagctgcagctaccccgaagccccgcgcccccgccaccgccatggcaatccacctccgcgcccacgccttcgcggccaacccgctgcgtggcgtctccgccgccaccaccgccgtctccccctccgcggccgccgaggttctccgctcccttctcgaccccagctccgccgccgccgccaatccccagccgtacctctccaagatcctccctttccgccggggccgcccgcttgcgcgctccacggaccctcctcccgcgtccgcccccgccgcggcgccggcctggtgccttgcgtggctcccgccgtcccgcgtccccgggctcgccccggacgccttcgtcttcctgggcgcgcatgtcgagggcggcggcaaggaggccgccgcgtactgggcggtcgacgtcagcgagggcgagggagcgacggtcggtgggccggcggacggggatgggccgtcggcgtttgtggacttgaggacgctcatggtggccacggactggagcgacaagcacgccatgggggagctcgccatcgcaggacatgctcgagcactgctcgaatggcacagcacggcaaagttttgtggagcatgtggagcaaaggctgttcctactgaagccggaaggcgtaagcagtgcagcaacgagtcctgcaagaagaggatataccctcgaattgatcctgttgtgatcatgttggtcattgataaagaaaatgatcgggcgctcttaagtcgccagtcaagatttgtgcctcgtatgtggagttgtcttgctggtttcatagagccaggagaaagcctggaagaggcagtgagacgagaaacctgggaggaaactggtattgaagttggacaagtcgtttatcacagttctcaaccatggcctgttgggccaaatactatgccctgccaactaatgatgggcttctttgcttatgctaaaacgttggagataaaagtggacaagcaggagcttgaagatgcccagtggcacagccgtgaagacatcaagaaagcgttgacgtttgctgaatacgaaaaagctcagagaacaaatgctgccaaggtcaatcagatttgcaagggtgctgagaaagggcagagcctctctggtgacttcaaagtcgaaagtggtgagcctgctccaatgttcgtcccaggacccttcgccattgctcatcaccttatctcagcatgggcttttgagggagtaccaaagctgcctagttccttctcaaatctataagcctggaccctagtgttcagacacatcagatggcaggaactggattag

SEQ ID NO: 424 - DNA, 1091 bp, Sorghum bicolor
acgagctagggaggagacagagagatggacccggagaagcagcgccagcacgacggcgacggcgacggcgatggcgccgccgcggcggaggcggacatcgagcggctccccgtcgacctcctcgcgcacatcctctccctcctgtcttccttccgcgacctgtccatggctgggggagcgagccggaggtggcgctgtgccgtggagcgggcactggcgtcgcggcggcggctgagcttcgcgggccagcgcaccggcaacgacaccgccgcgcgcctcatccgcgccgccgtcaacctccgcgacctcgacatttcacgaagctgctggggctgccatattaccgacgaaggcttgatcaagatttcctccgcggattgcgtcggcaatctgacctccatatcgctctggggattggccggcatcaccgacaagggcgtcgttcatctggtttcaagggcttattctttgcagcacctgaacattggtgggacattcatcacagatgaatccctgtatgcggttgcaaacagctgcacaaatctgaagagcatcatcctgtggagctgccgccacgtgacggaggccgggctggtggcgctggtgaacaagtgccggcggctggagtgcatcaacgtcggcgggatgcgggtgccgccggagagcttcgtgggcctcctctccatcagccccgccctccagatcaggtccatccaccgcatcctcaacgccggcgtcggcgtgcaggtctcttgatcggatgatccatgcatgcattatccatggatgataaggatcatatgtgtcagtcagttacagtatcaagccataaacccacatttgttgccactgtgtttttcatggaaaaagaattgtcagaagggattcatcaaattatggatcaacatatacgtgtgtgtgtgtgttcctgttgtcttattgttgttgtaaagaaaaaaaggatacattgtcttgattctatcttttgtacatgtatacatgtaaataaattgtaccgatacttttcatctaaaaaaattgtaccgtcactgcaccactggaagtgctaggaactataggaagtgcgtgtg

SEQ ID NO: 425 - DNA, 979 bp, Sorghum bicolor
gagagatggggaggcagccgtgctgcgacaaggtgggcatgaagaagggcccgtggacggcggaggaggaccagaagctcgtcggcttcctcctcacccacggccactgctgctggcgcgtcgtccccaagctcgcagggctgctgaggtgcgggaagagctgcaggctgcggtggaccaactacctgaggcccgacctcaagcggggcctcctctccgacgacgaggagcggctcgtcatcgacctgcacgcgcagctcgggaacaggtggtccaagatcgcggcgcagctaccggggaggacggacaacgagatcaagaaccactggaacacacacatccgcaagaagctgctccggatggggatcgaccccgtcacccacctcccattgcaggagccgcccgctcctcctcctcctcctcctccggagcaggagccggacgaccaggaagaagaaccgcagcagcaagagcagcaggccgggaagctcatgcaggagggcggcgcgggggaagacgacgtcgcgccgatggtccagccgcacgagaccatcatggcgccgccaccaccgcccacgacggcggcaagcaactgcggctctgctgctgtttcctctgcctccgccgggtccgcgtccgtggtctcgccgtcctgttcctcctcctcggcctcagcccccgcggtgaccggcgtggaggcgacggagtggccggagcccgtgtacctgttcggcatggatggcatcatggacgccggctgggccggcctcttccccagcactggcgctggcgctggcggctgcttcggcttgggcggcgtcgatccgttcgaccagtaccccggcgtcggcgtcggcggcgccggcttcgatcaagatgacggccactggatgtgacgcgcgcgcttgatcgccgtccttccatctcgcttagcaagttactcctagcatcatagcgccatagcctagcttgtagcctc

SEQ ID NO: 426 - DNA, 795 bp, Sorghum bicolor
ccagtcgaggcagtacaagttctccatcacctgctttccttttcttttgccgttccacatcgattcgtctcctctctctctctctcccctccgctcttatccccgctgcgcctcctgactttcctcttcgtcgtctcctactcttctcccacccgcaaccgccgcagagagagagagaaaggggaagaagctttccccagcgcagcagcagccgccgccgccgccgccgccgccgcagcggatcgggacctctgctctgcggaatccatccatggcggaggaatcaggccgccccttgccaaagtttggtgaatgggatgtcaatgatccagcttctgcagacggatttactgtcatattcaacaaagccagagatgagaagaagggtgggaatggacaagacactgattcaccttccaaggacaccaggactgagagggtggaatcttatgctgcaaaaccaagcacgaagaaatggttttgttgtgtgacagccagccctacgcaatcctgaggaagacaagtgcatgcgctttggaaatactgtccctttaattttctatacatactatccataagacaatgtagaggtacccatgcctctccgggctccaggatgggtatctcgtaaactctggcgtgcgtgtatgtatggtgtgagagttgtcggcatacatttgaaaagtggactttctggttgtaattctagtcctgtctcttttttcatttgttggtgtatgtactagtgccttagtgcgggtccaaatttgtgcctaaggcctactttggtagccc

SEQ ID NO: 427 - DNA, 986 bp, Sorghum bicolor
aaactgatcatcgaggagatcgaacgagagatggcgatggagccgaacatggcgcgtcgcctgtggcacgtggtgcgcgccgtgctgttcatgctccgcaagggcatgccgaagcggaagctggccatggacctgcacctcctcgtccaccgcggcaagatcgccggcaaggccctcggcaacctcatgaccgcccacgggcacaacagccaccacgacagcaaggctgaggcggcggcggcggtgcctccgcagcagcagttctcgtcgtccggccgcggccgccgcgcactcgacccgtccctcgccgtctacaacccgcgcgaggtggagttcagctgcagcaacaccccgtcctacccgtccctccacctcaacctcatccccaccggcaagcgccgccgccgcaacaacaacagcagcagccgccgcggcacccaccgcggcgcgaacggcgccgagcccggctggtacaactacgacgcggccgacattgccagggtcttcgagatcctcaacaacaacgacggcggcggcgacaccagctcggaccaacaacaacaacaaccgtctcccctcgcgctgatcgcgacgccgtcgccggcgatgtgggcgagctttggacgcacgcccgcgcacgcgaggaagctcaggatcaccgactcgccgttcccgctcagggacgacgacgcggccggtggccaggtggacctggaagccgaggagttcatcaagaagttttacgagcagctgcgcacgcagcagagcctggccaccgccacgccggactactacggcggcgggtatgcgccaccggtctctggaatcgcctagaagccatgaagccatatatatatatatatatgcatccacattccacacacacacatatatatgtgtatatatgtgtccatagggtattagcttggatgaaccttaattttgttcataaggtgtgaagtgtgtgtcgtctgtgctaaactcca

SEQ ID NO: 428 - DNA, 847 bp, Sorghum bicolor
gaggtgaggtttgcagcttgcaagtcggtcggcgtcatggcatacaacggccgtgaccagcggtacggcggcggcatcgctacgccggggtacgcaccgccggtgccgtacgggatgtcgcaggtgaacatcgagggcaacgggtgcggtcggccgctgccgccgcagccgaccgtgaaggtgtactgccgcgccaaccccaactacgccatgaccatccgcgacggcagggtggtgctggcgccggcgaaccccaaggacgagtaccagcactggatcaaggacatgaggtggagcacgagcatcaaggacgaggaaggttacccggcgttcgcgctggtgaacaaggcgaccggggaggccatcaagcactcgctggggcagtcccacccggtgcgcctggtgccctacaacccggacttcctggacgagtccgtgctctggaccgagagccgcgacgtcggcaacggattccgatgcatccgcatggtcaacaacatctacctcaacttcgatgccctccacggcgacaagtggcacggcggtgtccgcgacggcaccgacatcgtgctctggaagtggtgcgagggcgacaaccagcgctggaagatccagccctactactgaaccaactgatcgatgatgagatctatcgatgatcatccatcgtcgcgtcgatcgatcctgtcgtcatgcatggagacgacgtgcatgtacgtatggcctatgtatatgtatctatatatgtacgcatgtatacgcactagcagaataactgagcctcgatcatctcctatgccgtctgctcgtctttctgcacgcatgtctgtcagcatgtgtgcatatt

SEQ ID NO: 429 - DNA, 571 bp, Sorghum bicolor
aaaggatccgtagagatcaccttcgcctcacgtctcgtctccgaagaagaagagattagatcctaggttactcctcgatctgaaaataaaaggctaggctgccggccgggataagatgatgatggagaagcagatcaggggggagcaccagcaggaaggagcagggcggcggcggcagcagcagcaggaggaggaggtggtggtggtgcacagccaggtgaggcggatcaagcaggaggaggacgagcgggcgaaagtgcacgagacgtaccagcaccagcacgtctccgagatgcgcgtcgtcctccgggacctcgacaggcagcgctcccgctccccgctcggccgcgtcgcccgcaccgccatctccatcggtggcgactcctagtctggctctggcctatggaattcgttcaagccgatcgatcccctcggggaggcggggtggagaaggcgggcgttctcggtcggcggcgacgatcggcgtcgtcctctcgccctcgctcttccctcgttagggttgattgatcgatcgatcgttgttaggatctgtttcggttagggtaccttt

SEQ ID NO: 430 - DNA, 913 bp, Sorghum bicolor
cacagcggtttcactgctcccctcacctccgctcccgaacggccggtctttgcatggcagcagcagctagttccaaggggcgggcgatcgctggaagcttcgtcagccgcgtcctggccggcaaggccgcttccccgaggagggccgtgcacgcctcggcgtacgacaagaacctggaggaccaggtgcggccggcgttcgtgccggacgatgtgatcggcggcggcgccgggaaccccgacaagtactggagcccgcacccgacgaccggcgtgttcggcccggcggcggtggaccccaagctggccgctgctgctggcgcgccggacgctgccgccgcgaatgctgcgggaggcacggtgctggaccagaaggtgtggttccgcccgctcgaggacgtcgagaagcccccacccgtcgcctgagcggcgctagctgtgccagcccacactgctgaattgctgataaggagagcctggcgctgatacacctatcactctgctcagctgggctccctccctgcttatcactgcagtatagtagcagtgcttgatagcggtgtggctgtgctaataccagcattatcaatataagtatataaatactggttttatagtagtgtagtagtagtatcaggcatggcgtgcatcagaactggctgtgatagtagcaacgtgatgctcgtgcctgtaataagaacaagcaggagatgtttgcctgtgctgcttgtgcctgtgatgtaccggtgttgttatcagtgttataagtacttgggtcactggtttgtgcttgtgtttcttacccatgacgcagttcatatactccatccatcccaaattctccattcgcctgttccacggcggaacgtcgacagcgtcatggactccaggactcaggcacttgtgtgatctgt

SEQ ID NO: 431 - DNA, 2163 bp, Sorghum bicolor
tccccaccctatccctcccggcgggcgggggaggaagcgagcgacgatggcggcgctggaggcggcgaggtcgtgggcgggctccgtcatcccgccggagctcgccgccgccgcgggcggagacccgctcgccgcgctggcggccaccgccgcggccctcgtcgcggggctgcttatcctcgccgtctggttccgatccggaggcggcgcgccgtccaagccggtcgccgcgccggtacgcccgccgccggtcaaggtggacgccgacgccgacgtggacgacggccggaagcgcgtcaccatcttcttcggcacgcagaccggcaccgccgagggattcgccaagtccatggcggaggaagcgagggcgcggtacgagaaggccgtgttcaaagtggtggatctggatgactatgctcaggaggacgaggaatacgaggagaagctgaagaaggaaaccgtggtgctgttcttcttagcaacatatggggacggagagccaactgataacgcagcaagattctacaaatggtttactgagggaaaagagaaggaagtttggctgaaggatcttaaatatggtatttttggccttggaaacaggcagtacgaacattttaataaggttgcaaaggtggttgatgagctactagaggagcagggtgggaaacgtcttgttcctgttggccttggagatgatgatcagtgtattgaggatgatttcactgcatggaaagaactagtgtggccagagttagatcaattgctccgcgacgaggatgacacaactggcgcatcgactccatatactgctgctattcctgaatacagagttgttttcattgataaatctgacctgtcattccaagatagatcatggacactagccaacggtactggtgtgattgatattcaacacccttgcagggctaatgttgctgttcggaaggagctgcacaaaccagcttcagatcgctcttgtatccatcttgagttcgacatttctggcactggtcttgtgtatgaaaccggagatcatgttggtgtatatgcagaaaattctgttgagactgtggaggaggctgaaaggctacttgacctttctccagatacgttcttctccatccatgcagatgcagaagatggatctcctcgtaaaggaggaggttccttggccccacctttcccatctccatgtaccttgcggactgcgcttctacgatacgctgatctactcaatccaccgaagaaggctgctttgcttgctttagcttctcatgcatctgatccagctgaagctgaacgacttagattcttggcttctcccgctggaaaggatgagtactctcaatggataactgctagtcagaggagccttattgaagttatggctgcattcccttcagctaagccaccactgggagtgttttttgcagcaatagctcctcgtctgcaaccacgatactactcaatttcatcatctccaatgatggctccctccagaattcatgtaacatgtgcattagtttatgggccttcaccaacaggaaggatccaccaaggagtttgttcaacatggatgaagaatacaattcctctggaatatagtgaagaaagcagctgggctcccatctttgtgaggcagtcaaatttcaaattacctgctgacccatccactccgattatcatgattggtcctgggacaggactggccccttttagaggcttcttgcaggaaaggttagcactgaaacaatctggaacagaactgggcacttcaatccttttctttggatgcaggaaccgtaatatggactacatatatgaagatgagttgcaaactttccttgaggagggggctctttctgagctaattattgcattctctcgggaagggccaacgaaagaatatgtgcagcataagatggtagagaaggccacagaaatttggaacatcatctcacatggtggttacttatatgtatgcggtgatgccaagggaatggctagagacgtacacagaatgcttcatacaatagtccaagagcagggatctttggatagctccaaaaccgagagctatgtaaagagcctgcagatggaaggcaggtacctccgtgatgtatggtgacacatcacccccaatcagccatagcttctagc

SEQ ID NO: 432 - DNA, 771 bp, Glycine max
cattaatacagcaaggcagcactgtgtttggaaatgtgcatcttttcttgggcccaaatgcaataattgttgtcctgttttctaccgttgaggcttctttctatcagctaagctaagcagtccaaagggcacaacacaacagagaaagaaaagagtaagagtatgggaggctcatggtcatggcagctcacatgtgccctcttgctactcttctccgccgtagtcaccgccactgaccacattgtgggtgcgaatcgtggctggaaccctggctttaactacactctttgggccaacaaccacactttctatgttggcgatcttatctcattcaggtaccaaaagaaccaatacaatgtgtttgaggtgaaccaaactgggtatgacaactgcactacagaaggggcagtggggaattggagcagtgggaaggatttcataccccttaacaaggccaagagatattacttcatttgtggcaatggccaatgcttcagtggaatgaaggtttccgttgtggttcatcctcttcctcctcctcccacctctgcagttgctgctcaacattcatcgccaaagtctgcttctcctgtgctcttaaaacgaggatttcgctcactgttggtgtctactgtttcagcttgctttggaattgtttggatttatcacttgtagagcttagtggctcattctttttccccttgttgtttgtatctttcatgtttgtttcggattcttgcctttcaaaagcttgcttgttggtgctgaatt

SEQ ID NO: 433 - DNA, 1051 bp, Glycine max
cagaagatgaagcagtgtagtggtaactcttgtcaatctttccactttgacattgccgacgcctccagataaacaaccttaactttcccacaacaccacccatcattctttttctctctctagatttcatttagttgttgctgtcttcttctgtttgtgtgtgccaacacagagcgaaaaacatggctctgaaccaatcaaaagccgtgttgttgagggtgagtttggtggtggtggcgctcttcatagcagggtacatagtgggtccccctctctactggcatttcgttgaaggtttggctgcggtcaaccactcttcttctacttgtgccccctgcatctgcgattgctcttcacaacccattctttctattccacaaggactgagcaacacttccttcggagattgtgcaaagcctgatccagaagtgagtggagacactgaaaagaattttgctgagctattggcagaagaactcaagctacgggagaaccaagccgtggaaaatcagcaacatgctgacatggcattgcttgaggcaaagaagattgcatctcagtatcagaaggaagcagacaagtgcaattcagggatggaaacgtgcgaggaggctagggagaaggctgagttgacattagtcacgcagaagaagctaactgcattatgggaacttagagcgcgcaagaaagggtggaaggaagggcttgccaattctcatgcacactctcaagggaaagtacagagttcttagatacattacacggtctccatggaggtgagtggttgcataatactacaatagttttcaaatgctggtgatagcaaaagcaagtcatcgaggctcatatgtgttcacgaaaggtcaagtgtaaaatacaaatgttgttgtattttctatcattcttttttgggtatttattccatgtgtaacaccgtttaaagctagaaatcgtcaaatgttgggtaaaacttgcataaagaatattgagactatctttttgtattatttttttgcttctgatttgaaccaaggctcagactgttgcttct

SEQ ID NO: 434 - DNA, 1715 bp, Glycine max
ggagaagagagtgccttgtaataatcatagcataaattcataaagaagagagagcataatagtgagagtgggagatggatcagctgttgtggagggtgttgcctttgctaacaatccttgtctcctttggagtgttcttctacttgcaggattcttacacagcacagttttatgctctcataaagttaccacgggataagtgcagccttcttccccatcgccacttctggatatccagcaaacgcattgtgaccccacaagggatcatttctggttcagtggagataaatgatgggaaaataatatctgttgtcgagggacatgctaaccaggggaagcctaagcaagaagaagtaattgattatggagatgctgttatcatgcctggcttgattgatgtgcatgtacatcttgatgagccaggaagaactgagtgggaaggatttgatactggtaccagagctgctgctgctggtggcgtaaccacagtggttgacatgcctctgaacaattatcctacaaccgtgtcaaaggaaaaactaaaacttaagcttgatgctgcagaggataaaatctatgttgatgttggattttggggaggcctaatccctgaaaatgcacttaatacaagtattcttgaggggctcttaagtgctggtgttcttggtatgaagtcttttatgtgtccttcaggaataaatgacttccctatgactactattgaccatatcaaggcaggattgcctgtgttagcaaaatataaaaggccgatagttgtgcatgctgaggttcaacaagattttgaaaaccatttggagcttaatgaggataaccttgatccacgtgcttacttgacctatctcaatgccaggccaccttcatgggaggaggcagccattaaacaacttgtaggtgttacgaaggacacaagaaaaggtggtcctttagaaggagctcatgttcacattgttcacttgtctgattcaagtgcttccttggatctgattaaggaagcaaaaagtcgtggtgacagcataagtgttgagacttgtccccattacttagctttctcatctgaagagataccaaatggagatactcgttttaagtgttccccgcccattcgtgatgcttataacagagaaaaattatggggggctgtattagagggacacattgacctattaagttctgatcattcaccaactgttcctgaactcaagcttatggaggaaggtgacttcttaaaggcttgggggggcatatcttctttgcagtttaatcttccagtgacgtggtcatatggtaagaaatatggactaactctggaacaattgtcgttattgtggagcaagaaacctgcaacattggcggggttagaatcaaagggggccattgcagttggaaaccatgcagatattgtagtttggcaaccagagctggagtttgacctggatgatgattatcctgttttcatcaaacattctgagctctctgcttacatgggaagaaggttatctggaaaagttttggagacttttgttagaggaaaccttgtgtttaaggatgggaagcatgctcctgcaccgtgtggtgttcaaatactagccaaatgagttagttaaatactggtttctttcagatgctagttacgttgggacctaaataagagatggaagtagatgctggcatcgaccactgacctagcattctcc

SEQ ID NO: 435 - DNA, 1428 bp, Solanum lycopersicum
gtgagtgtaaaaatggtgcaaccccatgtcctattggtgacatttcctgcacaaggtcatatcaatccatctcttcaatttgccaagaggctaatcgaaatgggcattgaggtgacattcaccactagtgttttcgcccaccgtcgtatggcgaaaatcgcggcttccacggcacccaaaggcttaaacttggcggcattctctgatggatttgatgatggtttcaagtctaacgtggatgattctaaacgttacatgtcagagataagaagtcgtgggtcccaaacattgagggatgtcattctgaagagttcagacgagggacgtcctgtcacgtccctcgtctacactcttctgctaccttgggcagctgaggtagcgcgtgaactccatatcccatccgcgttactatggattcaaccagcaactgtgctagacatatactactattacttcaatggctatgaggatgaaatgaagtgtagtagctcaaatgatccaaattggagtatccaattgccaaggcttccattactaaaaagccaagatcttccatcttttttagtttcatctagctcaaaagatgataagtatagttttgccctaccaacattcaaagagcaactagacacattagatggtgaagaaaatccaaaggtacttgtgaatacatttgatgcattagagctagagccactcaaagctgttgaaaaatacaatttaattggaattggaccattgattccttcatcattcttgggtggaaaagattcattggaatcttcatttggtggtgatctttttcaaaagtcaaatgatgactacatggaatggttaaacacaaagcctaaatcatcaattgtttatatctcatttgggagtctattgaatttatcaagaaaccaaaaggaggagattgcaaaagggttgatagagattgaaaggccattcttatgggtaataagagatcaagaagaagaaaaagaagaagagaaattaagttgcatgatggaattagagaagcaagggaaaatagtaccatggtgttcacaacttgaagtcttgacacatccatctttaggatgttttgtctcgcactgtggatggaattcgactctagaaagcctatcgtcaggtgtacctgtggtggcatttcctcattggacagatcaagggactaatgcaaagttgattgaagatgtttggaagacaggtgtcaggatgagagtgaatgaagatggtgtggttgagagtgatgaaataaaaaggtgcatagaaattgtaatggatggtggagaaaaaggagaagaaatgagaaaaaatgcacaaaaatggaaagaattggcaagagcagctgtgaaagaaggtggatcttcagaagtgaatctaaaagcttttgttctacaagttagcaaaagttgttgataa

SEQ ID NO: 436 - DNA, 1454 bp, Solanum lycopersicum
tgatcaaacagaagaagagtgagtgtatacgattttcttttaagttgcggaatgtcttttggcgagactagaactatagctccaaccgaaccgagtacggaagctgcaagaaggagacgcatggaaattcatcagtttcgatttgttgccagcgatatggcggtggctccaccgagtagtatggagaatggaaggaagagaaagaaattggagaaaactgtgtccgtaaaaagctatgatagtaaagagaagaagcaattcaagttggaaagaattgtttccctcccactttcgctgccgtgcactgatgtgggtgaaaagaagctagcagagaataaagaaaccgaaacgaacgctttggatttgacggaatctgcatctgtatcgtcgaatattgagcgccagggagtctccgactgtccgaaattcgggatgacatctgtatgtggaaggagaagagatatggaagatacggtgtcgatctacccgtcgtttcttcaggataaacatgaaaagtccagcatcttacatttcttcggtctctacgacggccacggctgctctcatgcggcgatgaaatgtaaagatagaatgcatgagatagtgaagaacgaggttgagagcgcaggagaagctacatggaaagagatgatgattcagagcttctcaaaaatggacaaagaagtagttgaatattcgaaaggagctggaggtacacaaactgcggattgtagatgcgaacttcagacgccgcagtgcgatgccgttggatccactgctgtcgtggccgtcctaactccaaacaaaatcgtcgtgtccaactgcggcgattctcgcgctgtgctctgcagaaacggtgtcccaattcctctgtccactgaccataagcctgatcgacccgatgaactcaatcggattgaagaagctggcggtcgtgtaatctattgggatggtgcgagagttcttggagttttggctatgtctcgagcaatcggtgacagttacttgaaaccgtatgttacatctgaaccggaggtgaccataacggagagaacagtggaagacgagtgtttgatattagctagcgacgggctatgggatgttgtgtcaaacgagacagcatgtggtgtggctcgcatgtgcttgcgatctgggcagaactctgaccaggcttgcactgatgcatcaatcctcttgacaaggctggctttggctcggcacagttcggataatgttagcgttgtcgttgttgatttgaaaagaggtctataggggattattaatttatatgttttgcatgtacatgtacttgtttcaattttagagctagccaaacaatatgattttcatttatcataggcaagatttttcgcggttggttcctgcgatgcaatgcaatgcaactctcctaatgaaagagaaactgcttgagctggagagcctctgttgttatt

SEQ ID NO: 437 - DNA, 1281 bp, Solanum lycopersicum
ctctctttcacacaaacccagaaaatgctctctgaatcctaaaattgaagctttaatctctccaagaatcaaactttaacaaccccaacaatgtctttaatcaagccatcatctcgttatgctaaaacttcttttgattcttcaagatcttcaactaaatctgacccttcttcttctacagacaaagctctaatcaaaatcaagaaaggttcaaatggggttactcaaactacccatcaatccaatttcagctcaatggtcaagaaatttgttgaacacaaatctgcttcttctaaattgatgaagcagcagcagcagaaaaagggtgatttgaaattggttattcctgtggattttatagctgaagatttgaagaaaacggcgaaaaggggcagtggtttgagttctctgcataagaaattgtttaaaggttcttcttctggtggtggtgtgaaaaaagaagaaggaagcacggtgaaggcgttgacggaggttaaagggaatacgaggacattaggaatggttcttagaagtgagagggagttgttaagtatgaataaggagcaggaggatcagattgttgagcttaagctaatgctcgaggagaaaaatcgagaggttgagaagcttaaggatttgtgcttaaagcaaagggaagagataaagtcactgaaaaattccatactgttcccggatgttatgaattctcaagttcaggatcttttggaaaagcaaggttcagaactcaaacaggcaaaacagctaataccaaatcttcaaaggcaggtcacttctctcaccggccaactacaatgcctagctgaagatctcgctgaggtcaaagcagataaatatgctataagagggagctatgactcttttggtagcccttccgaatatgatcaagaagaagcagctaattctctggaattcagctctgaggatcacacaattcccggtagtccagatgacatgtttctgaaggatgtaaacccctgcttaacaccttactatgccaagacaaaatccaaggaattcgatgacttcaactctcctgatgctaaagatttggttaaaaacaacattcaagtgtatcatgagtccagctacaattcctgtgcaaggaagctgtcaaaaagttcagattgtcgccaatgctccaatacaggcaacaaagcaactcgtgcagctcgtaggtctgatgaaagcaaatgtacttatggaaagcaggttcacagtaagttctactgagttgtcctctatcctgacaatgcttcttag

SEQ ID NO: 438 - DNA, 479 bp, Solanum lycopersicum
caacaatggcggatgttcagagaagaggaagaccattacctcctcctccacccagaggtccacatggtccacctcctcaaaggattgctccacgccccgtaccagttgatcgcgaaaagacttgtcctctgttgcttcgtgttttcactaaggttggaggccatcacaatgttaatgaatttgctgtgaggggcaaggaacccaaagatgaggtccaaatctatacatggatggatgctactctgcgcgaactaactgatctggttaaagaggtagctccagaagcaagacgaagagatgcaattttgtcctttgcttttgtctatcctgataaaagggggcgatttgtcgttagagaggtggggactacattttcttatcccaatatgaggcgaccagataatggcagcaaaacattgagtgaacttaaatttcagataggagattacttggatgtggctatcatgttccagtgatga

SEQ ID NO: 439 - DNA, 894 bp, Solanum lycopersicum
aaaaggcctaacccagatctacggttgaaatcttggattattaataatgtcgacagatgtgcattgtaatggaaatgcattcaagattttcataggttatgatcctcgtgaagatgttgcttatgaggtctgtcgatattcccttctgaaaagatcttcaatcccacttgaaatcatacccattaaacaatcagagttaagagaaaaagggttatactggcgtggaagagggaaattagaaagcactgagttttcatttactcgttttttgacaccccatttggctaattttgaaggatgggctatgtttgttgattgtgatttcttgtatttaggggatattaaggaattgagggatatggtggatgataaatatgctttaatgtgtgtacaacataattatgctcctaaagaaactactaaaatggatggggcagtacaaactgtgtatcctaggaagaattggtcatccatggttctttataattgtgcgcatccaaagaataaggtcttgacacctgagattgtcaatactgaaactggggcatttctccataggtttacttggttggaagatgaggagattggggaagttccgttcgtttggaacttcctcgtcggccataataaggttgttgaaggggatccaactacatttcctaagtccatccattatacgcttggtggaccttggtttgaggcttggaaggattgtgaattcggggatttgtggataaaggaactcgaggagtataagaaggcaacagagaagaaggtggattaaggcaatgtaggttattcgtattgtttgattcacacagtttttagttaaaaggtaattcattcgttatgtgctttttcagtcttccatattgtttcgatcgtgagctcttt

SEQ ID NO: 440 - DNA, 917 bp, Solanum lycopersicum
tggaatagttgaagaagaagaagaggaagagaaaatgagaggaaacgatccgaatccgtttgatgaagaggagcctgaagtcaatcctttttcaaaaggtggctccgctcctgcttcgaagtcacgcttccctcaaatgattgctagtactcttggttttggccaaaaacatgatgcaactgatgacgtcccattggattcaatgaatggctccaacaagaagcaaaaagaattagcaacctgggaagcagatctgcaaaggagagaaagagatattaaacgaagagaagatgctgttgctggtgctggtgtgccaactgatgataggaattggccgcccttctttccaattattcatcatgatatagcaaatgaaataccagctcattctcagcggctgcagtatttggcttttgcaagctggttaggcattgttttttgtctggcgttcaatgttcttgccgtgactatctgttggattaagggtggcggtgttaaaatctttttcctggctgtaatatatgctttaatgggatgtcccctttcgtacattttgtggtacaggcctctgtataacgcaatgaggaccgacagtgcattgaagtttggatggtttttcatgttctacttgttccacattggattttgcatacttgctgctattgctcctcccattgtatttcaaggattatccttaacgggtatccttgcagcaattgatgtcttctctgaccatgtgctggttgggatattttatttgattggatttggtttcttctgcttggaagttttgcttagcttgtgggtgctgcagaaagtgtacatgtatttccgagggcacaagtgatgcacctgtttggacgtagcaacaaaacaattcttttccagagtaatgacttgcgtgatatagttgcatg

SEQ ID NO: 441 - DNA, 3803 bp, Solanum lycopersicum
gcttaatttggacctgcatttgaaccaagctatgtatcctacgaatccttaccaaaggaaccaagtaccttacaatcctcattattatccccgtttcgaatcaaatcctcatcatcatatgaacattgatccaactagatctactttaccttatgaatcttggccttgtggtggtagcaactataggcatccttatccacctgagtgccacagttgctgtatccataacacttctccgagccagtgtgcgtttagccctccatatccttaccttccaccatctacctacaacaactgtagttatcctacatatcctgtgatgtatcctactcattatgttcctcatccccattttactatggagcagccccggtacgagtatgaaaagaatatgggcagagatcatcactgttgtggttgttcaaatcataaatgtggcagtaagaaaggagggagtagtgtcaaaatagaagaacatgaccaggacaagggaaacgattgtaacgactcattggttccttttgggttcaataattgtccttatccagttgtgtgcttaccacctgatgacatgaagaatagggagcgcatgaagcctgatggatccaattgtaaagagcaggaggagaatccacaacctttgaagccgcttggtgatttcaggccttcccagcaaccaaatttctggaagttatggccttctcattatgggaacagctcgggatcaccaaaggaaaacggagatttccctgaaaagcaacatcatgatgatgcaatcaggaagcagtttccatttccaataatatggatgccttatagacctgaggaagacagagaggaagttggtaaggagaccgagtctggcctcattgctgagaaggagccaacctccccctcaaaattaaccaaattaatgtcacatgattctgaagacaagagaagcagttctaaagaaaacgaagtgaatagtggaggtgatttccatggaaagggactgaataaagggtctgttgtgaaaaccattcctgtaaagcaagtggagcagaatgagatctttgatggaaaaaaagaggaggcttcccagaggcatgaaagtgatgctaaacagaagaaaatcactcaagaagctgggagaaaacagtcgacttctcctacaaagtcatcgaagttgcctcctgtttgtttaagggttgatccccttcctaggaagaaaagcagtagtggcaattctaggtctcctagtcctcctcgtgggaaagggaaattagtagaatcgcgcagtgacagctccaaacctcccatcaaatcaaatgagaaggagaatgttcaactagacaaatcatcaacaacaagcatgccaagaaaaagcacagaagtggagccaagtaaaagcaaggcaaaagttgttgaagttgcacaagggacagctaaagaagatatacttcatgatcaatgtactgttttccctgatctgaaacgccaggcaaggagcaaaattgctgagggtgatactggtaaagcagcaaataagccaaaagatgaacttgatgcagtagttgcgaaagctcagtccagcaatgaagcacatcagagaggtgaggccagacaagcagtaaatgaagaagtggatgcaggcaataagacgaaacgagaaaagaggagtaaaatgtccaatgatgaggcagctaccaagattcaatcagcataccgaggtttcaccttgcggagatgggagcctctgaagaaattgaagcagttagccaaaatagaggagcagatggctgagcacaaaaggcatattcagactttggagagctcagctgacaatggggtggacaacaaacaaagaactttcctcacagaagtcataatgggtcttctactaaagctcgacactattcaggggttgcatccaactgttagggaatatagaaaatccgtagcgaaggagcttgttagcctgcaggagaagctggatcttctaaactgtaaaaagcaaccagcagaaagtgaacagactgttactgccaaatctagcgaggacacaagcatggcggtggaagacaacccttccttgcagggtggccaggaggtgcagaagttggaaagggatgacgattttgtgaagggggatgaaggaataaagtttgatgcaaagggactttgtgaagagcagactctttgtgcaacagagctgctagccaactctcatgatgtgggcaatgcagtactagagggaaaagaattaaacaaggacgttgaagaggtgatggagggtgttttgggtagcagtgcagtgaagaccggagatggggcatcagtacaacattttgaatctgaagaaaaaacagataagttatttgatgagaacacaatagtagtggagaaattagaagagcatggagatggtgtggatgagttgggagaactccctcgaggagtccctgatgaagagaccagtattcaaggttctgctgaaatcagacaagacacagtagaccttactgcacttacccctgaagaaagagtctctgatacagagagtctagagcactaccaagcattgggtgaaacatcaattattttggggctggagaacacgcacagcagcaatggagtagaagaaaatgcagatattgtggaaagagatgcagcagtaccaattgacattctcgaacgagagaaagaagttacaaaaccattaagtgaagatgcaaacatgtccgaggtggatgacaaggttggtatggagaagaacggaaaaaagcttgatcaaggtggtagtgcatcagatggcttttcagtaccatcacaggaaaaggcaatcaccatagagcagcctacagatactaccaacacggaggaatcagaaacaattgaggttctgcaggagaaaatgcaaaatgcagttgacagagatattgaaatccttgattcaggaaaaccagtagaacaatcgctggaacctcaactatccattggtaccaatgatgaagctcgggagtacaagcagaaaatgggggagggacataaggaggtgcaaggtgaggaattgcaagcttgcgatgatgttgtcgtctctgatcatgacaatgaaggaaaagagcataatgtggtggtcgagcagcggcatgtggagaacttcgagatgcaagcgaatgaaccagtaactgcctataatgcagcacctgtgatccaggaaccggtggatggaagtaaagctattgccactccaacgtcagaagctgcaactaccgagacagagatgtcaagggagaaagaactcggtctagcagatgaccacaacatacatccatcgatgtgtgttgccggggaagttaatcctgctgatgcttcccattcttttggttctacgcctattgaagtcccaggtaagaatgcaaatgagcttaaggaatggaagaaaatggacatgttaccggcatcgcctactgccagccaagtatcctgtgatagtgatgccctgtctgaaagcaacagaaaaattatagaggagaatgaaaaattaagggagatgatggagaagttaatcaaatcagggaacgaacagctgagtgccatatcgagtctttctggaagagttaaagagctggagaagagattgtccaagaagaagaagctaaaattgaaacgaaatagggtaccagcagctggatcagcctgtgtaaagccattgaatgactcacttagaaataggaatgtggggttggcaatgtaaaaacaaaaagcttggtcattccttttcatagaatagtaatttggttcatgtggtctgtttgcgt

SEQ ID NO: 442 - DNA, 2026 bp, Solanum lycopersicum
acaacatggcactcaccacaacatttttctctctctttctcctaatcatcaccgtcgccggacaaacaactccggtggctgaagctccggcaccggcagccgacgactgtaacggtatattcttgcagtatgtgtttaattccggatctaaaatcaaacccactttgaaaactcgtcaaccctacaagtttcagtctattctcagtataactaacaacggacttgaggaacttaagttatggagggtttttgttgggtttcaacatgatgagattttggtttctgcttctaacgctctgcttgctgatggggaatcatttcctgctttagttggtaatggtactgtttttgctggatttccggctgccgatcttaagacagctgtggaaactgctggagatactacacagacgagtgttcaaatcaaaattgtgggtacccagtttggagttggctctcctaatgtacctatgccctccaatatctctttggaaaatgatgggtttatttgccctaaaccctctatgcaaggaaagagtgttatgcaagtatgctgtattaaagacgaaaatttcaagacaaatttgacgttgggtgagaaatttagtccacgccaagatggggatcttacaattatgtatgatatcctaagaacatatgattcaaattactgggctcaggttaccattgcaaaccataatccccttggtcgccttgataactggaaactaagttgggactggatgaaggatgagtttatttgggaaatgaaaggcgcatatccctctgttgttgatacttctgagtgtgtttttgggccacaggcaaaattttatcaaaaccttgacttttccactggtttgaactgtcagagaaggccgacactaattgatctgccgctggagaagaccaatgatacaaagttgggaatgatacctttttgttgtcggaatgggacaatcttgccacctgctatggacccaagcaagtctgtttcagcattccagatgaatgtctttaaaatgcctccagatcttaatcgatcctcattcactcctccacagaattggaagatcgaaggcagactgaatccagattacaagtgtggacctccagtccgtgtaagccccacccaagtccctgatcctagtggattgttacctgctacatcagtatttgctagctggcaagttgtatgcaacatcacccaaccaaaaggagctagccccagatgctgtgtttctttctctgctttctacaatgaatctatcattccttgtccaacatgcgcctgtggttgtccttccaatactgctcgtacatgtagcacgaaagccccagctcttctcctcccatctcaggctcttctggttccatttgacaatagaaccaagatgtcccttgcctgggctgaaattaatcatcttccagtttcaaacccattgccatgtggagataactgtggtgtaagcatcaactggcatttgttcacagactataggggtggatggtctgccaggatcaccatcttcaactgggaggatgctgcttttgctgattggttcactgcggtggaattggacaaagcagcggctggttttgacgcagtgtattcattcaatggaactatgttagatggggttaataataccatattcatgcagggccttccaggcttgaactatatagtagcagaagcagatggagctaatccagcgaaagatccccgagtacctgggaaacaacaatcagtaatctcattcacaaagaagaatatcccaaacatcaacgttgctgctggtgatgggtttccaacaaaattatacttcaatggagaagagtgctcattgccaaagctactcccaacaagcagttcatctagaatatcttcattcactgtcactacttccattcttgcagcagttgtggtttttatgttggtgcgacaatagcagtgagctgtggcgttttctcttcgtttcatacctgccaattgattcattctttagcgtctgctaccaggttt

SEQ ID NO: 443 - DNA, 1892 bp, Solanum lycopersicum
aagaagggtctgaagaaatcaccgattttcaaggagaagaagaagaaatgggtacgcttcaaacttggaggaaagcgtatggagctcttaaagaccatacaactgttggccttgcccatgttaatagcgatttcaaggatgtggatgtggcgatcgttaaagctaccaatcatgttgagtgcccaccaaaagacagacatcttagaaaacttttggtttttacatcagcgatgcgacctcgtgctgatgttgcatactgcatacatgcacttgcaaggcgattggcgaagacacataattggacggtagcgctgaagacattgatagtaatccacagaacattgagggaaggtgatccgacatttagagaggaactattgaatttccaacagagaggacacgttctccaaatgtccaatttcaaggatgattcaagtccaattgcttgggactgctctgcctgggtacgaacatatgcactctttctggaggaacgacttgaatgctttagggttctgaagtatgatattgaaggagagcgccttcctaaacctgcgcaagggcaagaaaagggatacagcagaactagggagttgcccagtgaggaacttttggagcagttgcctgctttgcagcagttgttgtatcgtcttattggatgtcggcctgagggagcagcacttggaaattatgtgatacaatatgcccttgctctggtcctcaaggagagcttcaaaatctactgtgctataaatgatggaataattaatcttattgacaagttttttgacatgccaagacatgaagctattaaggcccttgatatctacaaacgagctggccaacaggccatgaacctctctgacttttatggggtatgcaaaggattggaacttgccaggaactttcagtttcctgttttgagagagcctcctcagtccttccttgtgactatggaagagtatataaaagaagcaccccggattgtctctgtgccaattgaaactctggattatccggagaggcttatgcttacgtataaacaagaggatgaaccttcagcttctgaagatgctcaagattcagctaacgaaacccctcctcctctgcctttagatgatgctgttgtttcaaccactgaggctccttccccgccaatgcctccacccccaagcagcttggaatctgatgatttactggggctaaatgcaccaagtggttatgcatcagcaattgaggacagcaatgctttggctttggcgatagttccatctgggacaacaccgttcgactcaaatcctgctcagccaaaagattttgatcctactggatgggagcttgccctggtcactactcccagcagcgacttatctgcagctcaggagagacaattggctggtggattggactccctcacactgaatagtttgtatgatgaaggagcatatagagcatctcaacgaccagtatatggagcaccagcccctaatccatttgaagttgctgatccatttgccatgtctaccaccatgcctccccctccgtcagtgcaaatggctgcggttcctcaacatcaaatgaatccttttggaccattcgaacctgcctatccacaacctcaaaatccaatgctgaatccccacaacccttttggtgatgcagggttcagtgcttttcctaccaatcatgttgctcatccacaaacaaccaatccttttgggagcaccggcctgatataatacaagttgtgcatccaccaggcatatcacagtgtattgcctgtcaatcattgttgcttttccacaaacaatcaatcctttcgtggagcactgggctgctatattcaaaagttgcacatacatgagtcgtagcagacttggcatagtcgattt

SEQ ID NO: 444 - DNA, 1316 bp, Solanum lycopersicum
caacaaacaaacagcaatcttctcaaaaaacaatcttttcttattcaactactctttactagcttctttttttctcattttaaatctcacaaaaaacactcatttctaatttaccaattataaaaaaaaaatggcacctaatgtttttggtcttgcaactaaggcaactggtttagccaaggcaaaaagtttgtcaagccgtgcctatgttacatttttagctggaaatggtgattattggaaaggcgttgttggtttggttaaaggtttgcgaaaggcgaaatccgcttatccacttgttgtggcttgtttgcctgatgtcccggaggaacatcgacgtatactcattaaccaaggttgcatcgttcgagagatcgagcctgtttatcctcctcacaatcaaactcaatttgctatggcttattatgttatcaactattcaaagcttcgtatttgggagtttgtggagtatagcaagatgatatacttggacggtgatattcaggtgtttgataacatagaccacttgtttgacttgccagatggctatttttatgctgtgatggattgtttttgtgaaaaaacatggagtcacaccccacaatataaagttggctactgtcaacagtgtcctgataaggtccagtggactgaagacttgggccctaagccatcactctattttaatgctggcatgtttgtgtatgagccaagtctctccacttatgatgatctcttgaaaacactcaaagttacccctcctaccccatttgctgaacaggattttttgaacatgtatttcagagatgtctacaagccaattccgaacgattataacttagttttagctatgttgtggcgtcaccctgagaatgtggatcttgagaaagtaaaagttgttcactactgtgcggcggggtcgaagccatggaggtacactggcaaggaagagaacatggacagagaagacattaagatgctgataaaaaaatggtgggatatttatgatgacgagtcattggattacaagaattccaacgttgttatgaatgccgttgatggagaagttgaagctcaaaaaattatggaagcgttatcagaggctggtgttgtgcactacataactgctccatcggccgcttagaatattataggaagctttcaaattgttttttatcttaaaaaaaacaactttgggatacatagtcttaaagcaaattatactagctttacagagtgcttttgttatttatttttttacaaatggattataaattgtctgtatataataggggagcaggcaatttaagttcttc

SEQ ID NO: 445 - DNA, 686 bp, Solanum lycopersicum
gctccaatctccattagagaccaaattcgaactttagtgaatacccaaatggcgatttcatcgtcttcactctcagcagctctttttccaatgtgtaattcatcttccatttctgcacaacccaagttttctcttctgtctttgcattcaaattctgttaagttacaagttttcaaccaatctcgagtgtctacaactaaggtttttgcttctcctgaagttttggatgcccagaatgttgaagctgatgttgaggatattctagctgcttcaacgctgagtattggtggtgactctgacaaggcagctccaaagcagaagattaggatcaaattgaggtcatactgggtacccctaatagaagactcttgtaagcaaattatggatgctgcaagaacgacaaatgcaaagaccgtaggtcctgtaccactgcccaccaaaaagagaatttactgtgtcctcaaatctccacatgttcacaaagatgccaggttccatttcgaaataagaactcatcaacgtcttattgacattctttacccgactgcccaaactatcgacaagttaatgttgcttgaccttcctgctggtgttgatgtggaggtcaagctctgagtaaaaaatttctcctccttgtttcacatcgtaaccttgtctatctcttgctagttcctttctggtttgga

SEQ ID NO: 446 - DNA, 1988 bp, Solanum lycopersicum
gtggcctagcaaggacatacacaaatgtgtggtctatcaatcttcgtattttgactatttctttttaccttttcttttaaaaataaattctgtccataaattaattgtagaagatgacacaaccaatgtgtttgttgtatatctgaaagccacaaaacacttttctagttttatcagtcaccacttttattctgtatttgcattttaatggagttctgaagattttttatttttattttttaaaagaagatttgaacttttattaacaaatttcaagattcagccatgcaagctgtcaaagcttcttccttttcaccatttcacctcaacttgaactcaactagttcatttcccaaaactaccaacttgtatattcaacaaaattatgaaaaccccatttcttgttttccctcaattcagacacaaaatgcaaaattcaaggtttttactgctacttccccaagtgtttcaacagaatcagaaaccccatttgatgaaaagactgaaaatgaaaatcaagaagagaaatttgagtggtatgctgagtggtacccaataatgccaatttgtgatcttgataagaggaggccacatggaaagaaagtgatggggattgatgtggttgtgtggtgggataggaatgagaaagaatggaaagtaatggatgattcttgtcctcatagatatgctccactttctgaaggaagaattgatcaatggggaagattgcagtgtgtgtatcatggttggtgctttaatggagctggtgattgtaagttgatccctcaagctcctagggatggccctcaggttcatacgtccaaaagagcttgcgcaactgtttatccaagttgtgtgcaaaatgacattctttggttttggccgaactctgatcctctatacaaggacatatatttgatgaaaaggcctccctatatacctgaacttgatgacagttcgttttcgaaaactttcatagtcagagatatatcatatgggtatgagcttctgattgaaaaccttatggacccagctcatgtccaatattcacattatggcattatgaatgttccagtagccccccaaagtgtgaaagctgatcgagaaggaggaagaccacttgacataactatcacgaagttggatgtaaatgtcattactgcaaaccagggacctggacggaacacatttgttccgccttgtgtgtattatagttattttgctttcggaggatctcagggaaaaacaactgctgtatcatctggaactgtacaggaaaaaccttcagctgagaagcagaaaaaagcacttttagttttcatctgtattccggttagtccaggtcatagcagaattatatttgcatctccaagaaactttgccacttgggcagatcgaataattccacgttggatatttcacctgggacaaaatctaattctggattctgatttgtatcttcttcatgtggaggagcgcaagctaaaggaaattggctcttacaattggcataaagcttgctatgtgccaacaaaggcagatgccattgttgttgcttttagaaggtggctaaacaaatatgcaggtggtcaagttgattggcgtggaaagtacaatggagacctcccgccaactcctccaagggagcagctgctggacaggtattggactcatacagtgagttgcacaagttgcaatctcgcatataaaagtctcaatgctcttgaagtcgtactgcagatcgtctccattggtgccattggaattgttgctgctttaaagcagggcacattgtctgcggtgacaaggtattccttggtcaccgttgcattactatgcttcgtggcctcgagatggttatctcatttcatatacaaaaatttccatttccacgattacgaccatgcctttcgttaacacttgagtactttcatatgactgaacattcactgtataaacatattccttgtagttgaaatttgcagaaa

SEQ ID NO: 447 - DNA, 1088 bp, Solanum lycopersicum
cgtaagattttcaacagtagaagagtgagaaaatgagatctatagaggataaaggatgtttgaattatggacaaaaagaacaagaggttgtaggaggcagtagtatgaattttgagtttcatggaacaaatcgagcttcgactcatcatagaacagcagcattaggtaaaccaacaccatcaaaatgggatgatgcacaaaaatggttagttaatctatcaagaggagaaaaacatcaatcgaaagccacacctcgaaactcgaatgctgatgacttaaggttgattgcacctgttccaaagaaagaagagtattcgagtgacgatgaaggagattctagtatgattcaatttgaagttgaaacaaagaaagttgattgtgatgaatcaatatggagaataaataagaataataacaactttgcatccgttgttcgatcgatatgtgtgagggatatgggaacagaaatgacaccaattgcaagccaagaaccatcaagaacagcaacaccaataagagccacaactccagcagtaagaagcccaatatcatcaggatcttctactcctattaggggacaaaatgggacaatcgaaaacggtcaaattgttgccaacattggtcaaaacaggggaaatgcagggactacacgagtcgttcgtgatgtagaagaaactattgacaatgaattagcagctaagaaggaaacagaccatcccaacaaggttaatccactcgagactcgtgcaatggcgtgggatgaggctgaacgtgctaagtatatggcaaggtataagcgcgaagaggtgaaaatacaagcttgggaaaatcatgaaaagaggaaagctgaaatggaaatgaaaagaatggaggtgaaggcagagagaataaaagcaagggcagaggagaagtacaaaaacaaattggcagcatcaagaagaatagcagaagagaaaagaggtaatgcagaagcagagttgaatgaaaaagctgtgaagacatcagaaaaggcagattatataaggaggactggtcatcttccttcttctttctcctttaagttaccttcttctttctgttggtaataa

SEQ ID NO: 448 - DNA, 419 bp, Solanum lycopersicum
tggataagatggatacacaaattcctatattgagtcctaacaataatattgatgaatttgaagatttggaagtgacacaatttgatgaagatacgctaagaaaaatattattcgaagaagaactgcaaccgaataaagatagtattaatatcgttcaagataatataatacaaccaatgatggttgatacaacttcgaatttttcgaaaatcgaggaggaggaagaagaggagcttgtaatcgaagatttcgattggatagaaatgatggaattgtcagatacaattgtctcccacgagggagtaaatgagatttttgatgtgggagaattagattttgatttttctcatttttgttcttcttcaattcctatggaagaaataggatatgatgttttgtggcaaaataacttataatag

SEQ ID NO: 449 - DNA, 1034 bp, Solanum lycopersicum
aaagtcgaccaccgcgaaactaactgaactcaataaccagtcattcaaaagctctcaaaaacggccaacaatggccgcagcattcagcagcagctttactagttccgccattggagctcaattctacaggcccaaatttgtaaaacccaagacttttgtaaacacaattcgctgtgctggtagactagaatgggatccagatggtttattgggtccgcctcaaacgggtcatatagcccgactcgagttccagagacgccttgagaacgatgctgcggccagagaagaatttgaacggcaagttcgtgaagagaaagaacgtcgcagagttcttcgtgagtcacgagtgattccggatacagtggaagggcttgtggagttttttcttgacactgaagctcaagagattgaatttgagattgcaagaatgagaccacgattgaacaaagaattctttgaccatctgcaagtcgaacttggaaagctgcgtttttctgtaaacaaaactcaggctgtggaagacagattatttgaactggaagcactgcaaaaggccctgcaagaagcaacagaagcctatgataaattacaagcagatcttgtagcaacaaagaagaacctaactgagattttgacttcaaaggatgtcaaggctactcttttggatttggttgagaggaatgcgctgaatagacccttgttgacgcttcttgatgaaaacattgcaactgcacatagtgttaaccagaaacaagcagcagaatacatggaaaagctgagaggacttgttctgaagtacctaacagtatagattccatctcaaggctatcaaatgcttgtctcatgtttatacagagaaatgggcctggtgtgaatgtaaatgtgaaagctgctttaagattaagaatacttcatgttgcacaagttactagtaatgcacttgctttggttaatcgatttgcggatcgacaccggccaagtccttaatgtgactgaggcaaggagcgtgaatttgaattagtcgaaggcctttt

SEQ ID NO: 450 - DNA, 831 bp, Solanum lycopersicum
tgtgcttccctatcttcttcttctactactactttttggtctagtggaagcagagcaaaagcagaattatgactatggctactcctatttctccaatgaagcaattcccttcaactgctcttcaaccattcccatcaatctttcaaagaaaaccagtactaatctcttcacttagaaaaactcctcatcttttctcttattcatctcccaagtcattcgttccgctttctgcttgccttgctgttcttctatggtcctctcctgctaatgctggatttctttcgggttatactggtatagaatcagttcctggccctgaattacctaagattgagtttcttaatcgttggaacgataataatcagaaaaagtatgcagaactcgatgaaaaattcaaagagtcgcctttgcttaaacagttactcgaaaaatccaagcaaaataaagagaagaacaaaaggtcaattgaagacaagtattgtttacgcggagctgaatggggagttggagattgctcaacagcaggaatgacaccagaagacagagatagcttcattgccatgttgaagcagaaggctggtgtagaatgaacgcgcaattatgtactactctttatcgatgatgctggtttcaatttccgaatgcagagagtgaagattgaagcgtaatgctgaaaattcgcgataggagacggggagtttgattgagccttataacctgttagtattagcataagcacaagaacatgtcaaaagggacatttcttctattgttctatagcttgtaaatacattgcactagtaaattatgagcttgagagtggcatattga

SEQ ID NO: 451 - DNA, 1110 bp, Solanum lycopersicum
atagtctgtcgtgccgtgttagctgttgtgatccttttgtaattgtagctttgaagtccaccatgtaatgaagattatacccagggctttttgatctatctacttattataaacttcaccagaatcagctttttttacgaagaatgtctgtgttaccaaaaattgattctatcaaaattagagaggtatggagcgataatcttgagaaggaatttgctttgatccgtcaaattgtggatgactatccttacattgccatggacaccgagtttccaggggtggtgcttcgtcctgttggcaatttcaagcatattaatgagtataattatcagaccttgaaggacaatgttgatatgttgaacttgattcagttaggtctcacattttccgatgaaaatggcaatctacctacttgtgagagtgagtactactacgtttggcaattcaactttcgtgagttcgatacaaaagcaaatatttttgcaaatgattcaatcgaattgctgattcagtctgggattgatttcaagaagaacaatgaaatgggtattgatgcaaaacagtttggtgaactcttaatgtcttctggaatcgttttgaatgacatggttcattgggtgacatttcacagtgggtatgattttgggtatttgctcaaattattaacttgtaggaccttaccggaaacacaatcagggttctttgatttgctaaacatgtactttccgctggtttatgacatcaaacacctgatgaagttctgtaacagccttcatggtggcttgaacaagttggcggaactactggaaattgaaagggtcggtatttgtcatcaagcaggttcagatagcttacttacctcgtgtgcgttcaagaagttaaaagataacttctttaatgggtctacagagaagtatgcaggtgtcctgtatggtcttggtgttgagtatggatctgataataaatagattgactttgtgtacttactagaaaataaaatagaaggaaaggtttcagtgtatgtcaagtggtgtaggtaatgtatcatgttgtctgtaagaaattaattgtgataaaagtatttgtaagacggtttggactttcactgag

SEQ ID NO: 452 - DNA, 1825 bp, Solanum lycopersicum
aaaggtcttctacttcaacatgtcaacaaaaactacaagtgtctctaatgcatccaactcctttttcctcccaaaaatcactcacaataatggctttacaacaaccatttctatctgaattactactccactcatcttcaattagaacaacactccccaaaagttcacttttttctctacaaatacctcaaagattcaatctttatcttcaaaataagcaaatcaagaaacaaggaacaagttgttatgcaattgctgagaatcttgaagctgaggatcaaagtttgattttggaaaattcaagtttagatgagttgaggggacaaagggaaattgttggttatgattggactgaagaatggtatcctttgtatttaaccaagaatgtacctaatgatgcacctttaggtcttactgtctttgataaacaagttgttttgtataaagatggaagtggtgaacttagatgctttgaagatagatgtccacatagattggccaaactctccgaagggcaactgtatgatggcaaactggaatgcttgtatcacggttggcagtttgacggagatggtaaatgtgtcaagataccacagctacctgaaaatgctaaaattcctcgatcagcttgtacgaagacatatgaaattcgggattcccaaggagtagtctggatatggatgtctcatggaacaccacctaatattaacaaaatcccctggtttgaaaattttgagaggaaaggatttcgagacatttctactattcacgagctcccttatgatcactctattcttctcgaaaaccttatggatcctgctcatgtcccgatatcacacgataggacagattttacggcgaaaagggaagatgctggaccactgtttttcgaggtgacagaaaggactaaccgagggtttgcagggtggtggggtaaagaaagagatcaaggcaaagcaaactatactccgaacttcttacgttttgaatctccttgtgttcttcagaataatagagaaattgttgatgagagtggggagaagcattacttttcgggtctttttctttgtagaccatctggacaagggaaatcgatgcttattgttcggtttgggaatacaagaaaacgaaccgggatacttaaatttatcccaaactggttcttgcatcagaatgcaagcaaggttttcgagcaagatatggggttcctttcgtcccaaaacgaaatcctaatgaaagaaaaggttccaacaaagaaactatacttgaaccttaagtcgtcggatacatgggtagctgaatacaggaagtggatggacaaagtggggcacggaatgccttatcatttcggtcacagcaccattttcctgcctcaacaacctgctgtcgttgagcacgcccctgctggtttcgttgccaatttttcagctgctcagccagctaaaggaggaatcggtggaatatatgctccgaaccctgccaacagatacttcagacatgttgtacattgcagggattgcagcaacgttgttaaagctttcgagacttggaaaaaggccctctctgttatagctctcgtgtcaactgcattcgcgattctagtgtctggaagacaatggaaggccttgcttttgctttcgacgtcgctatgtttagctggtgcatatgcttgttcaacagccattgcaatgaacacaaccaacttcataaggactcacagaagattgtaaaaagtatgtatataatagctatattcatattgatgtttttcatgtaaaataggattcaggtttatgtgcttttcatacatattgctccctccgtc

SEQ ID NO: 453 - DNA, 583 bp, Solanum lycopersicum
cacatatataagaagttgctatggcctcatcaaaagttttcttgattttcattttggctgcattaattgcaacccctgttgccgtagcccaattaggaggacttctgggtggccttcttgccccaacaagtatagaaggggttctgttttgtagccttaacggcaaaatagatgtcctcaatggagctaccaccccaattttccccgatgcatcggtgcagctgcggtgtggagcaggaaatgtagtatcaagtacaacaacaaatggatcaggagcgttttcgttggtgacgagtcctgtacaaagtttattatcatcattgttgtctgactgcaacatagtggttacaactccgctctcaacatgtaacgctaccttaccatccgttggggttctgcaggcacctttgcagattgttggcaaaaccgctggtggaggacttcttaatattgtcaaacttgttactggtgcttttcaacttattaactaaataaataaatgctactcctttatattatgtgttacgttattaattaatgtttcctagtgatgcatcagctagttagtgttgctgctgatggc

SEQ ID NO: 454 - DNA, 434 bp, Solanum lycopersicum
tctctcatctgtgtgtgtagaaagccgcagaaatggcatctttcgcggaagcaccaccaggtaaccctaaagccggagaaaagatcttcaagacaaagtgtgctcaatgtcacaccgtcgataaaggagctggtcacaaacaaggacccaacttgaatgggctctttggaagacaatctggtacaactgcaggttactcgtactccaatgcaaacaaaaatatggctgtgaactggggagagaacacattatatgactacttgctcaacccgaagaagtatattcctgggacaaaaatggttttccctgggttgaagaagccacaggagcgggcggatctcattgcttatctcaaggaagcaactgcgtgaagatttctttggaatattaaaatacttttgctagtggtcaggagtcgtccatttctcatttag

SEQ ID NO: 455 - DNA, 1611 bp, Solanum lycopersicum
aaaggatcctggctatggcttttcaaggttcattttgggcaattagccttttgatatttttggccaattttttgtctatgattgagttttctaaggctgcaaatgcaaaagtgccaagccatactatatctaatccatttaatcgtaccatattttcacctgattttctttttggagcttccacttcttcctatcagtatgaaggtgcatggaatgaagatggcaaaggaccaagtattgtggatactttcgttcacactcatcctgaaaaaatattggaccgtagcaatggagatatagctctggacttttatcatcgttacaaggaggacgtgaaactagcaaaatttgaaggactggatgctttcaggatatctattgcatggacgagaattttaccaaagggttcggttaaaaagggaataaatcaagctggtattgactactacaacagtctcataaatgagattgtagcccttggtattaaacctctcgtgacactttttcattgggatcttcctcaagcccttgaagatgaatatcttggctttctaagccctaaggtcgtagatgattacgtagattttgtggagatttgtttcaaaaattttggagatagagtgaagttgtgggcaacaatgaatgagccatggatttttacatcaacgggttatgattctggttctttagcacctgggcggtgttcagcctggatgaacaataattgcacaatcggtaactctggcactgagccttatatagctggacataacatacttcttgctcatgctgctgcttccaaactatacaggcaaaaatataagccaattcaaaagggtcaaataggaacaattgtagtgtcacattggtttgagcctgcctccaacaaaccagaagatataaaagcatctataagagcccttgattttatgcttggatggtttatgcacccattgacttatggagattatccaacaagtatgagaaaacttgttggcaagagattaccaaagtttaccccaaaagaatcaatgttggtgaaagactcatgtgattttataggattgaattattacacctctaattttgcagctcatatttctaaaccaccaaatactgtcaatattagttcaggaactgataatctagtcaatcaaacaacatcgctgaacggaaagttaattggtgatccaactggtgtgagcatattttatgttgctccaaagggactttataagcttcttgtttatattaagaaattttacaagaatccaattgtttacattacagaatgtggaatgggtgaatccaatattgatgatgttgcaaagggtattaatgatgctcagagggttgatttctaccaacgccatattaaggctctttatagggcgtttagggagggagtacatgtaaaggggttctttgcatggtcattttatgacaattttgaatggggatcaggatacacacagagatttggtatcaattttgtagattacaaaaataacctcaagagatatcctaagcgttctgctctttggatgaagaaattccttctcaaataaaattatttgtacgtgtagaatctaatcaagtgtgggtaccaaa

SEQ ID NO: 456 - DNA, 455 bp, Solanum lycopersicum
aaaatatgggtttaaaaggtaagttgattgcttcagtggagatgaagtgtggagaaggctcatttttcgatatttttcacatcaatactaatcaggtacccaatataagtcctaaaaatatcgtccattttggaattcacgaaggtgaaagcgttaaggctggttcgattgttagttggaaatacaacgaagctggacaagaaatgtatatgaagcacttaattgaagctgccgatcctcagcagaaattaatcaaatggaaagttatcgaaggagatttattgaagttgtataaatactgtaattttacaacatcttgtgatggccagtggactacttggacaattgactacgaaaagaaaactgaagataccccagaacccctccttcacttgggtgttatccttgccatgaccaaggatatagaaagtcaccttctcaagaaataatgttaa

SEQ ID NO: 457 - DNA, 777 bp, Solanum lycopersicum
cattccatttccatcatactaccaaaaaagcaaaagctaaagaaaaaaaaaagcaaaaaaaaagaagacaaagtttaaagagagagaattcaaacaagaagaagggttttctatctttgtggaaaaaaaaaataagaaaaaaaaatgcagaatcaacaacagctacagacactgatgcaagcaggtcagatttcagggagtttgagttttaatggtaatttaagtaaagaagatgaagaaatgtcaaaatctgcactttcaacttttaaagctaaggaagaagagattgaaaaaaagaaactcgaggttaaggagaaagttcaagctcagttgggtcgtattgaagaggaaactagacgtttagctattattcgtgaggaactagaagcattagcagatccaatgaagaaagaagtttcaacggttcgaaaaaggattgatattgtcaacaaggagttaaaacccctgggccagacttgccagaagaaggagagagaatacaaagaagctctcgaggccttcaacgaaaaacacaaggaaaaagtacaacttatatcaagattgatggagctggtgggtgaaagcgagaaaatgaggatgaagaagttggaggagctgagcaagagtgtagaaacgatccattgaaagataaatcaccttaaaaaagctcatcagtgacgactaattaggcttgtgtgatatatttaagatctataatcgaaatttctgtttattatatggttgttttcgcgtttggtgggtgtattctttcttcct

SEQ ID NO: 458 - DNA, 1151 bp, Solanum lycopersicum
aaaggatccttatctctgttgctgtgggaagaaaactaagtgttttctgagttagtagtctgtgaggatgatgaatagtgaacgattagcaaatgttgctttagcaggtttgagtttggccccactggttgtgaatgtggacccaaatttgaatgtcgtgctaacggcttgtctcactgtttttgtgggttgctaccgttctgttaagcctactccacctacggagacaatgtctaaggaacatgcaatgagattccccttggttggaagtgcaatgctcttgtcattgttcttgctttttaagttcctctcaaaagacctggttaatgctgtattgacgtgctacttttttgtacttggcattgctgcttttgctgcaacactgttacctgctatcaaacgattcttgccggaaaagtggaatgaagatctcgtaatatggcacttcccatatttccgctctttggagtttgagttcacaaggtcccagattgttgctgcaattcctggaaccatgttctgtgtatggtatgctaaacagaagcattggctagctaacaatgtattgggccttgcattttctattcaggggattgaaatgctttcccttggatcatttaagactggtgccatactattggctggactttttgtgtatgacatcttttgggtcttttttaccccagtgatggttagtgttgctaagtcttttgatgctcctatcaagcttttgttccccacagcggatttgaaacgtcccttttcaatgttgggtctcggagatattgtaattcctggcatttttgtggctttggcactccgctttgatgtctccagaggaaaggggcctcaatactttataagtgcattttcgggatacgctgttggtgtgatttcaaccattattgtgatgaactggtttcaagctgcacagcccgcgttgttgtatattgttccagctgtaattggatttgtggctgtgcactgcatttggaatggggatatgaagccgttgttggagttcgatgagtcgaaaacacagagcactgaagaagtcgccgcggaagagagcaagaaagtagagtgaggctttaagaagagttacagtagggatatatgaccttccaactgatgcagagattggtaccttt

SEQ ID NO: 459 - DNA, 996 bp, Solanum lycopersicum
caacccacatcaagattcatcaatttaacttcaatttcacaaaagaaaatttaaaatttgattaaaaatggtgaaacccaattcgaaagatactgaattttcacagtcgtcatcgtcgtcgttgtatcggggagtacggaagaggaaatgggggaaatgggtatcggaaattagattacctaatagtagagaaaggatttggttgggttcttatgatacgccggaaaaagctgctaaagcatttgacgccgcacttttttgtttgcggggtaaaggggctaatttcaatttcccggaaaatccgccggagattaggaacggaaggacgatgactccgtcggagattcaatcggcggcggcgcagtttgcgaataatacagaacccgaacttatccgggtcgggccaagggagaattcggatctttcttcttcctcatcggaaatatttcgagcggaatcaccgtcggtgtcagtttccgatagagtagaaagtgaaaagacggaaataaccttgggtaacgattttatcgatgtgtatcgggtggagtctagagtggaaagtgaaaagacggaaatgtccttggataacggatttgttgacatgttttcgtcgttaggaacggttaatgatatgtctgattttggaatttttccggggttcgatgacttatcgggtgaattttttataccaccaccatcgtcaccacaaccatcaccactgcaaatgcctaatttggaatcattagaagaagagaattatttgaactatgatggatttcaatcacaggggacttcatttctttggaatttttgaaggatataaaaatgttacattatattcattaatggttaataatataagtttataaaattagaaatagtactaaaaattagtattaagtaggattaagagaacttatttgaattttaaaacttcatttgatgattttgtagacaattctagacatttttttggttgctagaattgttacaaca

SEQ ID NO: 460 - DNA, 443 bp, Solanum lycopersicum
ggttcaaagaggagatcgtcactgtagaggttcaatttttatggtagcagagaaaaaatggctgctcaagaggaagttaaacaactggcagagtgctcagtctccaatgctctggggacatgggttttctctgtagctggtgccctgcttgcgattccagtgggtattaaacggaaatctttggcaccccttgtattctttggcacaactggtacgatgctagacataattatgggtatcagtgcttgtgaaagggagcatgcagaacggcaaatgaagcttttggaagaagcacaaggatctgtagctgttgataccttgactgatgcagcaactgaacattgatggcattcaggtcgctctggattttgtcttcaactaatagctgaggttcatgacttcatgtagcattttgagtactgttggccttcagtttctgcttt

SEQ ID NO: 461 - DNA, 382 bp, Solanum lycopersicum
tcagaaattctcttgctccgactccgatctcgatatcataataagcaatggctcgttctttctctaactctaagactctctctgctttcgtctccgactccgtttctgcttttctcagcaggcgtggatatgcagcggcatcacaaggtgcagtttccggtgtagcaaaaggagtgccaaggagcaacgtgatgatgcaaaaaagtggagaggaatcggtgaagacttcatgggtgccagatccagttaccggttactataggccggaaggacaagcaaatgagattgacgctgctgagctccggaagatgctgttgaaacacagatctggaagcaactgaaaatctttgaagctgcgccgttgatctgcggttaatcatcg

SEQ ID NO: 462 - DNA, 692 bp, Triticum aestivum
aaaggatccatctccgtcgatccaccacaccctgcaatggcgtccgcgctcaccaacgtgagcctgtctaccttcgcgcccacggccaggggcgacgtcctcgccaggcctcaggtggccgccgcccgcgtcaccttcccgacggcgtaccgtggcagcggtgccctctcctgcagggcgggtgggccggccacgccgccgggcatctccgacaagatgtcggacagcatcaaggaggcccaggagacgtgctcggaggacgccgccagcggggagtgcgcggcggcgtgggacgaggtggaggagctcagcgccgccgccagccacgcccgggacaagctcaaggactccgacccgctcgagaactactgcaaggagaaccccgagaccgacgagtgccgcacctacgacagctgagcgtacgtgctaatttgttctggacggcggatagtgaaggtggacgtggtgttcttggctcatgggagcccgagaaaacctactatgtctcaacctaccgttacttacacgatcgggatgtatgtagtaaaaacgcgccaaatattttcccagggacatacgtggttgatatacaattgatattacagacgtttatttaaagttgtattatggatgtgtgcatgggtatggtgtagaggcgagtgtctggtcgtccttttccattaggtaccttt

SEQ ID NO: 463 - DNA, 1752 bp, Triticum aestivum
ctgctccgtctgaatcttcttcttcttctcgccggttgacggtcgcgacggcggccatggatcccaacagcttcaaaaccggaggccttctgcttccaaccatcgagaggcgctgcgcttcgcctccatctgtgatcgtgatcggcggcggaatctcagggatcgccgcggctcgtgtcctctccaattcctctttcgaggtgactgtccttgagtcgagagatcgaatcggtggccgtgttcatacggattactcctttggatgccccattgacatgggagcctcatggttgcacggtgtcagcaatgagaattctttagcaccactgataggccatcttgggctgagattataccacactagtggcgacaactctgttctgtatgatcacgatttggaaagctgttcgctctttgataagaacggcgttgcagtcccaatggagacggctgctaaagttggcgtgatatttgagaaaattctcaaggagacggtgaaactccgcgacgagcaggaacatgacatgccccttgaacaggcaatttcaatggttcttgagaggcaccctgatctcaagctagaagggctagatgatcggatcctgcaatggtgcgtctgccggctggaggcatggtttgctgcagatgcagatgaaatatctctgaagaactgggatcaggaacatgttctcactggtggccatggcctgatggttgatggatactttccagtaattcaggctctcgctcaaggtcttgacatccgtctgaatcagagagtgaagaaaattacacgccagcacaagggagtgacggtcaccatcgaggacggcacgcaatactcggccgacgcctgcataatcactgtgccgctcggtgtgctgaaggcgaacataatcaagttcgagccagagctgccatcctggaagagctcggccatcgccgaccttggcgtcggcatagaaaacaaggtcgccatgcacttcgacaaggccttctggccgaatgtgcaggtgctgggcatggtcggcccgacgcccaagacgtgcggctacttcctgaacctccacaaggccaccggccacccggtgctggtcttcatggccgccggtcggttcgcccaggatgtggagaagctctcagacaaggaggcggtggaactcgtcatgtgtcacctgaggaagatgatacccgacgccactgaacccactcagtacctggtgtcgcggtggggctcggacccgaactctttggggtcctactcgtgcgacctggtgggcaagccgtcggacgtgtgcgagaggttctcggcgccggtggagagcgtgctgtacttcgccggagaggcggccagcgcggagcactcgggggctgtgcacggcgcgtactcgtcaggcatggacgccgcagaggaatgccggaggaggctgctgatgagcaagggcgtgcctgacctcatccaggtcggcgccgcggcgtgcgaggagatggcggacgtcgtcgcccctctccagatttgccgcacctagggatgacgatgattcttcgttacagccgcgttctgccatgccggattgatttgatgattgacagaagccgatcagtgtgcagtcgatcagtccgagtcggcagaacgcaagatttgaaattcagttttcttctttacatttctaattttctcggaatgcttgggatcaagaaacatttgatcgatgcctgcctgctgtgcactctgggcactggatttatagc

SEQ ID NO: 464 - DNA, 1571 bp, Triticum aestivum
acctcacctcatcgcagtttcatcacaaatccaaaacaaaacgtctccgccgacgacccgcatccgatagcccccttctccgcgccttctccggcgagaagcacccacaacggtctcaccggcggccatgccggctacggactaccagggctcctcctcctcctcccactccccgttcgcctccttcggccgctcgctgctgtctcgaagccgggacaccccggcgtcccccgccatgcttccgtccggcggggaggccgaggtcgaggcgttccagcggcacgtggccgttagcctcgcggagctgagggacggggaggatttcctctccatcgcgtggatccggcagctcctcgaggcgttcctgctgtgccaggaggagtttcgggcggtggcggccgaagtgcggcgccgcggctgtggaggcgcgctggcggagaggctggtgggcgagtaccacgagcgcgcggtgaaggcgctcgacgtgtgcaacgccgcccgcgacggggttgaccaggtccggcgctgggggcggctcgccggcatcgcggcgtccgtgctgctcgcccccgaggagatccacgagggccagctccgccgcgcgaggaaggcgctgtccgacctctcgatcctcctcgtcgacgacgcggccgccgccgggggcgggggcggcgtcgcctccttcctggcctcacaccgcaaccgctccttcggccgcgggagccgcgcgtccccgtctcgcgcgtcctccgcctcctcctcgtcgtcctcctcctcgcacttccgctcgctctcgtggagcgtgtcccgcacgtggtcggcgtcgcggcagctgcaggccatcgggtccggcctggccgcgccgcgcgcgcacgaggcgggcctcgccgcgcccgtgtacgcaatgggatgcctgctgcacctcgcctcgtgggcgctcgtcgcggccgtcccgtgcccggaccgcgtcgcggcgctccaagcgcaccacctccccgcggcaccgccgcgtggggcattcgcgtgggcgccgccgctcctgacgctccaggaccgcctcaccgaggagggaaagcgcaaggacaggcgcaattcctgcggcctcctcaaggaaatccacgcgctcgagaagtgcgcacagaggctcgccgaggcgatcgacgcagcgcccatcccgctcaccggagagagggaggccgcggtgcgggaggccgccgcggagcttgccgccgtatgcagcgccatgaaggacggcctggagccgctggaaaggcaggtccgggaggtgttccaccgcattgtgcgcagccgcatggagggcctcgactcgccgatgcccaacgccgccgactgaaccatcaagaatccgcattttggccgcgcgctgcggcggcgataggtagcctcctgtccgtggtttttgatcacccgtgatctgtctcgcagtcagtagtagcaagtttaaaatgtgtatccttctgtaaaggaaaggggaaagggaaggaaccatctttctgcaaagatttattccttcttctcatgttttgatgctgcatttggtgtgtatcatc

SEQ ID NO: 465 - DNA, 1557 bp, Triticum aestivum
tagagagggaggcgacgagcgatggcggctgggacgggcagggtcctgccgctgctggccgtggcggcggcgctcgccgccgcgctcctctacacggcgcccttctccaagagcctgggcggggaggggtgcagcctgctcccgcacggccacttctggatcgccagccagcgggtcgtcgcgctcggccgcgtcggccccgccgcagtggaggtgaaggaaggtctgatcaacgccatcgccgtcggggactaccggagcttcgtgctccgccgcccgctcgtcgactacggggacgccgtcatcatgcccggcctcatcgacgtgcacgcgcatctggacgagcctggacgggaggagtgggagggcttctccaccggcacaagagcggcggccgcaggtggcataactacgttggtggacatgcctctcaacagcttcccttccacggtgtcagaagaaactctcaaactcaaggtggatgcagctcgagataagctatatgttgatgtcgggttttggggaggccttgtacccgagaacgccttgaacccaagcaaattggagagtctactgaatgcaggagtgttaggacttaagtcttttatgtgcccctctggtatcaacgacttccccatgacaaattcaactcacatcgaggagggcctcgttacattggcaaagtacaaaaggcccttacttatccacgcagaacgcataccggatgtgtcgagtgatgaggagcttgatggcgaattagatcctcgatcatacgcaacatacctgaagtctagaactccagcatgggaggaatcagccgttagagatttgaaccgtgccatgaaggacaccgaggttggaggccggtcagaaggagctcatcttcacatcgtccatctctcagattcaaaaactaccctcgaccttctgaaggatgcaaaacacagcggcgcaaaagtcactatagaaacctgtcctcattacctcgcattttcggccgaggaagttccagatggggacactcgtttcaagtgctctcctcccatacgtgacgccgccaacaaggaaaacctctgggaggccctgcttgatggtcacatcgacatgctcagttcagaccactcgccctcgactcctgatctcaagctaatggaggaaggcaatttcatgaaggcatggggaggtatctcatctctgcagtttgtcctcccagtaacatggtcacatgggaaaaagtatggcatcaccctgaaccagctagcctcatggtggagcgagaagcccgctgagctcgcggggcagaagaacaaggggtctattctgccggggtaccatgccgacattgtggtgtggaaacccgaggcgcagttccacctcgatgacacccatgctgtatatcacaaacaccggaacatctcggcttacctagggaaggagctatccggcaaggtcctgtcgacgttcgtgagggggaacctggtgtttgccgaagggaagcacgccggggccgcctgcggcgccaccatcctcgccaagtgaaacagtagagctacataa

SEQ ID NO: 466 - DNA, 949 bp, Triticum aestivum
caagaaatccacagaaaccgagatctctctctctctccgccccgacggatcccgggttgttgttgtagctgggcaatggcgaccgacgcgatcctggagaccatcaagcctcggcggagcccgtggctggaggacctcccggtgacgaatgggggcgcagcgaagggcggcaaggtcgacctgtccgggatgcgccggcgcgtgtcgtcgtccttgtcactgagcctccagccgctgtcctcgtcgtcgtccgcggcgttccggcgcgcgcggtcgatgccgtcgatcaaggcgctggcggcggcgggcgcggtgcggcagtggtgggagtgggggctcgggtgggtgatgacccggaagccctccttcgcgcgtggcctcaagatgagcgaggacgaggccgccctgctcgggtgccactgccgcggcacgctccggcacgtcttctacaaggcacgcgccgaggtgcgccgcctcctcggccgcgacggccgcccgctcggaggcgtcgccgcgcaggacttcaggtacgactccgtcagctacgcccagaacttcgacaacggcgacgtcgacgccagatgctagccgctgcgcctgcgcacgcgtggattcgaacgccgccattcgtgccgaaagtgaaggtataggttcgatcgatggctacgaagtatatcttcttggacggggcaataaaccgaattgtttgcaagatactagcagcatatagcacggcgtttgtgtgtgtgtgtgtgtgttgtctgaacgatcgcagatgatccagcagcgagtgatgcgcactgttcagggaccagatgtatatttcttccactcttctttcttgtgtttttccgagtcttttcttggatacatccgtccctacaatgtaatgtagcccgtggatcttgagctggcaaaatgtacatgttctgtaacacattgcaaatgc

SEQ ID NO: 467 - DNA, 1704 bp, Triticum aestivum
cacgcaaacccaacgaacgcgccgcgccgcgccgcgctgagaaacccccgaggaacgacgaccccaggagcaggcccccattgcggcatggctgcggccgccgacgtcgggcagctcgctggcgccgccgcggccacgctcctcgcggcggtgctcttcgccgccgcgctggggcgccagcgccagcgccgccgccgcggggctccggtcgaagggatccccgcgccggacgacggctgcgcggtcgccgacggcgcagggagcgcggccgtggacggcccgacggacgtcatcatcgtcggagccggggtcgccggatctgccctcgcgtacacgctcggaaaggatggtagacgggtgcatgttatagagagagacctgacagagccagatagaattgtgggcgaattgttacaacctggaggctacctgaaattgatggaattgggtctgcaggactgcgttgatgaaattgatgcacagcgtgtccttggttacgcgttgttcaaagatgggaagaacacaaaactttcttaccccttggagaagttccattcagatgtggctggcaggagctttcacaatggacggtttattcagaggatgcgtgaaaaagctgcgtcgttacccaatgtccaactggagcaaggaacagttacatctttgcttgaagaaaatggtacagttaagggtgtgcaatacaagatcaagtcaggtgaagaactaaaggcttatgcaccattgacaattgtatgtgatggctgcttttcgaacttaagacgtgccctttgctctccaaaggttgaggtgccgtcttgctttgttggcctggtcctggagaattgtgaacttcctcatgcgaaccatggccatgttatcttggccaatccttctcccatcctattttacccgataagcagcaccgaggttcgctgtttggtagatgtccctggtcagaaggtgccttccatagcaagtggtgaaatggcaaattatctcaagaccgtggttgcacctcagattcctccacaaatctatgattcttttatagcagcaattgataagggaagcataagaacaatgccaaataggagcatgccagctgcaccacatccaacacctggtgcacttttgatgggagatgctttcaatatgcgacaccctttaacaggtggaggaatgactgttgcattatcagatatagtcgtcctgcgtaatcttctcaagcctcttcgcaatctgcatgatgcctctgccctctgcaaatacctagagtcattctatactctgcggaagccggttgcttctacaataaacacattggctggtgctctatacaaagtcttcagttcctcgcctgacaaggctagggacgagatgcgccaagcttgctttgattacttaagccttggaggtgtctgttcaaatgggcccattgctctactctctggtcttaatcctcggccattgagtttggttgcacacttctttgctgttgctatctttggtgttggacggctgatgctcccccttccttcacctaaacgaatgtggaccggagcgagattgatttcgggtgcatgtggtatcatcttcccaatcatcaaagctgaaggtgtgaggcaaatgttcttccctgctaccgtccccgcgtattaccgtgcacctcctgaagcagagttctgatctacgaaggtgcagtaa

SEQ ID NO: 468 - DNA, 1040 bp, Zea mays
cagagatgaatgtagcggtgccaccacaatctccacatcttcgtctatatgactttgccaagagtgccatcatcaaaatttttgcctttccttatgctacggtctgtgacctgtattgcgacggtggaatggatacagacaagtggtgtgatgcccaggttggccactacataggcatcgatgcctctgcatcgggtgtcaactatgcccgtgagctatgggagaacaggaggaaacctttcactgctgaattcatcgagttggatccttctgatgatggttttgaagctcaagtgcaggaaaagggcatccaagcagatatggtttgctgtatgcagcacttgcagttatgctttgagaatgaagaacaggcaaagaagcttctgaacaatgtatcatcacttctcaaacctggaggctacttctttggcataactccagattcatctacaatatggacaaaatatcaaaagaatgttgaggcttcacataataagggtttgaagactgttccaaatagcattcgctcagagaactataccattacctttgaagtcgaggaagagaagtttcccttttttggaaagaagtatcaactcaaattcgcgagtgacgcggtgtttgagaatcagtgcctggtccactttcccacccttatgagattatcaagggaagctggacttgaatatgtggagatccagaatttaaccgagttttatgatgataacagaacacaattcgctccaatgcttggtggttacggtgcaagttttttggatgctcgagggaagcttgttgctcgttcctacgacattttaggcttgtattcagcatttgtgttccagaagcctgatccagaggcaataccaccgattgtaactcccgacttgcctgatcctgataaaggtcacgaagaggagtggctccagccacagcaggcgtcagtggaagatgggagacgctcgcatgcggatgtgcttcccatagaccctgagaaaggcatcctgggtcctggacctgcagacatgaggctttagtag

SEQ ID NO: 469 - DNA, 1448 bp, Zea mays
ccttgctcattggctagggcggggaaggaaattgcgggaggatgcgaagccattggtgtattgcatatggtggcaccaagcatgaggcaggaactgcattacttgcaagaaagtcacaagctcattccaatctgattctctaaactttggaggtctcttacacctaggcctgaaagctcctctcccattagttgcctacaacattggaaaagagtttctcacattatcttagaatccattgcaagatcatacttgtggctttcttgcaagttgtgcagttgttgcctcaagcttgctgcctccctttgccagagctatcggtaaaacaggaagtccctagaaaggaaaatcgtgatttggaaaggaaattcatcaacaaacctgatcggaaggatgcttaggaagcgggtactccctatgttccagattatagttcatttagatttgatgattcaatcaattatttctggggtggtctacagccaatgcatagtctctatctgtgtgtgtgttttgtgtttcccgtgcactctattcctttcgagaggcactctatgtcaggtgcctgaaatatggtttagcttcaggcaatgaagtggacgtcggatggagatccgagtgtccacgatgacagagaccgggttttgaatctctcgtctctccatctctcatgcgttcccaacttccaactccaatgccgtctccgctggctgatcagtgatcacctctgaccctctctggtgatgtgtacccattgttaatctctccaatgaagctaccctgcctgaccaggcccacaggctgtctcctgcatacggtggcaacacaccaacactgctggcctgccctaagacacatcttcgcgttgcgtccactggatacctgctttcttagtcagcagcatgccgaaaccctccatttgtgaaacctcagcggtgataggcggtggttgtcgaacgctggcatgaaggtgtgagctcccaactgctgaatcgtgttcctcttttacatgcacgtgtccaacaagaaccaagaaccgagattagcgctacctcagtacactgccggtgcaagataaacgaaggaagctgggattgcatggcactgcggtctgttatgtagccgtggaacagcaagacaaaaagacatggatattccttgtttggattggggtgtttgatccagaaacagtctcattgctaattgtttcattattactacaaatcttggtcgaggcgtgaatatccttgctcttgatataattatagtattttgaatccctattgtgttttttacttaagtgataaatgttgcaaagaaaccattagataattgttgaatgattagttattgattacattgattgattttgatttaatgaatcttaaataaaccagaagattcatgtgtatgaatatttgtgttgggaatttcttggtcacatgttt

SEQ ID NO: 470 - protein, 526 aa, Arabidopsis thaliana
MDPWSWICELPEDPEFSESDSHAVFQLAGDLTRSIKLRAERTLGSDQESHSLTFTVVAEGFNLLKSSTIWVSNTCPLSSEKPFLPLVLQLLQELITRSPTTHDGACTKFEQLEIKPSPVSWVMDSHSPESFSSVFNLILLTRLFWLCVFDAPSEVGSFFFQHLLGPHVNALTCQHAPVLRTFLVSLGVDAELCIVRAASYALSKWMISKEIGLGNLGLKQFSSSLMPRHSLGFSYATEAHGLWILKGYFPILSMNVTNNSSNEVHNKIVKFPFVEPKEAVLRYALSHQQAEILVQFEYSVKFYENYIKVNARVDNIRIHVSKLGFHKGGVGVENQIADCYSEERYFPSRVRVWLGPELGSSHVSGLSLGRSTKNEERDIEVTRVLKGNFGKGKVAPRVKARARMATKRKVKDWRIEQESEGNAAVFDAVLYDRESGQEVTTVKPKPNQEGLKNVFTKSGGMVFGRDEYGDEVGWRVGREMEGSVLKWRLGGKIWLTYWPNKLNTLFYETRCVEWCDEVDLPLLPTS

SEQ ID NO: 471 - protein, 190 aa, Arabidopsis thaliana
MKNGNRKTTPETEKSHRRKLSEKAMSFHGRGTTPLSNPGELRRPKTLPELFSTGQSITVPETVSLPPRLTKLLLNVTVQGSLGAVQIIISPESTVSDLIDAAVRQYVKEARRPFLPESEPSRFDLHYSQFSLESIVRDEKLISLGSRNFFLCGRKETGGFIGCGLSSESCSKEAEKVAKTGFHWLKFMGF

SEQ ID NO: 472 - protein, 511 aa, Arabidopsis thaliana
MEITTIIFLIISSLTFSIFLKLIFFFSTHKLPPGPPRFPVIGNIIWLKKNNFSDFQGVLRDLASRHGPIITLHVGSKPSIWVTDRSLAHQALVQNGAVFSDRSLALPTTKVITSNQHDIHSSVYGSLWRTLRRNLTSEILQPSRVKAHAPSRKWSLEILVDLFETEQREKGHISDALDHLRHAMFYLLALMCFGEKLRKEEIREIEEAQYQMLISYTKFSVLNIFPSVTKFLLRRKWKEFLELRKSQESVILRYVNARSKETTGDVLCYVDTLLNLEIPTEEKEGGKKRKLSDSEIVSLCSEFLNAATDPTATSMQWIMAIMVKYPEIQRKVYEEMKTVFAGEEEEREEIREEDLGKLSYLKAVILECLRRHPPGHYLSYHKVTHDTVLGGFLIPRQGTINFMVGEMGRDPKIWEDPLTFKPERFLENGEACDFDMTGTREIKMMPFGAGRRMCPGYALSLLHLEYYVANLVWKFEWKCVEGEEVDLSEKQQFITMVMKNPFKANIYPRRK

SEQ ID NO: 473 - protein, 132 aa, Arabidopsis thaliana
MTSGGDDKNRSVVTDHQHQQQPPPPFQGVSNYPPQQQPPATGYPQPAQPYAQGYVVNGVRPTEHGRCCGIGIGWVLFILGFFFALPWYIGFFLLLFSRNPRERPGYIACAVGAVFATIIVIFGTVRGSGVWS

SEQ ID NO: 474 - protein, 301 aa, Arabidopsis thaliana
MAGTCTSIRPRLIGSSSIVELSRLINRAGVPFSVRFSTRTRALHGGGLTAPTSREEGPSCIFVGPIDSARKETLEALYRQAKDAYYNGKPLIVDDMFDRVELKLRWYGSKSVVKYPRCSLLRQSTYADAEDDASQVLLLATVWIMIFLFGSSACVLPTIYGVGLVYGGDPFDSGLVYSSQLSSSVPILSKFNGILLSVLGPAFGYPIASSAVRVLKGLWRNDLTALKGDCPNCGEEVFAFVRSDQSNRSAHKADCHVCECTLEFRTKVEVDKSASRLGRKWVYGRIYLVSRPRRDRRSKFT

SEQ ID NO: 475 - protein, 306 aa, Arabidopsis thaliana
MERSLKKTKNNYNNSIKSNLMKDDELFHVIHKVPCGDTPYVRAKHAQLIEKNPEMAIVWFWKAINTGDRVDSALKDMAVVMKQLDRSEEAIEAIKSFRPRCSKNSQDSLDNVLIDLYKKCGRMEEQVELLKRKLRQIYQGEAFNGKPTKTARSHGKKFQVTVQQEISRLLGNLGWAYMQQAKYLSAEAVYRKAQMVEPDANKSCNLAMCLIKQGRFEEGRLVLDDVLEYRVLGADDCRTRQRAEELLSELESSLPRMRDAEMEDVLGNILDDDFVLGLEEMTSTSFKSKRLPIFEQISSFRNTLVC

SEQ ID NO: 476 - protein, 955 aa, Hordeum vulgare
MDDSENNAPSTPGSPGFSTDRLPPNTTTSRGATDPSSYSDDDGEAEVDPNVLPEDDGATVIRDEEEDDGEDLFNDDYLNDYRRMDEQDHYESVGLDDSIEDERNLDEIMADRRAAEAELHARDVRTGATSDRKLPRMLHDQDTDEDMNFRRPKRHRANFRQPTGGPRTPRSDDDGDGLTPSSPGRSQPYSGGDVPMTDQTDDDGYEDEFDEEDEMNMYRVQGTLREWVTRDEVRRFIAKKFKEFLLTYVNPKNEQGEFEYVRLINEMVLANKCSLEIDYKQFIYIHPNIAIWLADAPQSVLEVMEEVGKNVVFDLHKNYRNIHQKIYVRITNLPVYDQIRNIRQIHLNTMIRIGGVVTRRSGVFPQLQQVKYDCSKCGTVLGPFFQNSYTEVRVGSCPECQSKGPFTVNIEQTIYRNYQKLTLQESPGIVPAGRLPRYKEVILLNDLIDCARPGEEIEVTGIYTNNFDLSLNTKNGFPVFATVVEANYVSKKQDLFSAYKLTDEDKAEIEKLSKDPRISERIVKSIAPSIYGHEDIKTAIALAMFGGQEKNVKGKHRLRGDINCLLLGDPGTAKSQFLKYVEKTGHRAVYTTGKGASAVGLTAAVHKDPVTREWTLEGGALVLADRGICLIDEFDKMNDQDRVSIHEAMEQQSISISKAGIVTSLQARCSVIAAANPVGGRYDSSKTFTQNVELTDPIISRFDVLCVVKDIVDPFTDEMLARFVVDSHARSQPKGANLEDRVAADEEDDPLTVARNADPDILSQDMLKKYITYAKLNVFPKIHDADLDKISHVYAELRRESSHGQGVPIAVRHIESIIRMSEAHAKMHLRSYVSQEDVDMAIRVLLDSFISTQKFGVQKALQKNFRKYMTYKKDYNELLLLLLRTLVKEALHFEEIVSGSTTRLTHVEVKVDDLKNKAQEYEIYDLRPFFSSSHFNDNSFVLDEGRGIIKHPVAA

SEQ ID NO: 477 - protein, 257 aa, Hordeum vulgare
MTKAFYAVGLWIRETGQALDRLGCRLQGNYFFHEQISRHRTLMNIFDKAPHVHKEAFVAPSASLIGDVEVGPGSSIWYGCVLRGDANNVQVGSGTNIQDNSVVHVAKSNLSGKVFPTIIGDNVTVGHSAVLQGCTVEDEAFVGMGATLLDGVVVEKHGMVAAGALVRQNTRIPCGEVWGGNPAKFLRKLTDEEIGFIGESSANYSNLARAHAVESAKPMEKIDFEKVLRKKFAHQVLLSVTQEVPPELPPPSPTPAQ

SEQ ID NO: 478 - protein, 374 aa, Hordeum vulgare
MARSAMSGLVLLLLCATCRLALGITDGLLANGNFERGPQPSQLRGTQVVGASSIPSWRTSGFVEYIPSGQKQGDMVLVVPEGAYAVRLGNEASIAQRLRGAVPGARYSLTFSAARTCAQAERLNVSASGQSGVLVMQTMYSSNGWDSYSWAWDASADEVEVVVHNPGVTEDPACGPLIDSVAIKTLTPPRRTNKNLVKNGDFEEGPYIIPGTKWGVLIPSRTVDEHSPLPGWMVESLKAVKYIDSDHFAVPRGRRAVELLAGRESAIAQVIRTVPGKQYALSFSVGDASNTCRGSLMVEAYAGRESAKVPYESAGQGGAAKRAVLPFRATSPRTRVVFFSSFYNTRTDDMSSLCGPVIDDVAVVSVRARHPKRA

SEQ ID NO: 479 - protein, 430 aa, Hordeum vulgare
MAAITAAFLLLLAATVAAAADLSVYHNVHPPSASPLESIISLARDDDARLLFLSSKAASTGVTSAPVASGQTPPSYVVRAGLGSPAQPVLLALDTSADATWAHCSPCGTCPTNSLFVPANSSSYAPLPCSSSMCSILQGQPCPDRDPYDSAAPLPSCAFSKPFADASFQAELASDWLHLGKDSIPNYAFGCVGSVSGPTSNLPKQGLLGLGRGPMALLSQVGNMYNGVFSYCLPSYKSYYFSGSLRLGTAGQPRAARYTPMLKNPHRSSLYYVNVTGLSVGRSPVKVPAGSFAFDPSTGAGTVVDSGTVITRWTAPVYAALREEFRRHVAAPSGYTSLGAFDTCFNTDEVAAGGAPAVTIHMDGGVDLALPMENTLIHSSATPLACLAMAEAPQNVNSVVNVVANLQQQNLRIVFDVANSRVGFARESCN

SEQ ID NO: 480 - protein, 486 aa, Hordeum vulgare
MAPLITADVVVEAAPAPSMAVLNQLVCASAPTPTIAVVSKHLVLPEGAQPVGDLKLSVSDMPMLSCHYIQKGLFFTPAGMPTARLVKSLLLSLSRALGVFPALAGRLVTLPDDRIVIRCDDAAVEFYHAVAPALSLADFLVPDADVPTRLTKDLFPMDRVVSYEGHRRPLTSFQVTVLGDGAVFVGLVANHAVVDGTSFWHFFNTWAGLCRGEPVQPPDFSRNFFGGSTAVLRFSGRDGPAVTFDAAAPLRERVIHFSAAAIRDLKAAANRCRKTNEDDEVNGKLEHDLKVQGGGGQISSFQSMCAHMWRAVTRARLQLTADATTTFRMAVNCRHRLRPKISPVYFGNAIQSVATTATVAELASHDLGWAAARLHATVVAHEDGAIRQAAADWEAAPRCFPLGNPDGAALTMGSSPRFPMYDGNDFGWGRAVAVRSGRANKFDGKMSAFPGQAGDGSVDVEVCLAPDTMGRLLSDDEFLQFVSHAP

SEQ ID NO: 481 - protein, 328 aa, Hordeum vulgare
MGDLGVRVVGRGCTAPMEPRKEMAPPPPMEQHHPPLFMDFSRRDGVADGGNVRKRPREAVAPPARLFSLQASQGSPGHKVIHLAQLHRRPAATGLRLDFDEGGSEHVACTSSSPSSVLPGELAAQCGQYSNEIDRLLQEHAERLRLALADTRRRQNRSLLGAAEALAARRVREMGAETFKAARRGVELEEQLARLRAEAASWQAKAMSDQSTAAALHAQLQQAAATAQARSGKAALDDDGAAGAADDAESGFVDPDRVVEVIAPPPAARPCRACRLRPASTVLLPCRHLCVCDACDPGVPAALAGTASAAACPACRCPVTGTVQVFFA

SEQ ID NO: 482 - protein, 537 aa, Hordeum vulgare
MGESLLTALSMDTATAHHPHQGPSTFLSMDTASHDEFDLFLPPPGPFQRCLHAAAAAPPDINLPLAADPSPPPPAMQTTTLHESNVDMLDVGLGCPQLYDSDSPAAAAAATSAPVSTTTTVHVSHTKSSGSSAARKCVKRNDSIWGAWFFFTHYFKPVMSADKSSKTKAPTAAGNGNSATLDAFLVQHDMENMYMWVFKDRPENALGKMQLRSFMNGHSRLGEPQFPFSADKGFVRSHRMQRKHYRGLSNPQCLHGIEIVRTPNLVGVPEADMKRWFELTGRDANFSVPTEADDFESWRNLPTTEFELERPATAAPAKSTSHGHHKKVLNGSGLNLSTHASKHGSGDGLDISGVCNKRRKDSSPSAMEEDCSNSNSDKVQDMDVSHTFEPSWNNDFTGVMRHASGPVTAAKTIYEDSKGYLIIISLPFADIQKVKVTWKNTLTNGVVKISCTSVGRMPFLKRHDRTFKLTDPSPEHCPPGEFIREVPLPTRIPEDATLEAYCDESGTGLEIIVPKHRAGPEEHEVHVSLRPPSSWCQ

SEQ ID NO: 483 - protein, 177 aa, Hordeum vulgare
MDSGSESDGAPEELTAVQGVEKHEEISKVEKDSAVRATQEEKDRRKRWAQRKTSSNPKKKKPLKVEDKDTEVDEETRAMPGTLPKSVIEMLAAREKQTFTSDSEEENVSQKVQKKKKRLKTTITGPETILLKDVRSTEHIKKALEFLNHRKNQVPRSNAVLKNRSAMRLFNKPNFTA

SEQ ID NO: 484 - protein, 383 aa, Hordeum vulgare
MSTKRVLCKFFMHGACLKGEYCEFSHDWSDQSNNVCTFYQRGSCSYGSRCRYDHVKVSRNNPVPPLPSSSAATRNPVRPPPSSSTATHVASTSLQLLSSGRPLHPGHQTNSSNQRQQISMDKLSLSESKPAWRNEVQPDSVSEDGIDWSSIQTAQNQTSMKLADMPICSFAAAGNCPYGEECPHMHGDLCAFCGKMCLHPYRPDERQEHIKLCEKNHKRLEALKRSQEIECSVCLDRVLSKPTAAERKFGLLSECDHPFCISCIRNWRGNSPTSGMDVNSALRACPICRKLSYYVIPSVLWYFSKEEKLEITENYKAKLKSIDCKYFDFGTGTCPFGTSCFYKHAYRDGRLEEVVLRHLDCDDGSTLIAKNIRLSDFLGRLHL

SEQ ID NO: 485 - protein, 333 aa, Hordeum vulgare
MYPLEMEGSSNPKASNKPKYSKFTQQELPACKPLLTPGIVIAAFALIGALFVPIGLASLHASRQVVELVHRYDAGCVPVDDKVGFIQNSRTDKTCTITMNVPKYMKSPIHVYYLIDGFYQNHRRYVRSRSDKQLRYKSAVHLISDCVPEGKTADGAPIVPCGLVAWSLFNDTYTVRVNGVVAQVNKKDIAWKSDKNNKFSNNIYPSNFQKGSLIGGAKLNESIPLSEQEDLIVWMRTAALPTFRKLYGRIEKDINANDNVTVVIQNNYNTYSFGGSKALVLSTASWIGGKNNFIGIAYLTIGGLCLSLAMGFLVLYMIKQRTFGDPTNLSWNR

SEQ ID NO: 486 - protein, 201 aa, Hordeum vulgare
MDVPTAGEAAAVPQRTAWEWEGRAVSPVPAATADEAWALLSDFLAFHKWHPRVAVCRLASSGAAAAAAAAAPGCVRYCEGTPPADGTPADWAHETLLEHDQARRFFRYEMNDNNMGFGAFFAVFRVVPAAAGGCELRWEFECEPVRGTPKEALEARLQAGLDGMAARVHGHLISARGAVAAAGTAGLEAADELKLDNSIAA

SEQ ID NO: 487 - protein, 341 aa, Hordeum vulgare
MAQTSSIPRVSLGTQGLEVSKLGFGCMGLTGSYNSPVEDDAGVAVVTHAFRRGVTFFDTSDVYGPHTNEILLGKALKQLPREKVQVATKFGIQRDAQGKSTICGRPEYVRACCEASLHRLGVDHIDLYYQHRIDTTIPIEDTIGELKKLVEEGKVKYIGLSEASPDTIRRAHAVHPISAVQMEWSLWARDIEPEIVPLCRELGIAIVPYSPIARGFFGGRGVTQQVSAESSLKGHPRFSAENLEKNKQLYLKMEELAKKHHCSPAQLALAWVLHQGDDVVPIPGTTKIKNLDSNIDSLKVKLTEDDLKEISNEIREEDVAGGRQYTSFAKFTWNYADTPKK

SEQ ID NO: 488 - protein, 108 aa, Hordeum vulgare
MTTKAKLGELMWEHRLRAAAAVAFLAVAVVSISAVGPRLGAVVSFFWPLLVSTGFFLVAITVLLRISPPPGGADESGKEIIDFVAGCRPEHLLPEASATVEVPPEPEI

SEQ ID NO: 489 - protein, 439 aa, Hordeum vulgare
MMLEGKSCLVSRSLPSYCEPESEWAFLAREVSVISGGKRPAPEDFGAEDMEEADGGGGGSSGKRSKSPSPQPHTPDITESHGSSRHASSGGGGGEQQGSGANLIGEIGRDLSINCLLRLSRSDYGSVAFLNRDFNSLVRNGEIYRLRRQNGIAEHWVYFSCNVLEWDAYDPYRERWIQVPKMPPDECFMCSDKESLAVGTELLVFGMAHIVFRYSILTNSWTRADPMNSPRCLFGSTSVGEKAYVAGGTDASGKILSSAEMYDSVTHTWTPLPSMNRARKMCSGVFLDGKFYVIGGVTNNNQVLTCGEEYDLNRGSWRVIENMSEGLNGVTGAPPLIAVVNNQLYAADYSEKDVKKYDKLNNKWIALGKLPERSVSMNGWGLAFRACGDRLIVIGGPRTSIGGIIELNSWVPDEQPPVWNLVATRQSGNFVYNCAVMGC

SEQ ID NO: 490 - protein, 515 aa, Hordeum vulgare
MDSLYCFVQLLSLLCFFVFYYRHLQSKKISKAEPTEWPILGHLFGMVANLSHFHDWATGILTGTRYNFEARAGITGVRFFVTCDPANVRHIFTSNFLNYPKGQDFADIFDVFGDGIFNADGDSWHRQRAKSQLIMAGPRFRAFSARYTRDKVETSLLPFLAHAADAGTPCDLHDVFLRLTFDMTCNLVFGVDPGCLQVGLPVVPFARAMDDVLETLFLRHIISPACWKLMYRYEVGTERKMAAGRRTIDRFAADTIAKRRADHKLRDEGVTDSSDMLSSFICNGDASEYSDEFLRDTTVNLLLAGRDTTGAALSWFFYLLSKNPRVEQKILDELAPIASRKKQLAGDDGNGMVVLDVSELSGMVYLHAALCECLRLYPSVPFEHKAAVADDVLPSGHEMKAGDKILIFSYCMARMEGVWGKDCMEFRPERWVNADGKLRYEPSYKFISFNAGPRTCLGKEMAFVQMKTAAAAVLWNFAVEAVPGHVVEPKLSIILHMKNGLAVTVKRRNVAAVHG

SEQ ID NO: 491 - protein, 1311 aa, Hordeum vulgare
MAGIDDGGAAAQLVQKLAICGVPEEQQHQEGLLVYLEEHNDKIPQITAAILSAGTDLMESGNSSKDKDDSSSSSNAYSESMLWLQWMMFGRNPDAMLHDMELSSEDDRAVCGTVWGQNCLAYRCRTCESDSTCAICVPCFQNGNHKDHDYSIMETGGGCCDCGDATAWKPEGFCSRHKGAEQIKPLTKELASSVGPVLDELLLFWKESICVPREKSDDCKKRVARELTISIADMLLRFCACSESLLSFVSQRIHECPGLLDALMRAEMLLDKKVVEKLHELLLKLIAEPAFKYEFAKVFIQYYPVAFSEVIEGGNDYVLEEYLLIQNFSVQIFTVPMLTTMLVRDHNLLGILLECLTALFLSCVGEDGHLQTSKWVNLYDASIRLLEDARYVLRHEEVSMYVASERPDLTRSWIKLLSLVQGMDPQKRVTSIHVEDENENLYAPSTLGHYFGIIHNLLMKGAFSSPGQQESTDFTVCSIATKGIESAENQRLAKVGRISQENSVCNLSTRKSFSSSKLPSPAACLIRQCLEAIDSWLEPGPLRRKSLSVDAIRGGSDKHIGEMGMKVNEGSQLDDVADYYEVIDPPIQEPDNMVMIGKGGMPHVGNVTGKGKMQETSSVPDVQLHSENFIAVALTDGSLLYAHPDSRTDELGILNMTSWPRVVFDVTSQETSFHIPLHRMLSLLLREAMKKCFGEDAKTEECSVVQSNEFFSQVLGGCEPCGFASVVMEHPLRLRVFCAQVRAGMWRKNGDAAVLSAEWYRSVQWLEQGLESDLFLLQCCGALSSPEFFVRTIQERFGLSDYTSMDLTEQNEYESVLIQEMLTFLVQLVKERRFCGRPTADNLKRELIYKLAVRDATHSQIVKSLPRDLSSSEQLQIVLDSLAVYSDPSGKKKGKYVLREAFWKELDLYHPRWSSMELEIAKERYYRCCKVSALGAQLPQWTHVFSPLRSISKIATSKAVLQIVHAVLFYAVYTDTSSVSRAPDNVLVTALHLLSLALDICESESQMSADQYGMDLVQHDDESWVVLSSDAVEAFPILTYSTELVSPESDKLKKESMITLLVSLMHKEKNDSTFSGCNIPSLVESLLKRFAKLSKQCMSAVRQMAPQVLPSIPEHASAKQNLGSPDSTGNSQCKATIMAKMGAEQSKLAESMKSSGNEGPDVPTFEPDAPRSTAIEMRPFCSLCQDSDSKSPLCCLIRLQAALETMMAETAEDGQTPRSVAEFASNILSHVGSTGSLKSPAVEVLEDKLRAERRGAAALREEIDALKKQAEKADAVIAKTQEEMEEVRKKQAETDQVLQLLLRRSQGNPGS

SEQ ID NO: 492 - protein, 104 aa, Hordeum vulgare
MDEQEFRRMLDLYPVVRSRDYCKDELESSSKGTTQQEQAQEIKGTKKKAAEDLFLRKLKMAAEKKVGATKAELFCKTFEEAHEKLVYKELDLDAAQRFLSAYKS

SEQ ID NO: 493 - protein, 492 aa, Hordeum vulgare
MKEMMVGSVAPVGGVGRWGAAPPQELLERMKDYGQEGAFALWDELSPEDRDLLVRDIESLDLSRIDRIIRRSMGSQGYVAPAEPVPESSVSRVEERSPEDKERWWKKGLRAISEGRLAVVLLAGGQGTRLGSSDPKGCFSIGLPSGKSLFQLQAERILCIQKLAAQSSDSPRNTLPIHWYIMTSPFTDDVTRKFFESRKYFGLEADQVTFFQQGTLPCVSDDGRFIMETPYKVAKAPDGNGGVYAALKSKKLLDDMSSRGVKYVDCYGVDNVLVRVADPTFLGYFIEKGVSSAAKVVRKAYPQENVGVFVQRGRGGPLSVVEYSEMDAAMTTEINQSTGRLRYCWSNVCLHMFSLEFLNQVANSLEKDSVYHLAQKKIPSIHGYTMGLKLEQFIFDAFNYSPSTTLFEVLREEEFAPVKNANGSAYDTPDSAKLMLLRLHSRWVVAAGGFLTHSVPLYMTGVEVSPLSSYAGENLEAICRGRTFHAPSEISF

SEQ ID NO: 494 - protein, 162 aa, Hordeum vulgare
MATANLSSVVVAVDGSEESMKALRWALDSLRLRPDGALVVLHVQPPPGIAAGLNPGPIPFGGPSVAEVPAFTQAIESHQRRITEAILEHALKICSDKNVEVKTQVVVGDPKEKICEVTAELKADLLVMGCRAFGPVKRMFLGSVSNYCINSVGCPVVVIKGT

SEQ ID NO: 495 - protein, 240 aa, Hordeum vulgare
MPPMAASLRSPPPVPAAAAAFRRSRAAVVVCASSSSSSSSSSPSTVSSAPKARFVARRSESTSVQQLARPLAEYMGLPASQYSVLDAERIERVDESTFRCYVYRFRFFALEVCPVLLVRVDEEPNGCCIRLLSCKLEGSPLVEAQNDKFSASMVNRVFCNNNSDDSTLQQLTSDATIEVAIDIPFPFQALPVEAIESSGRQVLEQLLRVMLPRFLKQLDKDYQAWASGDSSRKPLGTGEI

SEQ ID NO: 496 - protein, 336 aa, Hordeum vulgare
MEERAAVAGLGPFFRQQVPSKWNDAEKWIAGRHHVVHSNPIFSRKAAASVHGHTGVGGGCVRVVPESAPPPPPSDAKKTPALTELSRSPSPSSPSSLSSVTGPASKQRRDTKLRTQVQVGAPSSSVSMRDVGTEMTPIASQEQSRSGTPAGAATPSFSPLCSVPASPSASERELQIRTRREIAALGLQLGKMSIASWASKEDRFRTSPEKSAGEEDRAKKAEFEARAAAWAESKKCKLASRYQRKEVRIQEWENCQKSKFEAKMRHAEVQADQMKARAKNSLTKRLSTLSYKVEGKQARVEARRNRRAVRLARQVQRIRKTGRVPSRFRCCSWFLS

SEQ ID NO: 497 - protein, 507 aa, Hordeum vulgare
MAPAVGIKRTAAAQTVTVQAPPPPDARLVREAVRTSTIAGAVAPAALEAPAPALEGFLCLEEVEGRRWKYVVDAAPGKAKAKAKGRGRGGSAVPLGASVRAVPLQSPLPPAEEIMAFVRSYVVPEGFPDSVTPSYVPYMTWRALKHFFGGAMGVFTTRTLLSSVGVSQSKVTPGAIAINWILKDGAGRVGKMLFARQGKKFDNDLKQLRFSSDLLLEIGAGIELATAAFPQFFLPMACVANVVKNVAAVTSTSTRTPIYKAYARGENIGDVTAKGESVGNIADLLGTGLSIFITKRNPSLVTSFALLSCGYLLSSYHEVRSVVLNTLNRARFTVAVDSFIRTGYVPSLKEGNSQETIFIHPWRHEPVSIGSRFGEAFQEPVSFVATRPLFEDERYMVTYNPTKDKVYALLKDQAKPDDILKAAFHAHVLLHFINVSHERKRMSSNRSDHYGNPHPRNMDFLAHIAESCKIVSSSYGTFRKKAKEQGWIMSESLLNPGKARLCVTRPQ

SEQ ID NO: 498 - protein, 348 aa, Hordeum vulgare
MATSGDQSGGCGSAAVKGSKLRYPLRSAGRVKLEPPAAADAPLSGSASRRAKPSLDVTKSCALDLSAVKDKSAKPPRRHSIPTKPGVSPRPTPTGTITPVSGVRPRRSERLDTPTSEASMSTARRKFSTLSSVSYWMTQIRLAEAASKHSISLGFFKLALESECEPLDRMREELKAYVARHGLATELEEPVKEVLQVYDIVEDFEKLKISLDSSQEPKKSDKAAVSATNVTPKGNLKPRSLNSVAAHSKDGKKENIQKEKPDAKIRGSYNRNPAKNAPAKEGAKNTGKKTKKQAKEQQEDCNGGSEVSPVDADQESVDVVKEITYEDKENMGDAEMAIDAGNAVAQEV

SEQ ID NO: 499 - protein, 229 aa, Hordeum vulgare
MAPHAAVLLSLLLLTTCAADTHLHFFLHDVVSGSNPTAVQIIKGPASSSNAFPGMAFGDTTVIDDALTETSSPTSAPVGRAQGFYMMSSQSGMVLMMCVNFLLTTGDYNGSTLAVIGRDDIMTTTRELSVVGGTGKFRMATGYVLWKTNSSKGADATIELDVYTTALNGTTTIDANAPVSPIDGGGGGTAGGATGKSSSGAAALRGAVPYGWANAWVAAVLVALAGCVW

SEQ ID NO: 500 - protein, 272 aa, Hordeum vulgare
MSPPAPCQLLGAESAHATAEPFRVYVGYDSREDIAYRVCRRSLLRRSSVPLEVIPIVQQELREAGLYWRERGPTESTEFSFTRFLTPHLAGYRGWALFVDCDFLFVADVAELARMADPRYAVLCVHHDYTPKEATKMDGAVQTAYPRKNWSSMVLFNCGHPKNRAALTPEAVSTQSGAHLHRFAWLDDADVGEVPFAWNFLVGHNRVDPADVGGTAPRAIHYTSGGPWFELYKDCEFADLWIQERDAYESEEKEGEVEGTRVPSSSAVAVDA

SEQ ID NO: 501 - protein, 84 aa, Hordeum vulgare
MMWGVAAAVASAAAVAVASGAELLACDCAPTDPAAAVAVGRCDDFLLRQREPSSSSAGSGVTDDKFAPRFDGLRFIETLVTAHR

SEQ ID NO: 502 - protein, 557 aa, Hordeum vulgare
MGEMNHQPGQPPVGVPPPMGMQPMMNAPVGAGAMHQPYEQFNQLNYCVHSNPSWVQVAGLAFLHYLVMLGSTVMLVSTIVPAMGGGPGEKARVIQAFLFVSGINTMLQTLVGTRLPTVMNASFAFVVPVLSIARQFDPNDFGSNHERFVHTMRATQGALIVASILNMILGYSRAWGAFAKKFSPVIMTPVVCVVGLGLFQIGFPQVGKCVEIGLPMLILAIVVQQYAPLYFRHIHDRTTFLFERYSLLLCIGIVWAFAAILTAAGAYNHVSLKTQQHCRTDKSFLISSAPWIKIPYPFHWGPPIFTAGHSFGMMGAVLVSSFESTGAHFATARLAGATPPPAHVLTRSIGLQGIGIFLAGLCGAPAGSSVSVENIGLLGLTKVGSRRVIQISTGFMLFFSIFGKFGAFFASIPLPIFAAIYCILFGIVAAVGISFSQFANKNSMRNIYIIGLSLFLGISIPQYFAEYTASAGRGPARTNAGWFNDIINTVFASGPTVALIVASLLDNTLDPRANEADRGLSWFTPFLRRRKGYSDPRNEEFYSYPIRVHDLIPHRFL

SEQ ID NO: 503 - protein, 109 aa, Hordeum vulgare
MAMALGKLAVAALVASLLLLSTIKAADFPAPAAAPLGPPPHNIVDPSKDCGWACNLRCSANSRQNLCSRACLKCCSVCRCVPAGTAGNKETCGKCYTDWTTHGNKTKCP

SEQ ID NO: 504 - protein, 340 aa, Hordeum vulgare
MAYQLLSTVAHRDTLPEGYTRPENDRPQLADVVTDTNIPLIDLASLDKHSIIAEIDQACRTYGFFQIVNHGISEELLEKVMAVGLEFFRLPPEEKAKLYSDEPSKKIRLSTSFNVRKETVHNWRDYLRLHCHPLEEFVPDWPSNPETFKEIISTYCREVRLLGLRLLGAISLGLGLDEDYIEKVLGEQEQHMAVNYYPRCPEPDLTYGLPKHTDPNALTILLMDPHVSGLQVLKGGVQWIAVDPRPNALVVNLGDQLQALSNGAYKSVWHRAVVNASRERLSVASFLCPCNSAVIGPAAKLVADGDEPVYRSYTYDEYYKKFWSRNLDQDHCLELFTDQN

SEQ ID NO: 505 - protein, 428 aa, Hordeum vulgare
MGISSKWIKPLVGIKKHGKAQNGESSRERSSAAQVLHKRKHSVDTEGALAVAEHTVQTEPLASDTNTQTVSSQTELNTKEHQAATVIQSAFRVFLARRALRALKGLVRLQALVRGHAVRKQAAETLQCMQSLVKAQARVRARQVRIGLEGQVTQKKAPEQNAHDDHAREIEERWCGSIGSAEDMQAKVLKKQEAAAKRERAMAYALTHQRQAGSRKLKAADVQGPEADENQWGRNWVERWVAVRPWENRLLDSNAKESVPIGDDKEAEENGDRDVNNPKGKVAVSGIQSNGSSQTKDAKHKKSHSDASGSSSGQSAAAPPTASLGSSKLKPKPSDQTSEEVSPQPTDPAPRSTSNPKERPAQVSAPTKKRLSLPNNAVGGAARKGQVSSSERTRSVGSKNTVKGASKPESKQRPSPGSATAKRVQAQA

SEQ ID NO: 506 - protein, 355 aa, Unknown
  Sequence found in Organisms: Hordeum vulgare, Secale cereale
MRGKKPLKELTLSVPAQETPVDKFLTASGTFKDGELRLNQRGLQLISEENGDEHQSTKMKVEDVQLSMDDLEMIQVIGKGSGGVVQLVRHKWVGTFYALKGIQMNIQESVRKQIVQELKINQATQSPHIVLCHQSFYHNGVIYLVLEYMDRGSLADIIKQVKTILEPYLAVLCKQVLEGLLYLHHERHVIHRDIKPSNLLVNHKGEVKITDFGVSAVLASSIGQRDTFVGTYNYMAPERISGSSYDYKSDVWSLGLVILECAIGRFPYTPPEGEGWLSFYELLEAIVDQPPPSAPADQFSPEFCSFISSCIQKDPAERKSASELLNHAFIKKFEDKDLDLRILVESLEQPMNVPE

SEQ ID NO: 507 - protein, 527 aa, Hordeum vulgare
MALAGAANATFRPRLVTAAADTSDTHTRRRHWKAGEFPFPTTSPSSGTQQRRRPRTTERPPPPPPSKGEDPEGRGRQRHWKAGEDPEGRGRQRHWKAGEFPAAGESQSQSGRRGRARTPIKNVQKRLDARADAKAWACTVTEALADRIAAKNWQGALQVFEMLKEQPFYYPKEGTYMKLLLLLGRSGQPSLAQDLFTEMQQQGCQPTPELYTALIGAYCRNGLLDEALKLLQDMKANPLCQPDVYTYSILIKAFVDAPRFDLVDAMYKEMAERSVAPNTVTQNIVLSGYCRAGRLDDMEKLLSAMLESANSKPDVWTMNIILSLFGNSGQVELMEKWYEKFRGYGIEPETRTFNILIGAYGKKRMYDKMSAVMEYMRRLAFPWTTATYNNVIEAFAEAGDAKNMEDTFNQMRSEGMKPDTKTFCCLINGFSNAALFHKVVGMVKLAERLDVPPNTSFHNSVLAACAKAEDLMEMERVFRHMKHMQCEPDAITYSILLEAYRKEGMTDKMYALQQENPSLVSTELVMV

SEQ ID NO: 508 - protein, 98 aa, Hordeum vulgare
MAAAASSSAWKARWLRPEAYPIFAATGVAVGICVMQLVRNITTNPEVRVTKENRAAGVLDNHDEGRRYARHPFRRFIDGKSAEIMPGINNFFTAPPKN

SEQ ID NO: 509 - protein, 113 aa, Hordeum vulgare
MGCAGSTPKSDGSSKKLKKPKPWKHTQSISPVELKQMREEFWDTTPHYGGQKEIWDALRAAAEADLSLSQTIVDSAGIIVSNPDMTLCYDERGAKYELPKYVLSEPTNLIREE

SEQ ID NO: 510 - protein, 355 aa, Hordeum vulgare
MGARSTATAGEAVARRGSRKKAAMAPSLGGVEAGGRRRGPPRLVGYEELPEYLKDNEYIRGHYRVEWPIRDALLSAFSWHNETLNVWTHLGGFLLFLALAVAGGGPEAAHEAAPGIMRFVVGSANSSWKSDQSGLPSHDAAAAVLGGHGVPRWPRMVFLVGAMACLAISATAHLLACHSRRATVVFWQLDYAGISIMIVASFVPPVYYAFLCHPPARIAYLSAITVLGALVVAVLLSPSCSSPRYRRLRATLFLAMGMSGVIPAVHALWINWGHTACYMALGLEVAMGLAYAVGAWFYVSRVPEKWRPGVFDVVGHSHQIFHVFVLVGAITHYVAVAVLLDWREKAAVSCGGVTS

SEQ ID NO: 511 - protein, 324 aa, Hordeum vulgare
MGPVVLLLVVVAVAVPVVRPAAAELPRLEHSPKADGSLSILAVGDWGRRGEFNQSRVATQMGLVAEKMDADFIISTGDNFYSDGLTGVDDKAFEDSFTGIYTAKSLQKPWYTILGNHDYRGDALAQTSPILAKVDCRWICMKSFILNAEVADFFFVDTTPFVLTYWTNPKDSTYDWRGVAPRETYITNLLKDVEDSLRQSRAPWKIVVGHHPIRTAGKHGDTEELVQLLLPMLKAHGVDLYINGHDHCLEQISSSDSPLQYLTSGGGSKAWGGVYAPGADKVEFFHDGQGFMSLRLTATDARVAFYDVAGAVRHTWGHTKAAHY

SEQ ID NO: 512 - protein, 118 aa, Unknown
  Sequence found in Organisms: Hordeum vulgare, Secale cereale, Triticum aestivum
MAGGKEPIEVKFRLFDGTDIGPSKYDPATTVSALKDFILARWPQDKEITPKTVNDLKLINGGKILENNRTLAESRVTIGEVPGGVITMHVVVRPPQVDKNQKQLGNSPKQNRCGCTIL

SEQ ID NO: 513 - protein, 242 aa, Hordeum vulgare
MEALGLLGRACRLGHSCRRSTATPSPPPPRSSSNRGRAVRAGAKAASSSAPQAMEAKREEKPRVVTLRPVEATPESFAPFGQVIAASPDGDQFGPHDAQLDLSRGIPRFYIMRLESRPLKFSAITHHASVTQCLGSIGGQDWYLGVAKPSIVNEHSGQDGGRSPVQSRAGHYYLPPDPAEVCVFRVSGPKFLKLHAGTWHAGPLFKADAVDFYNLELSDTNVVDHTTHHFKEHDGVTFTIED

SEQ ID NO: 514 - protein, 275 aa, Hordeum vulgare
MHHDPNPFDEGTAGDENPFSNGGGRGGKQQYGFRPTEPVGFGGGGGGGSRGDATVDVPLDNMGDSNGNARELSSWESDLRRREADIKRREESLKNAGVPMEEKNWPPFFPIIHHDIANEIPANVQKLQYLAFASWLGIVLCLSWNFIAVIVCWIKEGDSKLFFLATIYALLGIPLSYLMWYRPLYRAMRTNSAFSFGWFFLCYLIHIGFCIIAAIAPPIVFQGKSLTGILAAIDTFSEHLIIGIFYFVGFALFCLETLLSIGVLQKVYMYFRGHK

SEQ ID NO: 515 - protein, 126 aa, Hordeum vulgare
MKAKAGSRAGGSRLAVKKSKADKDPNKPKRPPSAFFVFMDTFRKEYREKHPDVKLASVIGKAGGEKWKSLSDAEKAPYNAKAEKLKAEYTKKINAYNNPQAGEASGDSDKSKSEVNDEDDGSEGDA

SEQ ID NO: 516 - protein, 375 aa, Hordeum vulgare
MALPAAKAAPATPFSSQTHGGGILLGRASSPPPPAAALRLGPLFWPWEKVNVGPLSVSPMGFGTWAWGNQLLWGYEESMDSELQECFNLALKNGINLFDTADSYGTGKLNGQSERLLGKFIRECQGPIKSPDDVVIATKFAAYPWRLTSGQFVNACRSSLERLQIDRLGIGQLHWSTANYAPLQERALWDGLVEMYDKGLVRAVGVSNYGPKQLLKIHSYLASRGVPLSSAQVQFSLLSMGDEQMELKTVCDSLGVRLIAYSPLGLGMLTGKYDASNLPNGPRSVLFRQILPGLESLLSCLKSIADRKGKTMSQVAINWCICKGAIPIPGVKTVRHVEDNLGALGWRLSPGEISELEAAAMECPKKMVQNIFQTT

SEQ ID NO: 517 - protein, 102 aa, Hordeum vulgare
MDRVGSGEKHLEDCTVANALGTWVFSVAGALLAIPVGIKRKSFAPLVFFGTTGTMLDIIMGISQCEREHAERQMKLLEAQNLATNASVEGESLTDSFTNVDK

SEQ ID NO: 518 - protein, 1067 aa, Hordeum vulgare
MRLTVRVIGARNLRAMDFNGFSDPYVKLQVGKQRFKTKVVKMNLNPEWDQEFSFVAADVREVLKLDVYDEDMIGTDDFLGQVRVTLEDLLAVENFSLGTRWYQLLPKTKSDKAVDCGEICLAISLETAGATRSWSDDLATELTGTRKEYSLASSQSAGSSSAALAYEENEASKEDNVNEYFSDGTEVPEEDKCGEVRAPEDRFNGIPTEISNEAETSKTEKLDKPSLVDRVYQMFAKKNDDISSTSWRKTEASEEVQQATAVFEAPLSQNSDICSDVTFDELLGSFESRHEEVEMPVNLQGILVNQSYFTSPSDLNNLLFSPDSDFRQTLVQLQNCTDFKTEPWRIDNDGESLKRVISYTTAPSKLVKAVKATEEQSYLKANGKEYSVLLSASTPDVPCGTYFRTEVLFRIMPGPELDSEQQTSHLVISWRMNFLQSTMMKSLIENGARQGLEQNYSQFSDLLSEKIKPIDVDDAGSDKEQVLASLQGGQESDWKIAFLYFCNFGVLSSLFVALYIGVHVSLVNSGAVQGLEFPGLDLPDSLSEIVMGGLLFLQVQHIFKKIICFFQAREQKVGDHGVKAQGDGWLLTVALIEGTKLAPVDATGFSDPYVVFTCNGKTKTSSIKFQTLEPQWNDIFEFDAMDDPPSVMNVHVYDFDGPFDEVTSLGHAEINFVKSNLSELADVWIPLEGNLAKSRQSKLHLRIFLNNSKGTGMVTEYLSKMEKEVGKKMTLRSPRTNTAFQELFSLPAEEFLISSFTCYLKRKLPTQGHLFLSPRIIGFYSSMFGRKTKFFFLWEDIEDIQAIPPSLSTWSPSLSITLHRGRGMDAKHGAKSVESGKLKFSLQSFASFSVANRTIMALWKARSLSSESKVQIAEEQSQNNTLQSEDSGIFVGVDDSKSLQMSEVFSSTISANMNSLLEVFEGGSLEMKVMEKVGCLKYSATQWESDKPDEYQRQIHYKFSRKLSPVGGEVTGTQLKSPMPNKKGWIIEEVMELQGVLLGDFFTLHIKYQFEDLAPKQKVCSVQVYLGIEWSKTTRHQKRIEKNVLSSSSARLKEMFSLASKQLSSTR

SEQ ID NO: 519 - protein, 369 aa, Hordeum vulgare
MKRFFQPVVKDGSPAKKRPAGAATSDCVDGAAPTGADAAGEGPPGEEPRRFVTWNANSLLLRMKSDWSAFCQFVARLDPDVICVQEVRMPAAGSKGAPKNPSELKDDTTSSREEKQIVLRALSSSPFKDYRVWWSLSDSKYAGTAVFMKKKFEPKKVSFNLDRTSSKHDADGRVIIVEFESFLLLNTYAPNNGWKEEENSFQRRRKWDKRMLEFVQQVDKPLIWCGDLNVSHGEIDVSHPDFFSDAKLNGYIPPNKEDCGQPGFTLAERQRFGNILSQGKLVDAYRYLHKEKDMECGFSWSGNPIGKYRGKRMRIDYFVVSEGLKDRIVSCEMHGHGIELEGFYGSDHCPVSLELSKEAAEAPESKSSG

SEQ ID NO: 520 - protein, 554 aa, Hordeum vulgare
MEATTTLTLSSSPAIAARRSPVRATISQSHLRHCPVRTSRLHVAQSLASRPLSSGWRWRRRGSGLVVRAETFGQLTTGLKSAWNKLRGVDVLTKETIVEPMRDIRRALLEADVSLPVVRRFVSSVSEKALGSDVIRGIRPEQQLVKIVHDELVQLMGGEVSDLVFAKTGPTVILLAGLQGVGKTTVCAKLAFYLKKLGKSCMLVAADVYRPAAIDQLTVLGEQVGVPVYSEGTTAKPAEITKNAMEEAKRNNIDAIVVDTAGRLQIDKTMMVELKEVKKSVNPTEILLVVDAMTGQEAAALVTTFNIEIGISGAILTKLDGDSRGGAALSVKEVSGKPIKFVGRGERMEDLELFYPDRMAQRVLGMGDVLSFVEKAQEVVRQEDTMELQKKIMSAKFDFNDFLKQTQNVAKMGSMSRVIGMIPGMNKVTPAQIREAEKRLAFVESMINAMTAEEKEKPELLAESRERRIRVAEESEKTEQEVSQLVAQLFQMRAQMKKLMGMMQGQEAIAGMGDLMDSLNADEKAPPGTARRRRRRSEPPRQRELDAVGGASRP

SEQ ID NO: 521 - protein, 212 aa, Hordeum vulgare
MATDTFVTVVDFEDDEITATVTSSGDAVKAWLRQIRYVYRWVYHKLIVGLDVEWRPSFGRAQNPVALLQLCVGRRCLIFQLLHADFIPLALRRFLADPDFRFVGVGVQNDVDRLNDDHGLEVANVVDLRSLAADEMRRPWLRQAGLKDVAGVVMGANLHKPRRVTMGPWDACRLSQEQIQYACIDAFVSFEVGRKLLTGDYSDSEEEDDSGY

SEQ ID NO: 522 - protein, 499 aa, Hordeum vulgare
MAAMVALVPWLAWLVIAFLSFYLLNLLAHARSGLPPGPRPLPLIGSLHLLGNKPHRSLARLAKIHGALMSIRLGAVTTVVASSPAMAREFLQRHDSVLATRSVPDATGKHAAGSVPWLPPAPRWRALRKIMATELFAPHRLDALRHLRSDKVRELTDHVARLAREGTAVNIGRVAFTTSLNLVSRTVFSIDLTRLDDHGRSEEFQEVITAIMEGLGTPNMSDFFPVLAPADLQGMRRRLARLFARLHAVFDAEVDQRLRGRDAGQPRKNDFLDVLLDVAAREDGKDLLDRETLRSHFTDLFAAGSDTSSSTVEWAMTELLQSSSSMAKVCDELAQVIGSKRNIEEDDIVRLPYLQAVIKETFRLHPPAPLLLPRQPETTVKIAGYTIPKGSRVFINVWAIGRDKDVWTEPEKFMPERFLGSTIDFKGLDFELLPFGAGRRICPGMALAIRMVHVMLASLLNQFKWSLPLELEHDGIDMEDQFGLTLAKVVPLHIIATPI

SEQ ID NO: 523 - protein, 105 aa, Hordeum vulgare
MEATAACSSTSLARTLASSPLPHHCRSRVRVGNYVVPLDAAPSGITRPLVEILNLTDQNLTEIDNYAFSFLSVGVDLLLIFILHEKNCQFRLAHGLSCGFSCCDV

SEQ ID NO: 524 - protein, 89 aa, Hordeum vulgare
MKGTKLAAILILQAVLVMGVLSHVNADYFPTCCNNCRSFSGVDVCDDAHPQCPTGCSACRVVTTNPQTFRCADMKATVDGTCGGPCKKY

SEQ ID NO: 525 - protein, 338 aa, Brachypodium distachyon
MANSLPIAVLLLLLLSPAALATAVFPDSGDSFHAVSCPQLDTIVLTTVQAALRQEIALAAGLIRIFFHDCFPQGCDASVYLMGTGADEISLGPNLTLQRRAMQLVESIRAKAHAACGPTVSCADVSALATRAAVVASGGPSYSVPLGQLDSFAPAPRDKVLDLPGPRTASVAELVATFATRGMADVADLVALSGAHTVGRSQCDSFADRSGRMDDTFSRKLAANCSKHKDRLQNLDVVTPDLFDNGYYKALTFNQGVFTSDMALIKNRTSAAIVRQFAESKEAFFAQFARSMTKLANAPRPGGNVGEIRRNCFTRNVRQGADATIELAGEEEGFKASA

SEQ ID NO: 526 - protein, 537 aa, Brachypodium distachyon
MALAINSAAAAAAAALSNGGAAQPPRPRAGLLPMKRRGSISAVHAADPARGTGSVPAAAKTSSPTVAPEAAASPAASWKVDSWKAKKALQLPEYPSKEELDTVLQTIETFPPIVFAGEARHLEERLAEAAMGRAFVLQGGDCAESFKEFNANNIRDTFRVLLQMGAVLMFGGQVPVVKVGRMAGQFAKPRSDNLEERDGVKLPSYRGDNVNGDAFDVKSRTPDPERMIRAYAQSVATLNLLRAFATGGYAAMQRVIQWNLDFMDHNEQGDRYRELAHRVDEALGFMTAAGLGIDHPIMTTTDFWTSHECLLLPYEQALTREDSTSGLFYDCSAHMLWVGERTRQLDGAHVEFLRGIANPLGIKVSDKMNPAELVKLIEILNPSNKPGRITIITRMGAENMRVKLPHLIRAVRNSGQIVTWITDPMHGNTIKAPCGLKTRPFDSIMNEVRAFFDVHDQEGSHPGGIHLEMTGQNVTECIGGSRTVTFDDLGDRYHTHCDPRLNASQSLELAFIIAERLRKRRMQSGLTNNLPLPPLAF

SEQ ID NO: 527 - protein, 346 aa, Brachypodium distachyon
MPQVKSTAGAGAMPSGSKGGDGEVEAGFAKLQGEDFEYYMQTYSIMLGRNSKKSSVDVDLSSLGGGMNISRHHARIFYDFQRRRFALDVIGKNGCLVEGVLHLPGNPPVKLDSQDLLQIGDKKFYFLLPARSIFASFAAARQVPVIPTQILPPSFVRPGHPNVSNYHDQPFEGDYGREGDDIRNGINESGTRGKLIKRTKKPSGDLGIYGGHRINVEAIETLGEENISDVRPRGDKDMDNQQLLQMEEKEVVSSVATVLSDLCGPGEWMPMRKLHTELVDQFGNVWHHSRVRKYLTAEEWSPVEAKGRPWFGLLGLLRKYPEHFVINTKCKGRAISEFVSLVSLLS

SEQ ID NO: 528 - protein, 413 aa, Brachypodium distachyon
MDDDGAASPSPSPSPSRSSSPLPLAEPVTVAAVPPGHLAVALPIQKPAPSSGGGGGGGGREDAWSDGATSTLIDAWGERFVALGRGSLRHPQWQEVAEVVSSRDGYSKPPKSDIQCKNRIDTLKKKYKVEKSKSGSSWPFFDRLDYLLAPVQKLGGNSGRAAGNSGSSNLAERTTAVMIPRFNFPTRSRTTSHFPPSAGLKRRLPSPPQASASSDSSDGFPPEPPVEAANGKRQRVEEAVNGADSSVRVQGLRDLAQAIRRFGEAFERVEASKREHELRMERDRLNAARELEDQRVQFFLKMQMEISKANNGTALGPLAAVAAAMIGNSAPATVPAVADGNGSRRTSMAPDVGTSSNHHVRYRVKDGRHHQSLQHPSYQYNQNNAGEDATGHGSGSNDNKEDDEVEDEEEESQ

SEQ ID NO: 529 - protein, 367 aa, Brachypodium distachyon
MGGSMWMRYAPHNMMILVQLSYTLMYFVTEDAFNRGLNPYVYVTYRHLLVALLLCPFAYFHEKKLRPKMTLMLFLEIFVLSLLGVSLTLNMYFASLKYTSPTFVTAMANTVASITFAIAIVLRMEIVDVKSPRGLAKVAGTAVSFAGVTTMTFYKGAAIASPWKAPIHIHGSNAVHGSWVKGSLLAVASCVCWSIWYIMQAGSVERYPAELSLTAWMATVGGIQSAAFTVLLQHRKEDWLVGFGLNFWCIIYSGIACSGFAVFAQLWCTEKKGPVFVTMFNPVSTIMVAILAYFICGENLYVGSIIGGGVVILGMYMLLWGKDKDQEYNASSSKELQGSDLDWEKQAKMADVSSVQNDSQPETKTMT

SEQ ID NO: 530 - protein, 399 aa, Setaria italica
MLAAVMDYFSSCWGPRSRAGHRGKGSDAAGRQEGLLWYKDAGQLATGEFSMAVVQANQLLEDQSQVESGSLSLADPGPQGTFVGVYDGHGGPETSRFINDHLFNHLMKFATEHKCISVDVIRKAFQATEEGFLSLVSREWALKPQIASVGSCCLVGVICSGTLYVANLGDSRAVLGRLVKATGEVLAMQLSSEHNACYEEVRQELQSAHPDDPQIVVLKHNVWRVKGLIQISRSIGDVYLKRPEFNREPLHSKFRLRETFQKPILSSDPQITEHRIQPNDQFVIFASDGLWEHLSNQEAVDLVQNSPRNGIARKLVKVAMQEAAKKREMRYSDLKKIDRGVRRHFHDDITVVVIFLDSNAMSKASWSKSPSVSIRGGGVTLPAKSLAPFSAPAQLNSTY

SEQ ID NO: 531 - protein, 654 aa, Setaria italica
MKSTVFSAVVVSIGYALLGWDFAALLEANGHMEKEFELENLPSIEGITIAVSAFGAIVITIFSGSLLDWLGRRAVLVQSSLLLLSGGLLMLWSPNIYILLLARLIVGSGSGLVFTCVPIYISEISPSTMRGLLVTMPQFMFFIGTIFSYCLIFWLTLMPSPKWRIMIGAIFAPSIVYLALLVYYLPESPRWLVSDGKISEARVSLQWLRGKKHDISGEISTIVEGVDFISDTAIGTAQAQSFSRISSSQIWPNNTFYWHLSDPLVDLLGSIHETMSEATGSRRNSFFPVFNSFSFPEHEHMNEHRDDNSDQQTRGVYYAGEANNGDGLRTSLLSQTANVEVNDTNTSFTSEGSSSYLRRHGTSAFAQEFVASFIDNDIEEEDEETHGMALPYQPAYRYMENTRRHPCRYRILRLSETADMKSKWRVLLQPGIRHALCYGMLIQALQQSAGISVLLRYTPEILEQVGVVSLFSDIGLSPHSTSILISALNALLLLPCITAAMLLMDVCGRRALILATTPILMLSLSVMSLSTLVDMGSLERAILFHLALTICFCSYVVGLGPIPNILCSEMFPTKARATCVSFCSLSFWFGGLLSAYCFPVMLSTIGLGGACGIYALVCCIPLCLVYYRIPETRTLNLELIAEVFKLSRQLPYVQ

SEQ ID NO: 532 - protein, 162 aa, Setaria italica
MEPAERIESGKALGKRPRSRVLPRTASMVTVPSAAKQGRQERRAGVTSSTSLPAGGAGMGDGGSGAATRAFYSGGYLAGAETTAAFLKACGLCNRRLGPGHDTFIYRGEVAFCSQECREQQIEYDERMEQTCSLTSIKEAPSVSGASGSDQSGSGGETVAAA

SEQ ID NO: 533 - protein, 259 aa, Setaria italica
MASRIALLCLLGLLVASPAIADSGIYYQLELMWPGAYCEQSSAGCCKPTTSAKPARDFFISGFTVYNATTDAPVTRCSNKAPFDPNEITDIPGLKQYWSNIKCPSNNGQGGWKNAWKKSGACSGLKEKDFFEKALEFRSRLNPLVRLQKNGIQPDFELYSLKKIKKVFQSGINATPLVQCSMGPFNKYMLYKLYFCATEQGTFIDCPVAPKYTCSAEILFHPFKRWMLQQLQGEDAEFAAAADGDDQDAFVLPGVAMDM

SEQ ID NO: 534 - protein, 110 aa, Setaria italica
MRLLTGGGGGLPFKIRSLDAFGPTVLAEGTDATGALYWVHAWTVGPGGRVTEVREYCNTALVVTRLGGGRDMEARAAPASEDVCSKAQQVWQSRLPDQARRNLPGLVLAI

SEQ ID NO: 535 - protein, 351 aa, Zea mays
MAGANFLSTAALVARGVAACSSISTPTRRHPQIRVCCRADVEAMEAYAHEERLRFRRRDFIGTCVGTAIGLEMIDGSTSFSGVATAADLIERRQRSEFQSKIKDTLYVAIKAKPELVPSLLTMALNDAMTYDKTTKTGGANGSIRLETSRPENSGLSSALDLLTEAKKEIDSFSKGGPISFADLIQFAAQSALKRSFLDAAIAKCGGNEEKGRTLYSAYGSNGQWGLFDRTFGRADAQEADPEGRVPDWSKASVQEMKDRFVAVGLGPRQLAVMSAFLGPDQAATEGRLIADPDCRPWVEKYQRSRETVSRTDYEVDLITTLTKLSSLGQKINYEAYTYPKQKIDLGKLKL

SEQ ID NO: 536 - protein, 240 aa, Zea mays
MAAAPTVRGYGPASPSSSSVALPRPRSRVPAPLVPVTTRRGAPSVRLRAAGADTPPRGGLQLQRREEDEGLPGTVLGRGEDDEVSEKVGEEKVERWMRDSIAEIVRHVGEAPFLVHLFSSGEGERVTVRREPAAPESWPDVRRRWGPGGARRPDGIILVEQVASDGGGASAASEAARQVWGLVVQARGMERASCYVLSTCRVRSSAGFCTHFCLARAQCFGDPVELQLRNAWLNRLAGRR

SEQ ID NO: 537 - protein, 877 aa, Zea mays
MRVAVVGAGVSGLAAAHELARSGGSRVTVYEKEDYLGGHARTVAVEDADAASTVQLDLGFMVFNRVTYPNMLEWFEGLGVEMEISDMSFSVSTELGASGSRCEWGSRNGISGLLAQKSNALSPSFWRMIREILKFKNDALRYLEDHENNPDMDRNETLGQFIRSHGYSQFFQEAYLTPICACIWSCPSQGVLGFSAFFVLSFCRNHHLLQLFGRPQWLTVKGRSHSYVHKVREELESMGCQIKTSCEIKSVSSSEGGFRVTVFDGSEETYDRIIFGVHAPDALKILGAEATHEELRILGAFQYVYSDIYLHSDKSLMPRSLSAWSSWNFLGTTSKGVCVTYWLNLLQNIESTSRPFLVTLNPPHVPDHVFLKWYTSHPVPSVAAAKASLELHHIQGNRGIWFCGAYQGYGFHEDGLKAGKAAAQDLLGKESDLLVNPKQMIPSWSEAGARLLVTRFLGQYVSVGNLVLLEEGGTMFSFGEVGKKCHVKSVLRVHDPMFYWKVATEADLGLADAYINGYFSFVDKREGLLNLFLILIANRDANKSSSSAAGKRGWWTPLLLTAGVASAKYFLRHIARRNSVSQTRQNISQHYDLSNEFFSLFLDPSMTYSCAIFKTEDQSLEAAQLQKVCLLIDKAKVERDHHVLEIGCGWGSLAIQLVKQTGCKYTGITLSVEQLKYAQRKVKEAGLEDHISFMLCDYRQIPTQRKYDRIISCEMIEGVGHEYMDDFFGCCESLLAQDGIFVLQFISIPEERYEEYRRSSDFIKEYIFPGGCLPSLARITSAMSAASRLCIEHLENIGYHYYPTLIQWRDNFMANKDAILALGFDEKFIRIWEYYFIYCAAGFKSRTLGNYQIVFSRPGNDKLGDSGIHSLSKLSGS

SEQ ID NO: 538 - protein, 325 aa, Zea mays
MENPAPSIVVAIAAPVAAEFVKLTFRALYMRRAGPGSREMTVPGRPSDQLGRRVVTDSPVYDGRGADARLVARIQGVTVLVGNADALFTMVFETDRLKGSTLVINGMVTDGSDEWAIYGGTGVFAMATGVMKRRNLAGGSNDGNSDELALEVFCPVFGASQQPISKQQESISSVTKIGLWGGQGGSAQDITAEQPPRRLHSITVRAGVAVDSIEFTYTDDAGQRRTAGRWGGLGGNVRTIDLGDAEDVREVSGTYGAFEGAITLTSLRLVTSSRTWGPWGVENGTRFSITAPNGSSIAGFYARAGTRLVDAIGVYIRPVVPGRPR

SEQ ID NO: 539 - protein, 177 aa, Zea mays
MPPRSDHAAGSGAAAAATQAHFDSIDPLFHVLRVLPFSFLLPPRTRLRLPSNLALPSPMTVFSLILLTYFAVVSGLVYDVIVEPPGIGSAQDPGTGAVRPVVFLPGRVNGQYIIEGLSSGFMFLLGGIGIILLDLAVDRTRPRSLRVSFGSAGAVAVVIAYAMAMLFLRIKIPGYLW

SEQ ID NO: 540 - protein, 393 aa, Zea mays
MKVLVLAVLALVAAAAAAGQGEEGGGPPLPFAVGAAPAGCDVAQGEWVRDDDARPWYQEWECPYIQPQLTCQAHGRPDKAYQSWRWQPRGCSLPSFNATLMLEMLRGKRMLFVGDSLNRGQYVSLLCLLHRAIPDGAKSFETVDSLSVFRAKNYDATIEFYWAPMLAESNSDDAVVHSADDRLIRGAPMDRHYSFWKGADVLVFNSYLWWVAGDKIQILRGADNDPSKDIVEMKSEEAYRLVLHQVVRWLERNVDPVKSRVFFVTASPTHTDGRAWGDDDAEGSGNCYNQTSPISAASSYRGGTSQEMLRATEEVLATSRVPVGLVNITRLSEYRRDAHTQTYKKQWVEPTAEQRADPRSYADCTHWCLPGVPDTWNELLYWKLFFPSNDQVL

SEQ ID NO: 541 - protein, 170 aa, Zea mays
MPRSRINGNFIDKTSSIVANILLQIIPTTSGEKRAFTYYRDGMLAQSEGNYAEALQNYYEAMRLEIDPYDRSYILYNIGLIHTSNGEHTKALEYYFRALERNPFLPQAFNNMAVICHYRGEQAILQGDSEIAEAWFDQAAEYWKQAIALTPGNYIEAQNWLKITKRFEFE

SEQ ID NO: 542 - protein, 291 aa, Zea mays
MPAPPHPTPLLPPAGEPFRVFVGYDPREHEAYEVCRRSLLRRSSIPLDVRPIRQAELRAAGLYTRARGPTESTEFSFTRFLTPYLAGYRGWALFVDCDFLYLADLADLLAAAAAADRAAGAGRIAVACVKHEYQPAEATKMDGAIQTVYPRKNWSSMVLYNCGHPKNVAALTPEAVSTQTGAFLHRFAWLDDDEIGEVPFAWNFLVGHNRVDPADPATRPRAIHYTSGGPWFERYRDCEFADLWLKEAEELRADKDKENDKLKLLKDMDDANGKQEVEEETAQEKEKEKGK

SEQ ID NO: 543 - protein, 498 aa, Zea mays
MGKKHAAGGGWFAAVRKVFRPSGSGGSSATATTTTSSSKDKDKDAVQHGKQDAAAAEEPEVLLLEHFPASETSAEASNEGGDAEAEPAAAATKGRRREDEVDDEDGEMEEELAEDMERARALAAAAEAAVAAAEAAARVVRLAALRRLSREERAAVRIQAYCRLFQARRALRALRGLVRLQALVRGHQVRRQVHLTMRCMQALVRAQARVRARRLTQHPLLLLPPPTPPASSPTLLLGAGRPLCVELALQGDHDVGDDGEVADLLLQQRSRSRGRFGRGDDNGGARSPSGAWDSSSRTLEDARAEGARRHDAAARRERALAYAYAYQQRQWQRQEDEKAGLGFHWLERWMAATTQAQQQEHAPDHAKTHQSTPTRTTSSYVTAAAAFANGMSEKTVETETTSRSPLNQASAAAHGRPPAIPGYMAATRSARAKARPAPPSATPTHARSRSGGGLAGDTSSSGQNGSAVAGYSPDSSCTGDWTPPRLGVSTRTSRVAYT

SEQ ID NO: 544 - protein, 635 aa, Zea mays
MGDRNHGRSLPLLLYLHLLLPILPFAMADIASEKQALFAFASAVYHGNKLNWSQNIPVCSWHGVTCSLDRSCILALRVPGAGLIGTIPADTLGRLVSLQVLSMRSNRLSGSLPYDVVSLPYLQAIFVQHNELSGDLPPFLSPNLNTLDLSYNSFTGQIPSGLQNLTKLSVLNLAENSLSGPIPDLKLPSLRQLNLSNNELNGSIPPFFQIFSNSSFLGNSGLCGPPLTECSFLSSPTPSQVPSPPKLPNHEKKAGNGLVIVAVAGSFVIFLLAAVMFTMCISKRKEKKDEAGYNGKVTDGGRVEKRKEDLSSGVQMAHKNKLVFLEGCSYNFDLEDLLRASAEVLGKGSYGTAYKAILEDGSTVVVKRLKDVVAGKKEFEQQMELIGRVGKHANIAPIRAYYYSKDEKLVVYEYIGRGSFSALLHGIKGVCEKTPLDWNTRMKIILGTARGLEHIHSEGGSRLAHGNIKSTNVLLDGDHNPYVSDYGLSSLTSLPITTSRAVAGYRAQETFESRKFTHKSDVYGFGVLLMETLTGKAPLQSQGQDDAVDLPRWVHSVVREEWTAEVFDVQLMKYPNIEDELVQMLRIAMACTAWSPDRRPTMAQVVRMVEELRHSASGSRALSVGSPKESSPLSA

SEQ ID NO: 545 - protein, 299 aa, Zea mays
MASFFADDGADDLPRATSHPFDSDDFGAAAADDASAGGYASFADGGVEEVDEEITVESYGVPIRHVSGGYSPFSPDLEPNGSDGPTLPPPTEMGREEGILLREWRRKNAMELEKKEQKEKELRAQIIAEAEEFKKAFFEKRIQNCASNMVNNREREKIFVASQEKFHANADKQYWKSISDLIPHEIATIEKRGKKDKDKKPSVTVIQGPKPGKPTDLSRMRHILVKLKHAPPPHMLQPPPAPAAKEGAKDGSKEGGKDGGAKDGAAAPANDAKQPAESQETSTANGPSEAEKEQPAASE

SEQ ID NO: 546 - protein, 348 aa, Zea mays
MAKYGEGDKRWIVEERADGTNVHNWHWAERDCLEWSRARLSSLLAGLTILDGEGGLSLRTVALDKLDGEAYVNIRKGKVIPGYELSLTLSWEAEAASESGAAKVTGTAEVPYLADENADEDPDLRVTVRGDETPLALRAKDAFLSRGKPMVLEKIREFVAAMAKGGPAKDELDSKKTPTKVAGSAPAKEAVLAPAPAVEKKKAKGKDKEGFKTIEMTEKFYCRSKDIYEILMDENRWKGFTQSNARISREVGGEFSLFDGSITGVNEELQEGKLIAQKWRFGSWPDGLYSSVRLVFDEPESGVTIIKLKQTDVPEEDKYGNSTVVENTERGWRELIFQRIRGVFGFGI

SEQ ID NO: 547 - protein, 325 aa, Zea mays
MAPPPPPYARVMEDMVKGREYATQLKALLRESPEASRLVDRILHAISLTIQTAKAAAAAAEEEEEEEASEVQSEVTCTGKRKAAGGAGKRAAACRRRAQPSSVVTKSVRDLEDGHAWRKYGQKEIQNCKHPKAYFRCTHKHDQQCAAQRQVQRRDDDPDAYTVTYIGAHTCRDPATAADDELHAGSRLISFAAANATTASTTTTTGNASNRQAGHKGAVLPAEPPRQLEGGGGGGEREQELELEEVLSSLTPAGSSAATAEAVRTATPGPDQGDVTSGLQLQQQQQHWFGGGGLSGVAHLGYDDTFDLEDIVFGSITGGMYAAEY

SEQ ID NO: 548 - protein, 350 aa, Zea mays
MSSANGTTNVHGKEAAPYEEQLFKIGKVRTDLGQLSGKSALYCSDASIARYLIARNWDIRKATKMLKKTLKWRSEYKPDEIRWDDISDEAVTGKTYRTDYFDKIGRSILVMRPGCQNTKNANGQVKYLVYCMENAILNLPHGQDQMVWLIDFAGFNLGNLSIQVTKMTADVLQGHYPERLGVAILFNAPKFFEPFWKMASPLLEKKTRNKVKFVYSDRPDTMKIMEDLFNMDELECAFGGKNPATFNINDYAARMREDDKKMPSFWSPENSALASEPYQMSSQKALGSVSGAKTEDAGSGKMDDMETAPEKSEESGTESGEEVQTRTESSTVEQKNLPGEDNAPADKSGL

SEQ ID NO: 549 - protein, 398 aa, Zea mays
MGSSLKYRSGLCLIVAVVLIWVISAEVTQGIFTKYRHPFAVTYLGASLMVIYLPLSFLKDFIYNSLRRHSRNTSASKIASKSSFGGSAPLKNGEFQKMLEMESQKTIVVNCPDVSIPVVEETKPLICGITEMDDGLFKDKQLSTKEIATYGLYLCPLWFVTEYLSNAALARTSVASTTVLSSTSGLFTLFIGVLLGQDSINAAKIIAVFISMAGVVMTTVGQTWASDESEAGKSGFTQRTLLGDMFGLMSAIAYGLFTVLLKKFCGEEGEKVDVQKLFGYLGLFTLVALWWIVWPLTALGVEPKFSMPHSAKVDEVVVANSLIGSVLSDYFWALSVVWTTPLVATLGMSLTIPIAMVADMIIHGRHYSAVYILGSVQVFSGFVIANLADRFSRSLGLS

SEQ ID NO: 550 - protein, 397 aa, Zea mays
MPGLTAPSDYAEEPPRHPALKINSKEPFNAEPHRSELVASYITPVDFFYKRNHGPIPKVEDLSRYTVSISGLVNKSIQLSMADIWSLPKYNVTATLQCAGNRRTAMSNVRKVRGVGWDISALGTATWGGAKLSDVLELVGIPKLSSVTSLGGKHVEFVSVDKCKEEKGGPYTASIPLNQATNPDADVLLAYEMNGEVLNRDHGYPLRVVVPGVIGARSVKWLDSINVKEEECQGFFMQKDYKMFPPTVDWDNINWSTRRPQMDFPVQSAICTLEDVDVIKEGQARIAGYALSGGGRGIERVDVSADGGKTWVEARRYQKDNVAYVSDGPQSDKWAWVLFEATLDVPANPEIVVKAVDSAANVQPEKVEDIWNLRGILNTSWHRIKIQRSSCVERSKL

SEQ ID NO: 551 - protein, 722 aa, Zea mays
MSGGAPLLALLLLAAAAMIAPSPANAAVSYDHRAVVINGQRRILISGSIHYPRSTPEMWPGLLQKAKDGGLDVVQTYVFWNGHEPVRGQYYFGDRYDLVRFVKLAKQAGLYVHLRIGPYVCAEWNFGGFPVWLKYVPGISFRTDNGPFKAAMQAFVEKIVSMMKSEGLFEWQGGPIILAQVENEYGPMESVMGAGAKPYANWAAKMAVATGAGVPWVMCKQDDAPDPVINTCNGFYCDYFSPNSNSKPTMWTEAWTGWFTAFGGAVPHRPVEDMAFAVARFIQKGGSFVNYYMYHGGTNFDRTSGGPFIATSYDYDAPIDEYGLLRQPKWGHLRDLHKAIKQAEPALVSGDPTIQSLGNYEKAYVFKSSGGACAAFLSNYHTSAAARVVFNGRRYDLPAWSISVLPDCKAAVFNTATVSEPSAPARMSPAGGFSWQSYSEATNSLDGRAFTKDGLVEQLSMTWDKSDYLWYTTYVNINSNEQFLKSGQWPQLTIYSAGHSLQVFVNGQSYGAVYGGYDSPKLTYSGYVKMWQGSNKISILSAAVGLPNQGTHYETWNVGVLGPVTLSGLNEGKRDLSDQKWTYQIGLHGESLGVQSVAGSSSVEWGSAAGKQPLTWHKAYFSAPSGDAPVALDMGSMGKGQAWVNGRHIGRYWSYKASSSGCGGCSYAGTYSETKCQTGCGDVSQRYYHVPRSWLNPSGNLLVMLEEFGGDLSGVKLVTRTA

SEQ ID NO: 552 - protein, 570 aa, Zea mays
MDLHQLLKYRLTGANVYYEFPTENNLANTPWPASPLKSEFSSSSYTPLSSQLECDNLSALSNTPDNQSSTETISAQSISPLEVDSSYKQAAILRENTQVRPDPLYTTSRHNMQHALREIETVLMAPDADDAATSTKHEFEEHKPAQLMRQRSRTWSHESRQPSPGVVRTQLASGYPTASYEFRPEKRLRELREDPQSMVKQLLTKCAEALSEERIEEFLNLVQQARGVVSITGEPIQRLGAYLLEGLVARHANSGTNIYRALKCREPESNELLSYMKILYNICPYLKFGYMAANGAIAEALRNEDRIHIIDFQIAQGTQWITLIQALAARPGGPPHVRITGIDDPVSEYARGEGLDLVGKMLKSMSEEFRIPLEFTPLPGIYATQVTKEMLDIRSGEALAVNFTLQLHHTPDESVDVNNPRDGLLRMVKGLSPKVTTLVEQESHTNTTPFLMRFTETLDYYSAMFESIDTNLPRDNKERINVEQHCLAKDIVNIIACEGKDRVERHELLGKWRSRLTMAGFRPYPLSSYVNSVIRKLLACYSDKYTLEEKDGAMLLGWKNRKLISASAWH

SEQ ID NO: 553 - protein, 139 aa, Zea mays
MAGGKVYSFEEVRKHSDRKDCWLIIAGKVYDVTPFMEEHPGGDEVLLASVGKDATADFEDIGHSASAKELMPQYCIGKVDAATFPAKPAYVVTKDDARSSEKAATSAGAWATLLQLAAPVLLLALAFALQQNYARAKAE

SEQ ID NO: 554 - protein, 363 aa, Zea mays
MVVMGKEQQHEEEEVQGKVVQEEVQVVQETVVPVPSEEDKEAEAALVHKISSLAAAIAKLPSLSPSPEVNALFTELVTACIPRSSVDVERLGPELQEMRGGLIRLCADAEALLEAHYSDLLASFDNPLEHLSLFPYINNYILLSQLEHGLLARHVPGPAPARVAFVGSGPLPLSSLVLAARHLPGASFDNYDICGEANDRARRLVRGDGALQARMAFRTSDVADVTRELASYDAVFLAALVGMAAEEKARVVAHLGRHMAPGAALVVRSAHGARGFLYPVVDPEEIRRGGFDVLAVHHPEGEVINSVIIARKPVAVDAHATGGVGHAHAHAHGAVLNRPCLCCEMEARAHQKMEEVAVEQLPS

SEQ ID NO: 555 - protein, 337 aa, Zea mays
MDGLPDADTAPVAAAPAQKRDEWSESGILRLLEAYEAKWLLRNRAKLKWSDWVDIAREVSVHCADDAAAAGKPPGHGGGSSAKTPNQCKNKIESMKKRYRAEAAAAARAGPAAAGPTWRFFARMDGLLKGPPVCSAQVQQPELTSSIDLRAPAKPEAEVELADFATQLREAVPVPGAFSDLMNIDTNGAVPDKAEKVDNSMQKESRPADSDANVSSPRSKVADEDVEEVDKAWDRPSKRKSTEFDIAKSIELLASSFLKIEHARMEMYRETERMRVEAEIKKGEMELKRTEIMAKTHLQIARLFAKKLKQSSGKNGVSSSVTAEVDTLTKKGENGSG

SEQ ID NO: 556 - protein, 300 aa, Zea mays
MTTTTTAAAAVAQLCAGPRRRKQAAGARLDLRWARLLRLAVVTRVLRLARDQLLACSSCGGGTAARRRYRRLGPPTSASAGPVLSPVDRDDDCAADAEAAAPRDAADDEDNVVSLKVSLLGDCQIGKTSFMVKYVGDDGEEQNGLQMTGLNLMDKTMPVRGARIAYSIWDVAGDHQSVDHVPIACKDAVAILYMFDLTSRCTLNNIVDWYGRARKWNKTAIPILIGTKFDDFAQLPLEMQWAIVNQARAYARAMKATLFFSSATHNINVNKIFKFITAKLFNLPWTVERNLTIGEPIIDF

SEQ ID NO: 557 - protein, 372 aa, Zea mays
MEMESTPLLTPYKMGDFNLAHRVVLAPLTRCRAFGNVPQPEHMALYYRQRATPGGFLIAEACAVSESARGYPDVPGLWTHQQVEAWKPIVDAVHASGAVFFAQLWHTGRASPSEFQPNGQAPISSTDKQIPAQVNHSGDVNTFAVPRRLETEEIPHVVNDFRVAARNAIKAGFDGVEIHAANGYLFDQFMKDSTNDRDDSYGGSLENRCRFTAEVMAAVADEVGANRLGVRLSPFADYMDCHDSNPEALALHVIDETLNPLGVLYCHMVEPRMRVNPDDGIMTLEHMLLPFRRAFRGTFIANGGYDREEGNDAIARGRGYADLIAYGRIFLANPDLPMRFAKNAPLNKYDRSTFYTSDPVVGYTDYPFLDQL

SEQ ID NO: 558 - protein, 219 aa, Zea mays
MARPCRSSSSAAARLLLLLAAVAAALQAAAATPPVASGFIRKSCRATQYPSVCEQSLAAYGGSPPPRSPRELARAALAVSADRARAASAYVGRLCGSRSGSGDGSPRRGAGAKKGSAAAGPVRDCLENLADSVGHLRDAAQEIGGAGMARAGTRAFRWHLSNVQTWCSAALTDENTCLDGLSSRAVDAATRAAVRGRVVEVAQVTSNALALVNKVGPGY

SEQ ID NO: 559 - protein, 661 aa, Zea mays
MSLDSEASSQGGGYRSFRQITRDRLLFEMLRSTRKNSKSTWKVLIMDKFTVKIMSYACKMADITEEGVSLVEDLYKRRQPLPSLDAIYFIQPTKENIVMFLSDMSGRSPLYKKAYVFFSSPVHNELVAQIKKDSSVLPRIAALSEMNLEYFAIDSQGFITDHERALEELFSENAEGSHKYNACLNTMATRISTVFASMREFPRVHYRIAKTIDASTMTTLRDLVPTKLAASVWNCLAKYKTTIPEFPQTETCELLIVDRSIDQIAPIIHEWTYDAMCHDLLCMDGNKYVHEVPTKNGSATEKKEVLLEGHDPVWLELRHAHIADASERLHDKMTNFISKNKAAQLHQARTDGELSTRDLQKMVQALPQYSDQIDKLSLHVEIAGKLNNIIREQCLRDVGQLEQDLVFGDAGTKELINFLRTQLVVSRENKLRLLMIYAALNPEKFESDKGAKLMQLAGLSADDMIAVNNMRCLCGPDTKKSSVGGFTLKFDVHKKKHTNRKERTGEESTWALSRFYPILEQLIENLSKGELPKDEYNCMNDPSPTVHGLPTSSSARTSPAHSMRSRRTGGTWARPRGSDDGYSSDSVLKHASSDFRKLGQRIFVFVIGGATRSELRAAHKLSSKLKRDIILGSSSLDDPPQFITKLKLMSVEELTLDDLQL

SEQ ID NO: 560 - protein, 166 aa, Zea mays
MASEHAAGGEAKHDQKQSLMDKAKGFVAEKIAHIPKPEATLDGVTFKGLSRECITLHSSVNVSNPYDHRLPICEVTYTLRCAGKEVASGTMPDPGWIAASGSTALEIPAKVPYDFLVSLVRDVGRDWDIDYELQVGLTVDLPIVGNFTIPLSTSGEFKLPTLKDLF

SEQ ID NO: 561 - protein, 509 aa, Zea mays
MTIDMSIPGSSGLLNAAGKRDMKFFSNPYVLALTGAAGIGGFLFGYDTGVISGALLYIRDDFPAVKDNYFLQETIVSMALVGAMIGAAGGGWINDAYGRKKSTLLADLMFALGSLVMCAAAGPYILIIGRLLVGLGVGVASVTAPVYIAEAAPSEIRGGLVSTNVLMITGGQFFSYLINLGFTEVPGTWRWMLGVAAVPAIIQFVLMLFLPESPRWLYWKDEKAKAIAVLERIYESDRLEEEVELLATSSMHEFQSNNTGSYLDVFKSKELRLAFFAGAGLQAFQQFTGINTVMYYSPTIVQMAGFSSNRLALLLSLIVAAMNAAGTIVGIYLIDRCGRRRLALTSLAGVVVSLAILATAFILQSSSGLCMSAASGTCQGALGWFAVAGLALYIAFFSPGMGPVPWAVNSEIYPEAYRGTCGGMSATVNWVSNLVVAQTFLSIVGLVGTGPTFLIVAGIAVLAFVFVATYVPETKGLTFEQVEQMWRERAWGNSGGNCESLLAGTAAAP

SEQ ID NO: 562 - protein, 209 aa, Zea mays
MRRGYSYSPSPPRGYRRRARSPSPHDHYGGRGRDLPTSLLVRNLRRDCRPEDLRRPFGQFGRVKDIYLPRDYYTGDPRGFGFVQYYDPADAADAKYYMDGQVVLGRQITVVFAEENRKKPQEMRARDRVRGHSYDDRRYSRSRSPRYYRGRSPSRSQSYSRSPPQNPRHRLRERSYSGSPVDSRSRSGSPYEDGYRKSSRRERSLSVSG

SEQ ID NO: 563 - protein, 109 aa, Zea mays
MAAAQSSTDSLAPHLRRRPRRLVFDRRYGWIFDEWTHPADQALSGGRGMFCALTMARSLVSAAACSINYAVSSISRVLERPKRLHKKQQAWFRELECSGVVADLKLIQT

SEQ ID NO: 564 - protein, 154 aa, Zea mays
MEARRSSAALVSVAAAAAAVALLLVLAAEPSRAERFVVGDAARWTWGYNYTDWVIRKGPFFQNDTLVFMYDPPNATVHAHSVYLMRTAADYQSCNLKAAKLVASVTQGAGSGFEFVLRKRKQHYFVCGERGGIHCTMGQMKFVVKPKSSACRDD

SEQ ID NO: 565 - protein, 609 aa, Zea mays
MVFDASGSRSAAAASGNPLRVILTRGFARQVLAGRWLTVFASLLIMASSGATYIFGSYSGTLKSSLGYDQRTLNTVSFFKDLGANLGVFSGLINEVTPPWVVLAMGAAMNLSGYLMVYLAVSGRTAPPPLWLVCLYFFVGANSQSFANTGALVTCVKNFPDSRGVVLGILKGFVGLSGAVYTQLYLALYGGDDAESLILLVAWLPAAVSVVFVHTIRYMPYPRRRGGGRQETSSDSDPFFCFLYLSIALACFLLVMIVVQKQVPFSRAAYGVAATPLLILLLMPLGVVVKQEYKIYRERQLDAADPPPPTIISASATDASKKTEQQPAPAPPPTTSSFCGCVRTMFRPPARGEDYTILQALVSVDMLVLFVATICGVGGTLTAIDNMGQIGESLGYPARSVNTFVSLISIWNYAGRVTAGYASEAALARYRVPRPLLLTCVLALACAGHVLIALGAPRSLYAASVVVGFCFGAQWPLVFAIISEVFGLKYYSTLYNLGGMASPVGSYILNVRVAGRLYDAAAAQQRGRGRICLGVECYRRSFLIVTAATVVGALVSLVLVWRTWTFYRGDIYARFRDGDEGPGRDGRLPVDQKREEEEREKAAANGRKA

SEQ ID NO: 566 - protein, 510 aa, Zea mays
MERRRRRPPRLPLLVFVLVATTCPLGSSGIGSFGVGAESNGASSSFRTRSLLQIGDRNEDGLFHLPHTRALTHKSRSHRKVPTPAPAPESAPAPSPSMSPPDSSPSPSPHGSHPMPRQSTSHRHPSITPPHLVRPGPRQDGNDPLVYTPAHSRHKHFWTTYGLVAAGIAVFLLVSAASILCFRAKKMGTVRPWATGLSGQLQKAFVTGVPSLKRSELETACEDFSNIIGSTSTCMLYKGTLSSGVEIAVASSLVTSAKDWSKENESQYRKKITNLSKVSHKNFMNLLGYCEEEHPFTRVMVFEYAPNGTLFEHLHVREAEKLDWMARLRISMGIAYCLEHMHQLQTPAALRNFDSTTVYLTDDFAAKVSDLEFWNDAKGHNSTTNNELAFSPDMEDIVRKYGMVLLEILTGRVPSSEDDGPLENWVSRYFEGGMRLEELIDPSIGFFPEDTARALCEVVRSCIDRDPKKRPQMKEVAARMREITALGPDGATPKVSPLWWAELEIMTSES

SEQ ID NO: 567 - protein, 67 aa, Zea mays
MTRGDQRERDRQRAQARRPAAKGRDDGLTPEQRRERDAKALQEKAARKAAQAAGGACAKGGKNTGKK

SEQ ID NO: 568 - protein, 252 aa, Zea mays
MWHAAAAPNNLHPAVATTSSPALRRARWPIARPSSSVKVQSSTRNGNGSADNLDHLQRASKGRQQRQGASAPGPRARRVVRTTPFGLWWDSFPEARTLDQMVRTIMDADDADTDTRFGGVVPAAAAAAPTAVPRADHGRTPWEVRERAGEYLVRFDMPGMARDDVRVSVQDRTLVVAAEKKQQPAADGGGDEEGDNEEEAWPPASFGRYRTRVELPENVDVERIAAEVKDGVLYLTIPKLSAGAKVVNIQVQ

SEQ ID NO: 569 - protein, 109 aa, Zea mays
MPATTKPILLPRAWAAAPLLLLLLLVLHGRGGHCVGMEAAELEMDSEAHRRLLWEATTGRRYISYDALRGDVVPCSRTGVPYYNCRISTTANPYTRGCESITRCRDADP

SEQ ID NO: 570 - protein, 371 aa, Zea mays
MESGLLDTAAAAGLCPVAAGRRRVGSTGTARCFLSCSCASRDCRVSASYSHSISRMLSGVRSAARKRLFRSDPAELLGVANWSETGGGGAGGHQHWWTALENNFVLEATDDEYGGVVVDADRLPADRAAFARSLAASLSYWKSVGKKGVWLKLPVDLAEFVPLAVKEGFKYHHAEEAYLMMTYWIPDEPNMLPANASHQVGVGGFVINDQMEVLVVQEKYRGSSLDGVWKLPTGFILASEEIYTGASREVKEETGVDTEFVDVVAFRHAHNVAFHKSDLFFICMLRPVSSEIKIDETEIQAAKWMALEEFVKQPFIQEDHMFQKIMDICIQRLRKCYCGLTPHHVVSKFDDRTSTLYYNVAEPEDVNCSAA

SEQ ID NO: 571 - protein, 162 aa, Zea mays
MLGLPAAPPAAAAPPNPKGKGRCSAAPPPAMTGRVSLAVPAAAVSLSLFLWSSPVNAGILSGFSGLESTPGPDLPRLEFLEKWNAENQKKYTEFDNRFKKSKVLQDLLEKSRKNKEKNERMIQDKYCLRGAEWGVGDCSTEGMSDQEREDFISELKKRAGAE

SEQ ID NO: 572 - protein, 442 aa, Zea mays
MEVEILESCMVKPSDDIGTPPPPMHVVWLSNLDLLVARSHTPTVYVYRPSPDPDFFSPGVLSAALSKALVRFYPLAGRLAQDGAGRPQIHCTGEGALLVTARADATLQDIPGGFAPSDELRQMLVPSAADGEDRAGILAMFQVTSFKCGGVCVGAAIHHTAADGLAALDFVNTWAAIASKGVDEAAPAPRPWLDRTLLRARSPPDVRFDHSEYSPRGGGGPKTARVPFDSAILPMSKTQVDALRAGKKVSTFKAVVAHVWRCACIARGLAGDEDTRLYMTADARSRVRPPLPEGYLGNAIFRASAVATAGDVVSEQLDAVAGRVSGATARLDDEYVRSLVDYLEQVVGDVAGLRKGEWVMPETDLWVISWQGLPIYDADFGWGRPAFMGRACLQFSGLVYLVPGPDGDGRLDVVVAMEPKSLARFKELLYELKGAGVPCTAD

SEQ ID NO: 573 - protein, 203 aa, Zea mays
MAPKRPVSAAAAAEQPRLRGVRKRPWGRYAAEIRDPVRKARVWLGTFDTPEQAARAYDAAARKLRGPGAATNYPAPEPTAEALAEAPAASGSGSAVVYESSSASASASSCSLPLAAPSLDLSLALPAAAAAAEPYQLFADPAAAAAVTPALLHFLPPKSEEQQSYSGSSSLSSSSSSVVFDAAPPVGLRLDLNLALPPAEMVM

SEQ ID NO: 574 - protein, 155 aa, Zea mays
MFRCPSNGYGQPHPTANYHRTHSGEHVTTKVAQKPCHAGGAVQQHHVVHKESSFKELDGGNRRCFDNYPMNAANNANHHRYEAYEETYEETNCEEETYAYGAGRHHGHGSGGGGRRFQYQTHEETYEEEEEEVVVGGGDGAGAGWAQLRRPSCRA

SEQ ID NO: 575 - protein, 220 aa, Zea mays
MQRDARSWSPAPATDAAGPYAMPSPVQPSTKSTKETVKNALSRWGRKVGEATRKAEGLSRNTWQHLRTAPSIAEAAVGRIAQGTKVLAEGGHDRIFRQAFSAPPDEQLRKSYACYLSTAAGPVMGVLYLSTARVAFCSDSPLSYEASGGDRTEWTHYKVAIPLQRLRAASPSANKTKPAEKFIQLVSVDSHEFWFMGFVNYDGAVAHLQEALSGFRNLQA

SEQ ID NO: 576 - protein, 198 aa, Zea mays
MNVAVPPQSPHLRLYDCAKSAIIKIFAFPYATVCDLYCDSGMDTDKWCDAQVGHYIGIDASASGVNYARELWENRRKPFTAEFIELDPSDDGFEAQVQEKGIQADMVCCMQHLQSCFENEERAKKLLNNVSSLPKPGGYFFGITPDSSTIWTKYQKNVEAAHNKGLKTVPNSIRSENYTITFEVEEEKYELKLYTKYT

SEQ ID NO: 577 - protein, 298 aa, Zea mays
MFLADKYSSLLPFHHHHSKPSRRQQQKGEAHRFGTALAARLRGLLPLPASPLAALVRVADLLALTLAEAGPALACSGEGAAVAAHLDAGVALLDACNAIAARLDGLRRRRLLASLALHLLLSSTSPSGRTRARAALADRDPPAPPPLPWLPFEQPRGQLTAAARVLAAVDAVSSLAAAAAATVLAGGPATFPWVSGSGGDLPWAEPFNALSGQLAALGAGEVRAVDEAVRRLASALDSGTDNEGAVRAAAQEVGRRTEELAPRLDRLSDAVGGVFRAALGLRNAELGCLMVGPAGKPV

SEQ ID NO: 578 - protein, 322 aa, Zea mays
MVPAAAAVAAASPAALPRSTSPRGRRPRARACSFRCAGPSARSSALVSSYKSGSAGHGHPRIRQLRGRPDCSRQAEVMGSTVDDDEACELVSGSDLVIGEGDDSVSAYLFKAVKNNNGTGILLLSDIFGFQDSATRDFAYRVACNGYNVLVPDLFRGNPWKLNVPFDGDSFERWLAGQAPGRVSGDIDACTRWLVDEFKAAGVSKKLGVIGFCYGGGRLVETLARDAESCFSAGVCFYGSRMDASLGDRVAAPVLFVCGDGDPLCPVETVRELEGRARGARAAVYAGRGHGFAHRPQSVEEDGDAEDAFNAMRGWLHDHLLA

SEQ ID NO: 579 - protein, 506 aa, Zea mays
MSFRDQESGGEDGGRTSSASDLRKPLINTGSWYRMPPAGGVMGSRQSSLMERLGSSAFSLRDVAISATLCTLIVALGPIQFGFTCGYSSPTQDAIIADLGLSLSEFSLFGSLSNVGAMVGAISSGQLAEYIGRKGSLMIAAIPNIIGWLAISFAKDSSFLFMGRLLEGFGVGVISYTVPVYIAEIAPQDQRGALGSVNQLSVTIGILLAYLFGMFVPWRILAVLGILPCSILIPGLFFVPESPRWLAKMGKMEDFEYSLQVLRGFQTDITAEVNEIKRSLASSRRRTTIRFADIKQKRYSVPLVIGIGLLVLQQLSGVNGILFYAASIFKAAGITNSNLATFGLGAVQVIATGVTTWLTDKAGRRLLLIISTTGMVITLVIVSVSFFVKDNIAAGSHLYSVMSMLSLAGLVAFVIAFSLGLGAIPWIIMSEILPVNIKSLAGSVATLANWLTAWAITMTASLMLNWSSGGTFAIYAVVSTMALIFVCLWVPETKGRTLEEIAFSFR

SEQ ID NO: 580 - protein, 103 aa, Zea mays
MAEEKGALQSAREWVVDHKLRAVGTLWLSGIVGSIAYNWSRPGMKTSVKIIHARLHAQALTLAALAGSALVEYYDHQQGSGSKVHQYAKQFLSSDSNSGQQKE

SEQ ID NO: 581 - protein, 98 aa, Zea mays
MASSAYASWSKRWIRPEVYPLFVPMAVALGICSYQLVRNITGNPEVRVTKEKRAAGVLDNHDEGERYAMHGLRKFVRGKKPEIMASINSFFADPPKDD

SEQ ID NO: 582 - protein, 447 aa, Zea mays
MHHQQRMKQAAAAAAAAQQQQLMQQALLLQQQQQSQAQPPLFPGHHPHPGLLAAPQIEPIVSGNLPPGFDSSTCRSVYVGNIHLQVTDTVLQEVFQSIGPVEGCKLIRKEKSSFGFIDYYDRRYAALAILSLNGRQLYGQPIKVNWAYTSTPREDTSGHFNIFVGDLCPEVTDATLFAFFSGYSTCSDARVMWDQKTGRSRGFGFVSFRNQQDAQSAINDLNGKWLGNRQIRCNWATKGANAGEEKQILDTKVDLSNGSSESGKENPNEDGPENNPQFTTVYVGNLPHEATMNDVHLFFHSLGAGSIEEVRVTRDKGFGFVRYSTHEEAALAIQMGNGQLIGGRQIKCSWGSKPTPQGTASLPLPPPALAPFSTGVSATDLLAYQRLALSKMASNHPALMGQHSLKQVAALGIGGGASQSIYDGGFQGINTVTGTTSAQQQQQLMYY

SEQ ID NO: 583 - protein, 349 aa, Zea mays
MSSSSVQQTAFPEQEADAEGETNPELYQHFANLVSSLPSSKGLSNNKFYRHGQGWHCSEVGIVGAMVTDACFSARPSDVIIATLPKSGTTWMKSLLYATVHRRERPVVGAAAADQHPLNSWGPHDLIKFFEYQLYTRDRVPDLDRLPDPRLFATHVPFVSLPSSVVATPGCKIVYVCRDPKDHLVSLWDFVNKYFRVKDGLEPLSVEAAAELFCAGLTPFGPYWDHVLGYWRAHRADPDKVLFFRYEEMQRDPAAHVRRLAEFVGLPFSSEEEDGGVVDAVVGLCSFERMRGMAPTKGGRTEFPIGVVPNSSFFRQGVVGDWVNHLSPEMARRIDAITADKFRGSGLVV

SEQ ID NO: 584 - protein, 571 aa, Oryza sativa
MEGALLCAANHAPLTPITFLDRAALVYPDRPAIVASSSGLTRTWRETRDRCLRLTAALAALGVHRHHVVAVFAQNIPAMCELHFGIPMAGAVICTLNSRLDAAMASVLLRHSEAKLIFVDCALLDVAHDAIRRISQSGATPPVLVLISELLDDPSDAKLPSGRVDYEYEHLVGNAGSSPEFAVRWPADENEPIALNYTSGTTSRPKGVIYSHRGAYLNSLAAVLLNDMASTPVYLWTVPMFHCNGWCMAWGVAAQGGTNVCVRRVTAATIFDAVARHGVTHMGGAPTVLSMIVNATAEEQRPVARRVTVMTGGAPPPPKVLHRMEEQGFLVIHSYGLTETYGPATVCTWRPEWDALPAEERARIKSRQGVHHHGLEVDVKDPATMRSVPRDGKTMGEVMLRGNTVMSGYYKDGAATAEALAGGWFRSGDLAVRHEDGYVKVLDRSKDIIISGGENISTIEVEAALFSHPAVEEAAVVGRPDDYWGETPCAFVKLRPGAAAAAKAGVVEEELMAYCRARLPRYMAPRTVVVVEEGLPKTATGKVQKFELRARAKAMGTVPAAAAAKSKRSKL

SEQ ID NO: 585 - protein, 327 aa, Oryza sativa
MRNPPGRHLLRVATRAVRSSSALGSGGGGGGASTSATSPVAASSSSGGRPRTRSGGRLLRATSPPPPSAIAAAACWESRTMRREGEEEWEEVVAGAEEAVHGAPVPVAEEEEEYRVVFWSPPTGDEVRAAFTSIEEVFGDPFRAHSYETEEQSALSTSVHSSSGNSSGSDDWIEPAAYALNSTALLTREHRNVLDAFRLLQKDPNVQKMVMSLSCDRAVWDAVMNNEAVQEFRRSFQDDKEAAGRKGNPGGPAGVLKWILGNTQAKIMEFMNNIMKIVNMLFHSDDDEAKPDLYTDAVKVSFMLSVFIFIVVAIARINFEPWDFKVW

SEQ ID NO: 586 - protein, 459 aa, Oryza sativa
MGLEMEGMAAAIGVSVPVLRFLLCFAATIPTGLMWRAVPGAAGRHLYAGLTGAALSYLSFGATSNLLFVVPMAFGYLAMLLCRRLAGLVTFLGAFGFLIACHMYYMSGDAWKEGGIDATGALMVLTLKIISCAINYSDGMLKEEGLRDAQKKYRLAKLPSLIEYFGYCLCCGSHFAGPVYEMKDYLEYTERKGLWASPTPSPLLPTLRALVQAGACMGLYLYLSPQFPLSRFSEPLYYEWGFWHRLFYQYMSGFTARWKYYFIWSLSEAAIIISGLGFSGWSDSSPPKAKWDRAKNVDVLGVELATSAVQLPLMWNIQVSTWLRYYVYERLVQKGKKPGFLQLLGTQTVSAVWHGLYPGYIIFFVQSALMINGSKVIYRWQQAVSNPVFHAILVFVNFSYTLMVLNYSCIGFQVLSFKETLASYQSVYYIGTIVPIVVVLLGYVIKPARPVKPKARKAE

SEQ ID NO: 587 - protein, 784 aa, Oryza sativa
MVARMMRWPRPPAARKFRVRLVVRRAEGLQQPCAAAAEHAASAEAEAPPTRVAAEVRWKGPKASPLSSLRRTAVRRNRTREAEAEAAAVVACATAADDAAAAAGAGDAAGVVVAAWEEEFESTVTLAAASHREHAAFQPWELAFSVFTAANRGPKIKPSILGTASLNLADYASAAEENIEIILPLSVPNGSAESAPSLHLTLGMVELRAFQETSDASQRSAMAAPLSPSSGDSAPVGKDEVSVIRAGLRKVKILTDLVSTRRSKKTSQDDESSEEKCYVNSDGAEYPCDIESLDDDLDDRAQQDEVGDSTVRKSFSYGSLQSVNYVGGLVYAHAKIDGEHEDWIYYSHRKSDAGYHVEGKPSSTVEETMLPTVKRSILPWRKRKLSLRSLKAKGEPLLKKAYGEEGGDDIDYDRRLLTSSDGSVSEGSRGEDGSINGMVSEFGDDNFVVGNWELKEIVSRDGHLKLSSHVFFASIDQRSERAAGESACTALVAVIADWFQSNQDIMPIQSQFDSLIREGSLEWRNLCENLMYRERFPDKHFDLETVLQAKIRPLTVSSSKSFIGFFQPEGADDMHRFDFLDGAMSFDSIWAEISKAAEYSSSDNPNLYIVSWNDHFFLLKVERDAYYIIDTLGERLYEGCNQAYILKFDNDTMIHKLPEKAPSSPNSSGPLKDSSRSSSVEQDSEDGTEENILVSKGKESCKEYIKSFLAAIPIRELQVDIKKGLMASTPLHHRLQIEFHYTASSPKEITSAPQILTIEAPFEFSWPEPPPAMEIALAPAVAVV

SEQ ID NO: 588 - protein, 87 aa, Oryza sativa
MGCDDKCGCAVPCPGGTGCRCASSARSGGGDHTTCSCGDHCGCNPCRCGRESQPTGRENRRAGCSCGDSCTCASCGSTTTTAPAATT

SEQ ID NO: 589 - protein, 122 aa, Sorghum bicolor
MSGSAFNAFKSRVPVAWSPRLYITLVRGLPGTRRLHRRTLEAMRLRRCHRTVEHRTTPSLLGMLTQVKRLVAVETEEMYNARKQAEAERRAPRPPLVVSHHPPPPTPKPAAAAAEGAATTAQ

SEQ ID NO: 590 - protein, 282 aa, Sorghum bicolor
MAAAGSSPSSSSSKRLEGKVALVTGGATGIGEAIVRLFTEHGAKVCIADIQDEAGQQLRDALGGDAQGVMFVHCDVTSEEDVSRAVDAAAERFGALDVMVNNAGVTGAKVTDIRAVDFAEVRRVLDINVHGVFLGMKHAARVMIPQKRGSIVSLASVASAIGGLGPHAYTASKHAVVGLTKSVAAELGRHGVRVNCVSPYAVPTALSMPHLPQGARADDALTDFLAFVGGEANLKGVDAMPKDVAQAVLYLASDEARYVSALNLMVDGGFTAVNHNLRPFDD

SEQ ID NO: 591 - protein, 143 aa, Sorghum bicolor
MAAASSMLTAASLSFSPLPAPRLPAAASFAPPRRAAAALVVRAAAASSKSPAAAETAPKKKRATGITQPKPVSPALQAIVGEPVIPRTEALKRLWAYIKEHNLQDPSDKKVVICDEKLKVLFAGRERVGFLEIAKLLNPHFVK

SEQ ID NO: 592 - protein, 383 aa, Sorghum bicolor
MTSCFNGGAGWPEPVVRVQHVSDTCGDTIPERYVKPPSERPCLSPAAASSGGVGGGGGGGPNIPVVDLSMLDVDATSRAVAAACREWGFFQAVNHGVRPELLRSGRAAWRGFFRQPAVVRERYANSPATYEGYGSRLGTAKGGPLDWGDYYFLHLLPASLKSHEKWPSLPSSLRGTTEEYGEEVLQLCRRVMRLLSSGLGLEAGRLQAAFGGEGGEGACLRVNLYPRCPQPELTLGVAGHSDPGGMTMLLVDDHVKGLQVRSPDGQWIIVDPVPDAFIVNVGDQIQVLSNASYKSVEHRVTVSAAEDRLSMAFFYNPRSDLPIAPMPELVGPGRPALYPEMTFDEYRVFIRQRGLAGKAQLQSLQANQTAAAAAAAGSSSTCS

SEQ ID NO: 593 - protein, 387 aa, Sorghum bicolor
MARLLLLLGAAMVLLASAATAQDCLSATFSGGRTFGKCNSMPTLSASLHWTYHPENGTADVAFRAPSDTSGWVGWGINPTSGNSMVGSSVFIASQDSSGVVSVLMTYLETTSQPALTNNTFKFNVPIGPAAEYSDGAYTIYATVELPGNSTQQYTVWQAGPTSNGAIAQHPLSPSNRASTQSLDFLSGSSTAASNSKLHRRNIHGLLNAIAWGILIPIGAIIARYLRVFESADPAWFYLHIVCQCSGYILGVAGWGLGLKLGSESAGITYKPHRNLGIAIFSLATLQVFALLLRPDKKNKYRLYWNIYHHSVGYSVIVLSAINIFKGLDILQPASGYKTAYIVILATLGGIALCLEAITWPIAIRKRRRNAADKAAVGNGNGWQQGA

SEQ ID NO: 594 - protein, 645 aa, Sorghum bicolor
MGKMNCFSGLLSGKRKASKGKNKGAYVKKGSGNDCPKVKPVEFMDMADTVVDDVVSRGGDSSVPASACNSRFVVHAAAQLPRHASGENGDKAAAKKESSAADDDLVAGVGSSGHSSYGTGNSDAKSTEPDDGERSSLGRMSPTASPKLMRSCSNIETTRSVVPAGSDLPAKSRSYNDLKILPPGRSTAARSGAIDASPTASFRTSCSADRVMLKKRSSRQVLPSRSRKLWWQMFLWSHRNLHRPGASATMPTLLPPSPGQEEEEEEGGAAHQHDGYTSDTLGAVTADAKNKGVAIEADPITSQWVAFSAEASPLDRVSAWVNSLGDGSFHAVDEDDATGHGSGGEGAARPRRQRCSEIVELSTATAGGKRNPEAKRRAADEAAQASGIVQTLNTFSSVAHIAGMGLKTVPTIAAFSTLRAVNLSGNTIVEISAGSLPKGLHSLDLSRNKIAIIEGLRELTRLRVLNLSYNRISRIGHGLSSCTAIRELYLAGNKISDVEGLHRLLKLAVLDVSFNKITTAKSLGQLVANYGSLRAINLLGNPVQANTGDDTLRKAVSGLLPRIEYLNKQAVKPQRAREVAKDSVAQAALGNAGWNSRRRLTRRLSQSPGSAGKGGRGRDGNGNGSRRGSRSRSMTRPQSSSLPRR

SEQ ID NO: 595 - protein, 366 aa, Sorghum bicolor
MWVTSSMPQVWDEEAAAKGGGAAAVTPAPAAAMLGSLAGWLSRTVQPQPPPPRVCGTEGGPPVTAPRLRLRDGRHLAYCESGVPRDQARFKVVFSHGFTGSREDSVRASQEVAEELGVYMVGFDRAGYGQSDPNPNRSVKSAALDVEELADALGLGPKFYVIGISLGCHAVWGALKYIPDRIAGAAMMAPVVNYWWPGFPPELAAEVYAKQEVGDQWALRVSHHAPGILHWWMDQSWLPTSTVVAGTTPLPNARDAEIRRNMQADGTFQQKREQATQQGIHESYYRDMTVMFGKWEFDPMALPEPPCPVHLWQGDEDGLVPVVLQRYLAGKLAWVNYHELPGTGHFLSAVPGLGDTVLRTLFGQKQ

SEQ ID NO: 596 - protein, 241 aa, Sorghum bicolor
MSPPPSPLVVLPILLLLLLLLAAASPSLAAANAAGAVAPAPVPTPWPEQFHAVVFTNLTESGGRLQLIDLYYDWPRGRNLNLIRDQLSGDPLYDVEWTNGTSYYFDSGSCRTIRFPVGLLPPDWLAAGAVYLGREHVDGFDCHLWTKVDFVWYYEEVATGRPVRWNFFNGMQQHVMSFEVGGVLEDSKWQAPAYCFNGGNADTTNVAAGGVDSEAGRVDVMNSMIRFAGAPAAAVAASFDQ

SEQ ID NO: 597 - protein, 317 aa, Sorghum bicolor
MDYARSMISSSAVPFRAAGDGDGGGQVFLFGGRGGGGFLRGLPLVGGASAAAGAAADGRRKRAFQLTTAHEEPQLELGDDELCGGFDYELLHGPQQQERTKRRLTAEQVRELELSFEEEKRKLEPERKSELARRLGIAPRQVAVWFQNRRARWRTKQLEQDFDRLRAAHDDLLAGRDALLADNDRLRSQVITLTEKLQAKESSASEPEEFTVATQETAYALFEEDKLCLCSEIATGSTAAAAPGSNDSPESYFAGACSPPSSPEDDGCGGADDRTFFLPDALLATGVEESLERAAEEDDGAGTQLNNWAWLWNDQQY

SEQ ID NO: 598 - protein, 391 aa, Sorghum bicolor
MGSEGRAWNGAAGSSGHGGGGGGVEAKAITAALSAAEVPRMAVSVDISLPLPEMSPDIIYLCKQLVIGWCKIDSSRFSIETVSGGITNLLLKVSVKEDDGNESAVTVRLYGPNTDLVIDRKRELKAIPYLSAAGFGAQLLGIFGNGVVQSFIYARTLSPADMRDPKIAAEIAKELHKFHQVDIPGSKQPQLWNDIFKFLKKAAALKFEDNEQQKRYEKISFREIQDEVQELKDLLDTMHAPVVYAHNDLLSGNLMLNDLEGKLYFIDFEYGSYSYRGYDIANHFNEYAGLDCDYNLYPDKDAQYNFFRNYLRPDRPSEAQAQDMEVLYVETNTFRLASHIYWALWALIQAKVSPIDFDYLGYFFLRYGEYKKQREPCFSLAQSFLSKPRNV

SEQ ID NO: 599 - protein, 366 aa, Sorghum bicolor
MPNWPTILLVWSYGETCELLLSRVRQMPCLLYSSLWRSLAATCDCESPCQTGQAWYGETCWSCFSLGFGRCHACCIPLCRDFQLRPVTQRVNGAPALSQTSLGPGQGARQQAASHGAYKGLKIPAKSAGSHCVQGTQFPPNLLKSRIRGISQQKVGHTPQQNHTPRPRLLVPDTTSTGPLRSCAHGTTAVSLTRSSPAAAMSWLLVVAVLAGFALGPSAGTDHIVGANHGWNPNINYSLWSGNQTFYVGDLISFRYQKGTHNVFEVNETGYDNCTMAGVAGNWTSGKDFIPLPEARRYYFICGNGFCLQGMKVAITVHPLPHNATSKGSSTRGGTGAQEEAAAAALGARSAAWLATLAVAAVSAIC

SEQ ID NO: 600 - protein, 531 aa, Sorghum bicolor
MAGGVVVNAGGGKDYPGKLTMFVLFACIVAATGGLIFGYDIGISGGVTSMNPFLMKFFPSVYHKEQEAERNQSNQYCKFDSQLLTMFTSSLYLAALVASFVAATVTRVAGRKWSMFGGGVTFLVGAALNGAAKDVVMLILGRVLLGIGVGFANQSVPVYLSEMAPARLRGMLNIGFQLMITIGILCANLINYGTAKIKGGWGWRVSLALAAVPAAIIAVGALFLPDTPNSLIDRGYTDDAKRMLKRVRGTEDVEEEYNDLVAASEESKLVAHPWRNILQPRYRPQLVMAIAIPMFQQLTGINVIMFYAPVLFKTLGFADDASLMSAVITGLVNVFATFVSIVTVDRLGRRKLFLQGGTQMLACQIVVGSLIGAKFGFSGVAEIPKGYAAIVVFFICAYVAGFAWSWGPLGWLVPSEIFPLEIRSAGQSINVSVNMLCTFIIAQAFLPMLCRFKFILFFFFGAWVVVMTIFVALFLPETKNVPIEEMVLVWKSHWYWGRFIRDEDVHVGADLEMPSANGNGKVGAGKLVGMQ

SEQ ID NO: 601 - protein, 2182 aa, Sorghum bicolor
MANLGGGAEAHARFKQYEYRANSSLVLTTDSRPRDTHEPTGEPETLWGRIDPRSFGDRAVQNKPPELEEKLSKSRTKKSKRDAAAAADPADLPRRDAKRRRRAASTQEVSVLSLTDDAVYKPQTKETRAAYEALLSLIQQQLGGQPLDVLAGAADEVLATLKNDKVKNPDKKKDIEQLLNPISSQLFDQLVSIGKLITDFHDAAAGDAAGVPSADGTDTTLDDDVGVAVEFEEDEDEESDFDQVQDDLDEDDEDDMAELNGPGGMQMGGELDDDDMQNANQGLAVNVQDIDAYWLQRKISQAYGDGDIDAQQSQKLAEDILKIIAEGDDRDVENRLVMLLDYEKFDLIKLLLRNRLKIVWCTRLARAEDQEQRKKIEEEMASDPSLAPILEQLHATRASAKERQKNLEKSIRDEAKRLLNNDAGADGARDRRAAERDMESGWLKGQRQLLDLESLSFHQGGLFMANKKCELPTGSFRTPHKGYEEVHVPALKAKPYETSEKIVKISDMPEFARSAFDGMTQLNRVQSRVYDTALFKPDNILLCAPTGAGKTNVAVLTILQQIGLHMQDDGQFDNTKYKIVYVAPMKALVAEVVGNLSNRLAGYNVTVRELSGDQNLTKQQIDETQIIVTTPEKWDIVTRKSGDRTYTQMVKLLIIDEIHLLHDNRGPVLESIVARTVRQIETTKEHIRLVGLSATLPNYEDVALFLRVRKESLFYFDNSYRPCPLAQQYIGITVRKPLQRMQLMNEICYEKVMAAAGKHQVLIFVHSRKETAKTAKAIRDTALANDTVSRFLKNESASQEILGTHAELVKNNDLKDLLPYGFAIHHAGMARVDRELVEELFADKHIQVLVSTATLAWGVNLPAHTVIIKGTQIYNPEKGAWTELSPLDVMQMLGRAGRPQYDTHGEGIILTGHSELQFYLSLMNQQLPIESQFISKLADQLNAEIVLGTIQNAREACSWLGYTYLYIRMLRNPTLYGLPADILESDKTLDERRADLIHSAANLLDRNNLIKYDRKTGYFQVTDLGRIASYYYISHGTISTYNEYLKPTMGDIELCRLFSLSEEFKYVGVRLDEKMELAKLLDRVPIPVKESLEEPSAKINVLLQAYISRLKLEGLSLSSDMVYIRQSAGRLLRALFEIVLKRGWAQLAEKALNLCKMVDKQMWSVQTPLRQFTGIPKEILMKLEKKELAWERYYDLSSQEIGELIRYPKMGRQLHKCIHQLPKLNLSAHVQPITRTVLGFELTITPDFQWDDKVHGYVEPFWVIVEDNDGEYILHHEYFMLKKQYVDEDHTLNFTVPIYEPLPPQYFIRVVSDKWLGSQTILPVCFRHLILPEKYAPPTELLDLQPLPVSALRNARYEGLYSAFKHFNPIQTQVFTVLYNSDDSVLVAAPTGSGKTICAEFAILRNHQRAVSGESNMRVVYIAPIEGLAKERYRDWERKFGEFAKVVELTGETAADLKLLDKGEIIISTPEKWDALSRRWKQRKHIQQVSLFIVDELHLLGSDKGHVLEVIVSRMRRISSHIGSNIRIVALSASLANAKDLGEWIGATSHGLFNFPPAVRPVPLEIHIQGVDIANFEARMQAMTKPTYTAITQHAKNSKPALVYVPTRKHARLTALDLCAYSSVEGAGTPFLLGSEDEMDTFTRGVEEETLKNTLKCGVGYLHEGLSELDQELVTQLFLGGRIQVCVASSTMCWGRPLPAHLVVVMGTQYYDGRENAHTDYPITDLLQMMGHASRPLQDNSGKCVILCHAPRKEYYKKFLFEAFPVESNLHHFLHDHMNAEVVVGVVENKQDAVDYLTWTFMYRRLTKNPNFYNLQGVSHRHLSDHLSELVETVLNDLESSKCVAIEEDMYLKPLNLGLIASYYYISYTTIERFSSMLTQKTKVKGLLEILASASEYAELPGRPGEEEFIERLVRHQRFSIEKPKYGDPHVKANALLQAHFSRHTVVGNLAADQREILLSAHRLLQAMVDVISSNGWLSLALSAMELSQMVTQGMWDRDSVLLQVPHFTKDLARRCQENEGKPIESIFDLAEMGVDEMRDLLQLSNSQLQDIIEFFKRFPNVDMTYEVREGDDITAGDNVTVQVTLERDMTNVSSEVGPVHAPRFPKPKEEGWWLVIGDSSTNQLLAIKRVALQKRARVKLEFSAPAEAGRKDYMIYLMSDSYLGCDQEYEFTVDVKDAGGD

SEQ ID NO: 602 - protein, 277 aa, Sorghum bicolor
MAVARLRAAAAARLPPALSRGERRPLGTAAEVATTAGPGAARWELMGAREYYDYRRAIYGDITHKAILVDAAGTLLAPTEPMAQVYRTIGQKYGVDYSEDEILMRYRRAYAQPWGRSRLRYVNDGRPFWQYIVSSSTGCSDLQYFEELYQYYTTEKAWHLCDPDAGRVFEALRRAGVKTAVVSNFDTRLRPLLQALKCDGWFDAVAISAEVAAEKPNPTIFLKACELLGVKPEEAVHIGDDRRNDVWGARDAGCDAWLWGSDVYSFKEVAERIGVEV

SEQ ID NO: 603 - protein, 400 aa, Sorghum bicolor
MASLAAVKKVLVLVPITAGSEPVEAFVPIAVLRRAGADVTVAAAGAGAGLRVHAMYGVTVVADANVADCADASYDLVALPGGVPGADNLGGCAALESIVRRQALGGGLYAAICAAPPLALARWGLLDGVKATAHPAFVDKFPAEVAAVDANVVVDGRVVTGRGPAPAMEFALALVEQLYGKDKVDEIAKPMMVRYEPGYAFKELNPVQWQCSGTPKVLIPVANGSDEMEVLVTVDVLRRANADVVVASAEGGDAEVVVVARHGTRIVADALLVDAVAAGQQFDFVVVPGGMAGAKTLAGTEALVALLKEHAAAGRAYGAIGAATAEVLEPHGLLELEGKKATTTCASMADSRECGSRVVVDGNLATSSGPGTAMEFALAVVEKLLGAEAAREVAEALLFV

SEQ ID NO: 604 - protein, 120 aa, Sorghum bicolor
MQAVGIRRGLTIDPAGEEEPAAARVGRLVRESPVVIFARPGCCMAHVMKRLLQAVGAHATVIELDAGAAEEEELAAGAEGAGVPALFVGGDPVGGLEGLMALHLSGRLEPRLRELGALCA

SEQ ID NO: 605 - protein, 430 aa, Sorghum bicolor
MAINGEEAPPLLLDEAARPRRVALFVEPSPFAYISGYKNRFQNFIKHLREMGDEVIVVTNHEGVPQEFHGAKVIGSWSFPCPMYGKVPLSLALSPRIISEVAKFKPDIIHASSPGIMVFGALAIAKLLGVPLVMSYHTHVPVYIPRYTFSWLVEPMWQVIRFLHRAADLTLVPSVAISKDFETAQVISANRIRLWNKGVDSASFHPRFRNHEMRVRLSDGEPEKPLVIHVGRFGREKNLDFLKMVMDRLPGVRIAFIGDGPYRCELEKMFEGMPAVFTGMMQGEELSQAYASGDVFIMPSESETLGQVVLESMSSGVPVVAARAGGIPDIIPEDQEGKTSFLFTPGDLDDCLSKVQQLLTNREFRDNMGRTARSEMEKCDWQAASKTIRNEFYNAAIWYWRKKRAELVKPLQWLAQMFLPAPEVRSIKQC

SEQ ID NO: 606 - protein, 311 aa, Sorghum bicolor
MVLLRVCHRFGRPPRFPSFLSMAAPQQPGKTLPRPCPSPPLSGSAPKRFRAMATDVAAAAVDPPAARGCPAMKAEFAKHAEYLNALNDKRERLVKASRDVTMNSKKVIFQVHRITKVNRDEVLSKAENDLAAVVNQYIAKLVKELQGTDFWKLRRAYTFGVQEYVEAATLCRFCKTGTLLSLAEINDSLLALSDKSVEPLQLNVLDYLLGVADLSGELMRLAIGRISDGEVEYAKTICAFVRDIYRELTLVVPLMDDNNEMKKKMEVMLQSVVKIENACFSVHVRGSEYIPLLGSSGDPDYSFFGASDFDQ

SEQ ID NO: 607 - protein, 260 aa, Sorghum bicolor
MANLFLKQAKQYVATRPVYPPELFDFIASKTPRRDMAWDVGTGNGQAAASLATLYEAVVGTDTSAQQLAYATRLPNVRYVHTPPDLPLEGIHATVAAPASVDLITVAQAFHWLDLPRFYAQARSVLRHGHGVLAAWCYTEPRIDAAVDAVFWRLYHGSENYWAPNRRMVDDEYRSADFPFDPVEGETHTGPFQFSTHRRMDLDDYLMYITSWSAYQTAKDNGVELLDEDTVQEFAAAWGGDGKEVKTVTYPIFLRIGKVR

SEQ ID NO: 608 - protein, 852 aa, Sorghum bicolor
MASNGGGSSPPSISSPDGRPSSPLPVTNSSPSQPTRRSGGRRRRGSASPYASSPSLGGFETPPHPGRRTPSGAGAGAARQQRQNWTGRFPPTPSTPMSTDDIPPSSEAGDDETDGGGGGGVDATPVFVWGTNISVQDVNAAILRFLRHFRDPRDAGRVDPVMDEGKYMRAIHRILELEGGESLDVDAHDVFDHDPDLYSKMVRYPLEVLAIFDIVLMDLVARIEPLFEKHIQTRIYNLKSSICLRNLNPSDIEKMVSIKGMIIRCSSVIPELKEAVFRCLVCGFYSEPVMVDRGRVTEPHVCQKEQCKATNSMTLVHNRCRFSDKQIIKLQETPDEIPEGGTPHTVSVLMHDKLVDAGKPGDRVEITGIYRAMSIRVGPTQRTVKSIFKTYIDCLHIKKTDKSRLHVEDTMDIDNSNASKSTEEDFLSDKVEKLKELSKLPDIYDRLTRSLAPNIWELDDVKRGLLCQLFGGNPLKLPSGASFRGDINILLVGDPGTSKSQLLQYMHKLSPRGIYTSGRGSSAVGLTAYVTKDPETGETVLESGALVLSDKGVCCIDEFDKMSDNARSMLHEVMEQQTVSIAKAGIIASLNARTSVLACANPTESRYNPRLSVIDNIHLAPTLLSRFDLIYLILDKADEQTDRRLAKHIVSLHFENPNLEELEVLDLQTLVSYISYARKYIQPQLSDEAAEELTRGYVEMRKRGNSPGSRKKVITATARQIESLIRLSEALARMRFSEVVEVRDVVEAFRLLEVAMQQSATDHATGTIDMDLIMTGISASERQRRENLVSATRNLIVEKMQLGGPSMRMIELLEELRKQSSMEIHLHELRGALGTLMTEGAVVIHGDNVKRV

SEQ ID NO: 609 - protein, 278 aa, Sorghum bicolor
MAGIVVVFDFDKTIIDVDSDNWVVDNLGFTELFERLLPTMPWNTLMDTMMGELHAAGKTLGDVAEVLRAAPIDPRVPAAIKAAYALGCDLRVLSDANAFFIETVLEHHGIRGCFSQINTNPSHVDADGRLRIGPYHAAPHGCGVGTCPPNMCKGLVLDRILREAAAGTTGRSTKRVIYLGDGRGDYCPSLRLAREDFMMPRRGYPVWDLIREDPARVQAEVHPWADGADLEETLLRLVGRALVEEAALPPPLDCKLESTMPVAAQDGGMPIMPLGVKN

SEQ ID NO: 610 - protein, 108 aa, Sorghum bicolor
MRREGRQHGWVFTVDPSLVDAEGKQCRSRAVQVDGAAAANGGFVRAPRKPTNHTKPAVGRAYKALIGKGEAGSGRGRHKFKHDEAKMYHLYLEGADDAYADAMLEFDW

SEQ ID NO: 611 - protein, 402 aa, Sorghum bicolor
MQVAVNTSTVGAHQHPTKSSFLRPSPPCRVYFHASPRPKNLRAIAMATKSQLQEQLVITRPDDWHLHLREGGVLEAVVPHSARHFGRAIIMPNLKPPVTTTARAVEYREEIMRALPPGSSFEPLMTLYLTDNTSPEEIKLARKSGIIFAVKLYPAGATTNSQDGVTDIFGKCLPVLEEMVRQEMPLLVHGEVTDPHVDTFDREKVFIDKILAPLVQKLPQLKIVMEHITTMDAVNFIESCEEGHVAATVTPQHLLLNRNALFQGGLQPHNYCLPVLKRETHRQAIVSAVTNGSRRYFLGTDSAPHDKQNKECSCGCAGIYSAPVALSLYAKVFEEAGALDKLETFTSFNGPDFYGLPRNTSKIVLRKNAWKVPGTYKHSSGEIVPMFSGSTLEWLPSDQPKE

SEQ ID NO: 612 - protein, 151 aa, Sorghum bicolor
MGGGSCCVCKEAPPKYKCPSCRTPYCSVTCFKKHKEESCQKTSPQEEISKSPLQEEVTALNTTCIAESPNTVGPTKALEVEDPSWVVDNNRLRSLAELKGIQDALRDPELQKMILKIDGSLEPEKELEKLMEGQAFGQFADKILDIVSPQE

SEQ ID NO: 613 - protein, 563 aa, Sorghum bicolor
MGKKGNWFTALKKAFTSSPKEKPPNVHQLVAQYPSSHGHGRDKKRWGGFGRTRSHAEPASPAAGALINIPLYREPSSIEKILGDAEMDQQRQYYAATRAQYQITPARPTTAVAASAAAPLPQPVVGTARERERERERSREDKPAAVVLPLPPPSPPPLIRRFDHDREQQQKLQQLQLQPQSRAETEWRRQPQPQPQPRRHRAARQRAAPPDRARAAAVAIQSAFRGYMARRNYRSLRGLIRLQGVMRGASVRRQTAQAMRCMQTLVRVQAQVRASRVEAMERRNRQHHGAMLRDGGRWRAGSQDGGIWDDSRLTREEADARTKRKVEAVIKRERALAYAYSHQLLKATPMAAHAILADLQSGRSPWWWTPIERHHEPGSYRPVEPAISKPRPALAIAHRETTPMAMTAATTPARSVVSAYSKTRTTRPVTKVGAPPAPSLSYVGSIRDDESLTSCPAFGGVPNYMTPTLSASAKARARAHLQQQQKAAQEKPRFSFGLGQSIGSWAKSPFWKAGGGGGLPSSRVATPAASVAGGRHRSTRSISGLSVDSTVSMPAGIGRRPFK

SEQ ID NO: 614 - protein, 523 aa, Sorghum bicolor
MEDWLFYSLTTLLCLLCSLLLRARTPGSKDRHADSSSALPPLPPGPTPLPVLGPLLFLARRDFDIEPVLRRIAREHGKVFTFAPLGPARPGIFVADRAAAHRALVQRGAVFASRPPSTASSAVLTSGGRNVSSSPYGATWRALRRNLASGVLNPSRLRAFSPARRWVLDVLASRVRADGRHGETPVAVMEPFQYAMFCLLVYMCFGGDRLGDDARVRDIEATQRELLANFLSFQVFSFLPSVTKLVFRRRWEKLVSLRRRQEELFFPLIRARREAGADGDCYVDSMVKLTIPEDGGRPLTDGEIVSLCSEFLSAGTDTTATALQWILANLVKNPAMQDRLRDEVSSVVVGADGEVREEDLQAMPYLKAVVLEALRRHPPGHFVLPHAVHEDTTLDGYRVPAGAPVNFAVGDIGMDEEVWKAPAEFRPERFLPGGEGEDVDLTGSKEIKMMPFGAGRRVCPGMALAMLHLEYFVANLVREFEWREADGEEVDLTEKLEFTVVMKRPLRARAVPLRSPPPAVAAA

SEQ ID NO: 615 - protein, 152 aa, Unknown
  Sequence found in Organisms: Zea mays, Pennisetum glaucum, Sorghum bicolor, Saccharum officinarum
MAGMGDMPMRPARPGPPMQHRGPPPMARLRPEPIDREKTCPLLLRVFTRVAGHHQNEEFAVRGKEPKDEVQIYTWKDATLRELTDLVKEVALPARKRNARLSFAFVYPDKNGRFVVRQVGSTFAYGHGRGDDAKTLAELGFQIGDYLSVAIM

SEQ ID NO: 616 - protein, 386 aa, Sorghum bicolor
MKQVWGRSSKDMTAMPPLRHRGAAKKPMWIIVLLSLVCVALMGAYVYPPRRYSACYFFASSVCTPFKDWLPAVARERTDEEIVSSVVIRDLLSMPMAVSKNPKIAFMFLTPGTLPFEKLWEKFLQGHDGRYSIYIHASREKPVHSSSLFVGREIHSEKVVWGRISMVDAEKRLLANALEDVDNQIFVLLSDSCVPLHTFDYIYNYLMGTNVSFIDCFLDPGPHGTGRYSMEMLPEIEQRDFRKGAQWFAITRRHALLILADNLYYNKFKLYCKPAEGHNCIADEHYLPTLFNMVDPGGIANWSVTHVDWSEGKWHPRSYRAADVNYQLLKNITSVNENFHITSDDKKVMTRTPCMWNGTKRPCYLFARKFYPESLNNLLKLFSSYT

SEQ ID NO: 617 - protein, 69 aa, Unknown
  Sequence found in Organisms: Pennisetum glaucum, Sorghum bicolor, Setaria italica, Triticum aestivum
MADWGPVVVGVVLFVLLSPGLLCELPGTHRHVDFGGFHTNGKAIFVHTLIFFAAFTILTLALHVHIYTG

SEQ ID NO: 618 - protein, 368 aa, Sorghum bicolor
MGAPSPAMWAGLVLVALLAASGPAATAAAGLPRFAEAPEYRNGEGCPAPVAGAGVCDPGLVHIAMTLDAHYLRGSMAAIYSLLKHASCPESLFFHFLAAEGGGAPAVADLRAAVSASFPSLRFEIYPFRADAVAGLISASVRAALEAPLNYARNHLADLLPRCVPRAIYLDSDVLAVDDVRRLWETRLPAAAVVAAPEYCHANFSRYFTEAFWNDPVLGARVFAGRRRAPCYFNTGVMVIDLRRWRVGNYRQRIERWMEMQKEKRIYELGSLPPFLLVFAGEIEAVDHRWNQHGLGGDNVFGSCRPLHNGPVSLMHWSGKGKPWDRLDAGKPCPLDHTWRSYDLYIGENDSSSASGPSRSALSSSAAW

SEQ ID NO: 619 - protein, 190 aa, Sorghum bicolor
MATILENIQKARFLPTRPLKDELPTFQGGGGGKEESHLMGLRKRLSSFSGKIQPISSASAEWAFRRSKSAPSLGAAFAAGGGSLRQWWQWGVGWLLSKKPGFAGDLEMNEEEVAALGRQSRGSWGHILYKMRSGVRRLVMSTHSLPTTHKQSSLPSSASAVHNNVQCKPAAAFAYAQRQSFHHTGHAMAH

SEQ ID NO: 620 - protein, 396 aa, Sorghum bicolor
MAAPRKVLMLCGDYMEDFEAAVPLYALSALGITVDCAAPGKRPGDSCLTAVHDFLGFELYTELTGHRFTITADFAAAAADPSRYDALVIPGGRFTEQLSADAAVVDLVAAFAALRRPLVLTCHSQLLLAAAGGLSGGTRCTAFFSLRPVVELAGGAWVDPDPFELCVADGHVLSAIGWPAHAQILAKLLDALGAHVVAADAGRGGQRVLILCADYVDDYEANVPFRALAGVGCRVESACPTKRKGETVVTAIYDAAGTPAVTVSEERRGHNFVVTADWADASADDFDCVVIPGGRAPELLVTHDRAVALVKEFADKGKVVASIGHGHLLLAAAGLLRGRKCASGVPMRVVSRLAGAEAVEAAAAVVDGRLVTAASWTDLAQFVARVIDLLGISVSF

SEQ ID NO: 621 - protein, 115 aa, Sorghum bicolor
MSDLLTYISKVMCIKARSEATQAGDDGGCPADECRVCLSKIRLAEATRRLPCRHVFHRDCVDRWLLSCKRTCPLCRVYVTDGNKQPVAAKHTSREAQALADDLVIWFSTVLVPGF

SEQ ID NO: 622 - protein, 330 aa, Sorghum bicolor
MAGSAFLNALVLRAPSPSPSLSCSSSSTRRSAGAFAFPNPPRLPSLRSARRVVLARAAAAPPGAGGDPEPEDDEWGPEPEGGSAVTGATAVAEAPEAPEAREVAELKAQLKDALYGTERGLRASSESRAKVLELITQLETRNPTPAPTEALTLLNGKWILAYTSFSQLFPLLGFGNLPELVKVEEISQTIDSENFTVQNCIKFSGPLATTSVATNAKFEIRSPKRVQIKFEEGIVGTPQLTDSIVLPEKFELFGQNIDLSPLKGIFTSIENAASSVAKTISDQPPLKIPIRTNNAESWLLTTYLDEELRISRGDGSSIFVLFKEGSTLLN

SEQ ID NO: 623 - protein, 112 aa, Sorghum bicolor
MAPSKLAVVIALVASLLLLTNINTKAAPGPGGYPPAPPLGPPPHQIVDPAKDCGGACDVRCGAQSRKNRCARACLKCCSVCRCVPAGTAGNQQTCGKCYTDWITHGNRTKCP

SEQ ID NO: 624 - protein, 341 aa, Sorghum bicolor
MAIRVPSMELHRSSPLLSGGRGRNTCPQKKPFLVQAKRLGGLEKASTRLGTQESGQPKKRAPLVRGTVSPPLPVPGNIPRPPYVGTKYVPEIAKEVQMHDNESIVHMRAACELAARVLDYAGTLVKPSVTTDEIDKAVHKMIIDAGAYPSPLGYGGFPKSVCTSVNECMCHGIPDSRELQDGDIINIDVTVYLNGYHGDTSKTFLCGDVDEASKQLVKVTEECLLRAISTCKHGTSFKKIGRRISEHAERNGFGVVECFVGHGVGRVFHSEPIIYHQRNNRPGQMIEGQTFTIEPIISMGSIDCDMWDDGWTAVTTDGSLAAQFEHTILITRTGAEILTKC

SEQ ID NO: 625 - protein, 138 aa, Sorghum bicolor
MDKTANVVLDIEGLPQPPDKCCSGSPKMIRALSRKGSNRMERRGSDELEQEDLAKKLIIKVVPSQLEQPLGQIKALVAPHCTPCTPVLIDSGEGRSKRFSRFTSINPRKILLLFATLSSVGTTILIYFTLAINSKAEA

SEQ ID NO: 626 - protein, 367 aa, Sorghum bicolor
MLPAALLPSPPGRLLASIPLRCHAPTQQPSTAAAAAARGLLLGGARSPVVKRVPDGGGWLLWHQSGPRVALSTSMDGLRWSAPVSPDPLLPTEDWWAFDTASVRPSDVLLISGPAASSRRFPSSAVYWLYYTGSTDERFGSPFPDADVPALPGLAISQDGRHWARIEGDHHTGALFSVAEDGEEPRGWETRCIVAPKVVMHADGDLRMYYHSFDETSQRPAIGLARSRDGIRWKKTGKVLEAGRAGSFDECGVRHGHVVRDRAAGRYVMVFEGVDADGRVSIGMAVSEDGLKDWRRSSEIPVLCPSDDDDGWDGAGVGSPCLVQMDGAYDWRLYYMGVGRDGEASIGMAHSEGQALLKFEKCDAILM

SEQ ID NO: 627 - protein, 216 aa, Sorghum bicolor
MAASLLVLAVAVLVAVGPGGIDGGAAAPVEVEGSEVTYGSVIKLMHEKTKHRLHSHDVPYGSGSGQQSVTGFPEGDDSNSYWIIRPTPDSSSKQGDAIETGGIIKLQHMRTRRWLHSHLHASPLSGNLEVSCFGGDELSDTGDYWRLEIEGGGKVWKRDQKVRLRHVDTGGYLHSHNKKYNRLGGGQQEVCGVREKRAENIWLAAEGVYLPVTGSK

SEQ ID NO: 628 - protein, 443 aa, Sorghum bicolor
MKVDVVGTTLVAPSEDTPRRELWLSNLDLAVPKTHTPLVYYYPAPAPAAATGTDDGGDRAAFFAPERLEAALARALVPFYPLAGRLGVGVGEGGRLRIDCNAQGALFVVARADFAGEDVFGDTDGGYEPSPEVRRMFVPFVPSGDPPCVMSMFQVTFLKCGGVVLGTGIHHVTMDGMGAFHFMQTWTGVARGLDVAEACGPLPPFHDRTLLRARSPPTPAFDHPVYSPSLLNGRPRPFVTRVYAVSPKLLADVKSRCAPGVSTYCAVTAHLWRCMCVARGLAPCSDTRLRVPANVRHRLRPALPRSYFGNAIVRDLVVARVEDVLDRPLGFVAQAIKDAVDRVDDAYVRSVVDYLEVESEKGSQAARGQLMPESDLWVVSWLGMPMYDADFGWGTPRFVAPAQMFGSGTAYVTQRANKDDGIAVLFGLEPQYLQCFEKVFYGE

SEQ ID NO: 629 - protein, 176 aa, Sorghum bicolor
MAPSSSSSSAAAVLLLAVAVAAMLAASSTPVLADLTHANCAKNKKVTVQNLCSHDVTLTLEPLANSPALFAGAYTLHPHSHAEFPVCWWTGRLRAGADAAVVEFHVGVDGGSFYLAPNAQPGQRVPVSVTPHGSPLQGRCPAVGCAVQGRCSVHQVPSGDCRNVQEMKIIYCNPHV

SEQ ID NO: 630 - protein, 781 aa, Sorghum bicolor
MVARMMRWPRPPPARNFRVRLVVRRAEGLPPPPSPLSPEGSPEAEAKVFVEVSWKGPKMSPLTSLRRSQRPPRNQTRKEALPAVATADLEDGAAAAPAPAAVSAVAWEEEFERDAALTATSHRDPAVFHPWDVAFSVVSESNKMSKSKLVLGTASLNLADYASAAEEEIEIILPLSVPSSAMDLAPSLHLTLSLVELRISQQSPGASQRSVIAPLSPSSGDSVPSGKDEVSVIKVGLRNLKILRDLVSTRRFKKTNQDYDGSEEKYYVHSDGAEFSCDTDSLDDDLDDREQDDEFGGSAVRKSFSYGSLQTMNVGALLYAPRIDGDDEGWVHYSHRNSDVSYHVEQVPSSTAEEHASIPLRRKRSLLPARWRKTKLPKAKGEPLLKPYGEEGGDDIDYDRRLLTPSDGSVSEGSNGSGNSMVSVFGDDDFVVGNWESKEVFSRDGHLKLSTQVFFASIDQRSERAAGESACTALVAVVADWFQANQDLMPIRSQFDNLIREGSLEWRKLCENETYRERFPDKHFDLETVLHAKIRPLTVAPSKSFIGFFHPEGTEDVSGFDFLDGAMSFDNIWDEISRAAECSSGKPTIYIVSWNDHFFVLKVDVDAYYIIDTLGERLSEGCNQAYILKFDDTTTIHKVPAEKKESNPDTDGRHNKDSSEICSAEQDSGTDTEECELVLKGKDACKEYIKSFLAAIPIRELQADIKKGLMASTPLHHRLQIEFHYTESCPAEISVPAPLSPFEAPFEFCWPEPPSPPPATEFAVTYPPAMEVAITQAVAVI

SEQ ID NO: 631 - protein, 407 aa, Sorghum bicolor
MLIGMPQGAAATAVDSNGKDGGGGANPTSTARPAAALPLKLLRPLLLLAVLGTGFLAVVVLFLGGPTYSAMLPRLSLAPDAVLPAPASAGKAPLDRWKRAPASAWHNMTDEELLWAASWRPSVRRYPYRRTPKVAFMFLTRGPLPLAPLWDRFFAGAGDAALFSVYVHATPGYRHDFPPASAFHRRFVPSQVAEWGKASMLDAERRLLANALLDPANELFVLLSESCIPLYGFPAVYSYLTRSRASFVGAFDDPGPAGRGRYRAGLAPEVRREQFRKGAQWFELDRELAVDVVADERYYPKFREHCRPPCYVDEHYLPTALSIEAPARIANRSVTWVDWSRGGAHPATFAGKDVDEAFLKRLTAAPAKQNCTYNGQPSEVCFLFARKFAPSTLRPLLRLAPKLLGYG

SEQ ID NO: 632 - protein, 125 aa, Sorghum bicolor
MAMAPCAPVSSVPLAARPAATGSPSSVRPRAAAAAAGVVRAAGATEGGRWWAPLLGWSGKADYLEAPAPAPAVAQDDEAGARGRQFVGGLTEEKARQLRARMAQTESFHDAMYHSAIASRLARSA

SEQ ID NO: 633 - protein, 186 aa, Sorghum bicolor
MEKQAAAQAQAQEQEQEQWQGAVEATLPSTPASAAWPHIASFCALHRYLASIDVCELAEGEDGRPGCVRYVASLAPGTTTGEIGIWATEKLLEIDHDARRLAYAVVGSSLGFGRYVATMSIVAADDEDDAGCRLVWAFECDPVQGWSRDGMLAYLDAGVKGIAARIEEAHAAAASASAGGDGGVAA

SEQ ID NO: 634 - protein, 450 aa, Sorghum bicolor
MSFRSIVRDVRDSFGSLSRRSFEVTIAGLSGLTVHHRGKSQSTVHEVCDTDLIIQESRWANLPPELLRDVIRRLEASESTWPNRKHVVSCAAVCRAWREMCREIVLSPEFCGKLTFPVSLKQPGPRDGMIQCFIKRDKSKSTYHLYLCLSTAVLMENGKFLLSAKRNRKTTCTEYVISMDAENISRSSSTYIGKLRSNFLGTKFMISDTQPPYNGAVVPHAGRTSRRFNSKKVSPKVPTGSYNIAQVTYELNVLGTRGPRRMHCVMHSIPASAVEPGGIVPGQPEQILPRALEESFRSTTSFSKSSIMDRSMDFSSSRDFSSARFSDIAGGAAIAGDEEGQNKERPLVLRNKAPRWHEQLQCWCLNFRGRVTIASVKNFQLIAAPSPAPAPAARAPTPSSQPVPQDQDKIILQFGKVAKDMFTMDYRYPLSAFQAFAICLSSFDTKLACE

SEQ ID NO: 635 - protein, 79 aa, Sorghum bicolor
MPPLAPTTTSSSEPEPPFRPREKILEKQRYFQSVRRPTYLKGRHDVITSVAIPLALALSSMYLVGRGIYNMSHGIGKKE

SEQ ID NO: 636 - protein, 393 aa, Sorghum bicolor
MPYCEVGSYADGDKWEGVRLFYRRYGRGATKVLLIIGLAGTHDSWGPQIKGLTGSLEPADDEAVRPDEEAGVGAAGAAEAAPAEADEAAGGGDGIEVCCFDNRGVGRSSVLPNKSYYSTAIMATDALALMDHLGWKKAHVFGHSMGAMIACKLAAMAPHRLCSLALLNVTGGGFQCFPKLDGQMLSLAFRFLRAKTPEERALVDLETHYTKEYLEETVGSVTRRMVLYQEYVKGISSTGMQSNCGFEGQVNACWTHNMTTKELDTIRSAGFLVSVIHGRYDIIAQLCHAKRLAERLLPVARMVELHGAHLVSHERPDEVNNALMDLIKATKSAMKPEEWSAQPENISETGALISARPITVTMQTDEGVIVMGFEHMRNIVKVMKPVRVAAVES

SEQ ID NO: 637 - protein, 149 aa, Sorghum bicolor
MYQAIPYSAGRPWPQPAPAMGVEATTAAAEERLLAAVRQQQPAPEAEAAAREEEVRRAVAECPVLVVGRRGCCLSHVVKRLLQGLGVNPAVHEVADAEAELAGVVDGGDVALPAVFVGGRLLGGLDRLMAVHISGDLVPILKDAGALWL

SEQ ID NO: 638 - protein, 402 aa, Sorghum bicolor
MAIHLRAHAFAANPLRGVSAATTAVSPSAAAEVLRSLLDPSSAAAANPQPYLSKILPFRRGRPLARSTDPPPASAPAAAPAWCLAWLPPSRVPGLAPDAFVFLGAHVEGGGKEAAAYWAVDVSEGEGATVGGPADGDGPSAFVDLRTLMVATDWSDKHAMGELAIAGHARALLEWHSTAKFCGACGAKAVPTEAGRRKQCSNESCKKRIYPRIDPVVIMLVIDKENDRALLSRQSRFVPRMWSCLAGFIEPGESLEEAVRRETWEETGIEVGQVVYHSSQPWPVGPNTMPCQLMMGFFAYAKTLEIKVDKQELEDAQWHSREDIKKALTFAEYEKAQRTNAAKVNQICKGAEKGQSLSGDFKVESGEPAPMFVPGPFAIAHHLISAWAFEGVPKLPSSFSNL

SEQ ID NO: 639 - protein, 243 aa, Sorghum bicolor
MDPEKQRQHDGDGDGDGAAAAEADIERLPVDLLAHILSLLSSFRDLSMAGGASRRWRCAVERALASRRRLSFAGQRTGNDTAARLIRAAVNLRDLDISRSCWGCHITDEGLIKISSADCVGNLTSISLWGLAGITDKGVVHLVSRAYSLQHLNIGGTFITDESLYAVANSCTNLKSIILWSCRHVTEAGLVALVNKCRRLECINVGGMRVPPESFVGLLSISPALQIRSIHRILNAGVGVQVS

SEQ ID NO: 640 - protein, 298 aa, Sorghum bicolor
MGRQPCCDKVGMKKGPWTAEEDQKLVGFLLTHGHCCWRVVPKLAGLLRCGKSCRLRWTNYLRPDLKRGLLSDDEERLVIDLHAQLGNRWSKIAAQLPGRTDNEIKNHWNTHIRKKLLRMGIDPVTHLPLQEPPAPPPPPPPPPEQEPDDQEEEPQQQEQQAGKLMQEGGAGEDDVAPMVQPHETIMAPPPPPTTAASNCGSAAVSSASAGSASVVSPSCSSSSASAPAVTGVEATEWPEPVYLFGMDGIMDAGWAGLFPSTGAGAGGCFGLGGVDPFDQYPGVGVGGAGFDQDDGHWM

SEQ ID NO: 641 - protein, 80 aa, Sorghum bicolor
MAEESGRPLPKFGEWDVNDPASADGFTVIFNKARDEKKGGNGQDTDSPSKDTRTERVESYAAKPSTKKWFCCVTASPTQS

SEQ ID NO: 642 - protein, 267 aa, Sorghum bicolor
MAMEPNMARRLWHVVRAVLFMLRKGMPKRKLAMDLHLLVHRGKIAGKALGNLMTAHGHNSHHDSKAEAAAAVPPQQQFSSSGRGRRALDPSLAVYNPREVEFSCSNTPSYPSLHLNLIPTGKRRRRNNNSSSRRGTHRGANGAEPGWYNYDAADIARVFEILNNNDGGGDTSSDQQQQQPSPLALIATPSPAMWASFGRTPAHARKLRITDSPFPLRDDDAAGGQVDLEAEEFIKKFYEQLRTQQSLATATPDYYGGGYAPPVSGIA

SEQ ID NO: 643 - protein, 196 aa, Unknown
  Sequence found in Organisms: Sorghum bicolor, Triticum aestivum
MAYNGRDQRYGGGIATPGYAPPVPYGMSQVNIEGNGCGRPLPPQPTVKVYCRANPNYAMTIRDGRVVLAPANPKDEYQHWIKDMRWSTSIKDEEGYPAFALVNKATGEAIKHSLGQSHPVRLVPYNPDFLDESVLWTESRDVGNGFRCIRMVNNIYLNFDALHGDKWHGGVRDGTDIVLWKWCEGDNQRWKIQPYY

SEQ ID NO: 644 - protein, 90 aa, Sorghum bicolor
MMMEKQIRGEHQQEGAGRRRQQQQEEEVVVVHSQVRRIKQEEDERAKVHETYQHQHVSEMRVVLRDLDRQRSRSPLGRVARTAISIGGDS

SEQ ID NO: 645 - protein, 123 aa, Sorghum bicolor
MAAAASSKGRAIAGSFVSRVLAGKAASPRRAVHASAYDKNLEDQVRPAFVPDDVIGGGAGNPDKYWSPHPTTGVFGPAAVDPKLAAAAGAPDAAAANAAGGTVLDQKVWFRPLEDVEKPPPVA

SEQ ID NO: 646 - protein, 694 aa, Sorghum bicolor
MAALEAARSWAGSVIPPELAAAAGGDPLAALAATAAALVAGLLILAVWFRSGGGAPSKPVAAPVRPPPVKVDADADVDDGRKRVTIFFGTQTGTAEGFAKSMAEEARARYEKAVFKVVDLDDYAQEDEEYEEKLKKETVVLFFLATYGDGEPTDNAARFYKWFTEGKEKEVWLKALKYGIFGLGNRQYEHFNKVAKVVDELLEEQGGKRLVPVGLGDDDQCIEDDFTAWKELVWPELDQLLRDEDDTTGASTPYTAAIPEYRVVFIDKSDLSFQDRSWTLANGTGVIDIQHPCRANVAVRKELHKPASDRSCIHLEFDISGTGLVYETGDHVGVYAENSVETVEEAERLLDLSPDTFFSIHADAEDGSPRKGGGSLAPPFPSPCTLRTALLRYADLLNPPKKAALLALASHASDPAEAERLRFLASPAGKDEYSQWITASQRSLIEVMAAFPSAKPPLGVFFAAIAPRLQPRYYSISSSPMMAPSRIHVTCALVYGPSPTGRIHQGVCSTWMKNTIPLEYSEESSWAPIFVRQSNFKLPADPSTPIIMIGPGTGLAPFRGFLQERLALKQSGTELGTSILFFGCRNRNMDYIYEDELQTFLEEGALSELIIAFSREGPTKEYVQHKMVEKATEIWNIISHGGYLYVCGDAKGMARDVHRMLHTIVQEQGSLDSSKTESYVKSLQMEGRYLRDVW

SEQ ID NO: 647 - protein, 170 aa, Glycine max
MGGSWSWQLTCALLLLFSAVVTATDHIVGANRGWNPGFNYTLWANNHTFYVGDLISFRYQKNQYNVFEVNQTGYDNCTTEGAVGNWSSGKDFIPLNKAKRYYFICGNGQCFSGMKVSVVVHPLPPPPTSAVAAQHSSPKSASPVLLKRGFRSLLVSTVSACFGIVWIYHL

SEQ ID NO: 648 - protein, 189 aa, Glycine max
MALNQSKAVLLRVSLVVVALFIAGYIVGPPLYWHFVEGLAAVNHSSSTCAPCICDCSSQPILSIPQGLSNTSFGDCAKPDPEVSGDTEKNFAELLAEELKLRENQAVENQQHADMALLEAKKIASQYQKEADKCNSGMETCEEAREKAELTLVTQKKLTALWELRARKKGWKEGLANSHAHSQGKVQSS

SEQ ID NO: 649 - protein, 513 aa, Glycine max
MDQLLWRVLPLLTILVSFGVFFYLQDSYTAQFYALIKLPRDKCSLLPHRHFWISSKRIVTPQGIISGSVEINDGKIISVVEGHANQGKPKQEEVIDYGDAVIMPGLIDVHVHLDEPGRTEWEGFDTGTRAAAAGGVTTVVDMPLNNYPTTVSKEKLKLKLDAAEDKIYVDVGFWGGLIPENALNTSILEGLLSAGVLGMKSFMCPSGINDFPMTTIDHIKAGLPVLAKYKRPIVVHAEVQQDFENHLELNEDNLDPRAYLTYLNARPPSWEEAAIKQLVGVTKDTRKGGPLEGAHVHIVHLSDSSASLDLIKEAKSRGDSISVETCPHYLAFSSEEIPNGDTRFKCSPPIRDAYNREKLWGAVLEGHIDLLSSDHSPTVPELKLMEEGDFLKAWGGISSLQFNLPVTWSYGKKYGLTLEQLSLLWSKKPATLAGLESKGAIAVGNHADIVVWQPELEFDLDDDYPVFIKHSELSAYMGRRLSGKVLETFVRGNLVFKDGKHAPAPCGVQILAK

SEQ ID NO: 650 - protein, 470 aa, Solanum lycopersicum
MVQPHVLLVTFPAQGHINPSLQFAKRLIEMGIEVTFTTSVFAHRRMAKIAASTAPKGLNLAAFSDGFDDGFKSNVDDSKRYMSEIRSRGSQTLRDVILKSSDEGRPVTSLVYTLLLPWAAEVARELHIPSALLWIQPATVLDIYYYYFNGYEDEMKCSSSNDPNWSIQLPRLPLLKSQDLPSFLVSSSSKDDKYSFALPTFKEQLDTLDGEENPKVLVNTFDALELEPLKAIEKYNLIGIGPLIPSSFLGGKDSLESSFGGDLFQKSNDDYMEWLNTKPKSSIVYISFGSLLNLSRNQKEEIAKGLIEIQRPFLWVIRDQEEEKEEEKLSCMMELEKQGKIVPWCSQLEVLTHPSLGCFVSHCGWNSTLESLSSGVPVVAFPHWTDQGTNAKLIEDVWKTGVRMRVNEDGVVESDEIKRCIEIVMDGGEKGEEMRKNAQKWKELARAAVKEGGSSEVNLKAFVLQVSKSC

SEQ ID NO: 651 - protein, 406 aa, Solanum lycopersicum
MSFGETRTIAPTEPSTEAARRRRMEIHQFRFVASDMAVAPPSSMENGRKRKKLEKTVSVKSYDSKEKKQFKLERIVSLPLSLPCTDVGEKKLAENKETETNALDLTESASVSSNIERQGVSDCPKFGMTSVCGRRRDMEDTVSIYPSFLQDKHEKSSILHFFGLYDGHGCSHAAMKCKDRMHEIVKNEVESAGEATWKEMMIQSFSKMDKEVVEYSKGAGGTQTADCRCELQTPQCDAVGSTAVVAVLTPNKIVVSNCGDSRAVLCRNGVPIPLSTDHKPDRPDELNRIEEAGGRVIYWDGARVLGVLAMSRAIGDSYLKPYVTSEPEVTITERTVEDECLILASDGLWDVVSNETACGVARMCLRSGQNSDQACTDASILLTRLALARHSSDNVSVVVVDLKRGL

SEQ ID NO: 652 - protein, 386 aa, Solanum lycopersicum
MSLIKPSSRYAKTSFDSSRSSTKSDPSSSTDKALIKIKKGSNGVTQTTHQSNFSSMVKKFVEHKSASSKLMKQQQQKKGDLKLVIPVDFIAEDLKKTAKRGSGLSSLHKKLFKGSSSGGGVKKEEGSTVKALTEVKGNTRTLGMVLRSERELLSMNKEQEDQIVELKLMLEEKNREVEKLKDLCLKQREEIKSLKNSILFPDVMNSQVQDLLEKQGSELKQAKQLIPNLQRQVTSLTGQLQCLAEDLAEVKADKYAIRGSYDSFGSPSEYDQEEAANSLEFSSEDHTIPGSPDDMFLKDVNPCLTPYYAKTKSKEFDDFNSPDAKDLVKNNIQVYHESSYNSCARKLSKSSDCRQCSNTGNKATRAARRSDESKCTYGKQVHSKFY

SEQ ID NO: 653 - protein, 156 aa, Solanum lycopersicum
MADVQRRGRPLPPPPPRGPHGPPPQRIAPRPVPVDREKTCPLLLRVFTKVGGHHNVNEFAVRGKEPKDEVQIYTWMDATLRELTDLVKEVAPEARRRDAILSFAFVYPDKRGRFVVREVGTTFSYPNMRRPDNGSKTLSELKFQIGDYLDVAIMFQ

SEQ ID NO: 654 - protein, 245 aa, Solanum lycopersicum
MSTDVHCNGNAFKIFIGYDPREDVAYEVCRYSLLKRSSIPLEIIPIKQSELREKGLYWRGRGKLESTEFSFTRFLTPHLANFEGWAMFVDCDFLYLGDIKELRDMVDDKYALMCVQHNYAPKETTKMDGAVQTVYPRKNWSSMVLYNCAHPKNKVLTPEIVNTETGAFLHRFTWLEDEEIGEVPFVWNFLVGHNKVVEGDPTTFPKSIHYTLGGPWFEAWKDCEFGDLWIKELEEYKKATEKKVD

SEQ ID NO: 655 - protein, 270 aa, Solanum lycopersicum
MRGNDPNPFDEEEPEVNPFSKGGSAPASKSRFPQMIASTLGFGQKHDATDDVPLDSMNGSNKKQKELATWEADLQRRERDIKRREDAVAGAGVPTDDRNWPPFFPIIHHDIANEIPAHSQRLQYLAFASWLGIVFCLAFNVLAVTICWIKGGGVKIFFLAVIYALMGCPLSYILWYRPLYNAMRTDSALKFGWFFMFYLFHIGFCILAAIAPPIVFQGLSLTGILAAIDVFSDHVLVGIFYLIGFGFFCLEVLLSLWVLQKVYMYFRGHK

SEQ ID NO: 656 - protein, 1235 aa, Solanum lycopersicum
MYPTNPYQRNQVPYNPHYYPRFESNPHHHMNIDPTRSTLPYESWPCGGSNYRHPYPPECHSCCIHNTSPSQCAFSPPYPYLPPSTYNNCSYPTYPVMYPTHYVPHPHFTMEQPRYEYEKNMGRDHHCCGCSNHKCGSKKGGSSVKIEEHDQDKGNDCNDSLVPFGFNNCPYPVVCLPPDDMKNRERMKPDGSNCKEQEENPQPLKPLGDFRPSQQPNFWKLWPSHYGNSSGSPKENGDFPEKQHHDDAIRKQFPFPIIWMPYRPEEDREEVGKETESGLIAEKEPTSPSKLTKLMSHDSEDKRSSSKENEVNSGGDFHGKGLNKGSVVKTIPVKQVEQNEIFDGKKEEASQRHESDAKQKKITQEAGRKQSTSPTKSSKLPPVCLRVDPLPRKKSSSGNSRSPSPPRGKGKLVESRSDSSKPPIKSNEKENVQLDKSSTTSMPRKSTEVEPSKSKAKVVEVAQGTAKEDILHDQCTVFPDLKRQARSKIAEGDTGKAANKPKDELDAVVAKAQSSNEAHQRGEARQAVNEEVDAGNKTKREKRSKMSNDEAATKIQSAYRGFTLRRWEPLKKLKQLAKIEEQMAEHKRHIQTLESSADNGVDNKQRTFLTEVIMGLLLKLDTIQGLHPTVREYRKSVAKELVSLQEKLDLLNCKKQPAESEQTVTAKSSEDTSMAVEDNPSLQGGQEVQKLERDDDFVKGDEGIKFDAKGLCEEQTLCATELLANSHDVGNAVLEGKELNKDVEEVMEGVLGSSAVKTGDGASVQHFESEEKTDKLFDENTIVVEKLEEHGDGVDELGELPRGVPDEETSIQGSAEIRQDTVDLTALTPEERVSDTESLEHYQALGETSIILGLENTHSSNGVEENADIVERDAAVPIDILEREKEVTKPLSEDANMSEVDDKVGMEKNGKKLDQGGSASDGFSVPSQEKAITIEQPTDTTNTEESETIEVLQEKMQNAVDRDIEILDSGKPVEQSLEPQLSIGTNDEAREYKQKMGEGHKEVQGEELQACDDVVVSDHDNEGKEHNVVVEQRHVENFEMQANEPVTAYNAAPVIQEPVDGSKAIATPTSEAATTETEMSREKELGLADDHNIHPSMCVAGEVNPADASHSFGSTPIEVPGKNANELKEWKKMDMLPASPTASQVSCDSDALSESNRKIIEENEKLREMMEKLIKSGNEQLSAISSLSGRVKELEKRLSKKKKLKLKRNRVPAAGSACVKPLNDSLRNRNVGLAM

SEQ ID NO: 657 - protein, 648 aa, Solanum lycopersicum
MALTTTFFSLFLLIITVAGQTTPMAEAPAPAADDCNGIFLQYVFNSGSKIKPTLKTRQPYKFQSILSITNNGLEELKLWRVFVGFQHDEILVSASNALLADGESFPALVGNGTVFAGFPAADLKTAVETAGDTTQTSVQIKIVGTQFGVGSPNVPMPSNISLENDGFICPKPSMQGKSVMQVCCIKDENFKTNLTLGEKFSPRQDGDLTIMYDILRTYDSNYWAQVTIANHNPLGRLDNWKLSWDWMKDEFIWEMKGAYPSVVDTSECVFGPQAKFYQNLDFSTGLNCQRRPTLIDLPLEKTNDTKLGMIPFCCRNGTILPPAMDPSKSVSAFQMNVFKMPPDLNRSSFTPPQNWKIEGRLNPDYKCGPPVRVSPTQVPDPSGLLPATSVFASWQVVCNITQPKGASPRCCVSFSAFYNESIIPCPTCACGCPSNTARTCSTKAPALLLPSQALLVPFDNRTKMSLAWAEINHLPVSNPLPCGDNCGVSINWHLFTDYRGGWSARITIFNWEDAAFADWFTAVELDKAAAGFDAVYSFNGTMLDGVNNTIFMQGLPGLNYIVAEADGANPAKDPRVPGKQQSVISFTKKNIPNINVAAGDGFPTKLYFNGEECSLPKLLPTSSSSRISSFTVTTSILAAVVVFMLVRQ

SEQ ID NO: 658 - protein, 563 aa, Solanum lycopersicum
MGTLQTWRKAYGALKDHTTVGLAHVNSDFKDVDVAIVKATNHVECPPKDRHLRKLLVFTSAMRPRADVAYCIHALARRLAKTHNWTVALKTLIVIHRTLREGDPTFREELLNFQQRGHVLQMSNFKDDSSPIAWDCSAWVRTYALFLEERLECFRVLKYDIEGERLPKPAQGQEKGYSRTRELPSEELLEQLPALQQLLYRLIGCRPEGAALGNYVIQYALALVLKESFKIYCAINDGIINLIDKFFDMPRHEAIKALDIYKRAGQQAMNLSDFYGVCKGLELARNFQFPVLREPPQSFLVTMEEYIKEAPRIVSVPIETLDYPERLMLTYKQEDEPSASEDAQDSANETPPPLPLDDAVVSTTEAPSPPMPPPPSSLESDDLLGLNAPSGYASAIEDSNALALAIVPSGTTPFDSNPAQPKDFDPTGWELALVTTPSSDLSAAQERQLAGGLDSLTLNSLYDEGAYRASQRPVYGAPAPNPFEVADPFAMSTTMPPPPSVQMAAVPQHQMNPFGPFEPAYPQPQNPMLNPHNPFGDAGFSAFPTNHVAHPQTTNPFGSTGLI

SEQ ID NO: 659 - protein, 337 aa, Solanum lycopersicum
MAPNVFGLATKATGLAKAKSLSSRAYVTFLAGNGDYWKGVVGLVKGLRKAKSAYPLVVACLPDVPEEHRRILINQGCIVREIEPVYPPHNQTQFAMAYYVINYSKLRIWEFVEYSKMIYLDGDIQVFDNIDHLFDLPDGYFYAVMDCFCEKTWSHTPQYKVGYCQQCPDKVQWTEDLGPKPSLYFNAGMFVYEPSLSTYDDLLKTLKVTPPTPFAEQDFLNMYFRDVYKPIPNDYNLVLAMLWRHPENVDLEKVKVVHYCAAGSKPWRYTGKEENMDREDIKMLIKKWWDIYDDESLDYKNSNVVMNAVDGEVEAQKIMEALSEAGVVHYITAPSAA

SEQ ID NO: 660 - protein, 188 aa, Solanum lycopersicum
MAISSSSLSAALFPMCNSSSISAQPKFSLLSLHSNSVKLQVFNQSRVSTTKVFASPEVLDAQNVEADVEDILAASTLSIGGDSDKAAPKQKIRIKLRSYWVPLIEDSCKQIMDAARTTNAKTVGPVPLPTKKRIYCVLKSPHVHKDARFHFEIRTHQRLIDILYPTAQTIDKLMLLDLPAGVDVEVKL

SEQ ID NO: 661 - protein, 541 aa, Solanum lycopersicum
MQAVKASSFSPFHLNLNSTSSFPKTTNLYIQQNYENPISCFPSIQTQNAKFKVFTATSPSVSTESETPFDEKTENENQEEKFEWYAEWYPIMPICDLDKRRPHGKKVMGIDVVVWWDRNEKEWKVMDDSCPHRYAPLSEGRIDQWGRLQCVYHGWCFNGAGDCKLIPQAPRDGPQVHTSKRACATVYPSCVQNDILWFWPNSDPLYKDIYLMKRPPYIPELDDSSFSKTFIVRDISYGYELLIENLMDPAHVQYSHYGIMNNCLFTVKADREGGRPLDITITKLDVNVITANQGPGRNTFVPPCVYYSYFAFGGSQGKTTAVSSGTVQEKPSAEKQKKALLVFICIPVSPGHSRIIFASPRNFATWADRIIPRWIFHLGQNLILDSDLYLLHVEERKLKEIGSYNWHKACYVPTKADAIVVAFRRWLNKYAGGQVDWRGKYNGDLPPTPPREQLLDRYWTHTVSCTSCNLAYKSLNALEVVLQIVSIGAIGIVAALKQGTLSAVTRYSLVTVALLCFVASRWLSHFIYKNFHFHDYDHAFR

SEQ ID NO: 662 - protein, 350 aa, Solanum lycopersicum
MRSIEDKGCLNYGQKEQEVVGGSSMNFEFHGTNRASTHHRTAALGKPTPSKWDDAQKWLVNLSRGEKHQSKATPRNSNADDLRLIAPVPKKEEYSSDDEGDSSMIQFEVETKKVDCDESIWRINKNNNNFASVVRSICVRDMGTEMTPIASQEPSRTATPIRATTPAVRSPISSGSSTPIRGQNGTIENGQIVANIGQNRGNAGTTRVVRDVEETIDNELAAKKETDHPNKVNPLETRAMAWDEAERAKYMARYKREEVKIQAWENHEKRKAEMEMKRMEVKAERIKARAEEKYKNKLAASRRIAEEKRGNAEAELNEKAVKTSEKADYIRRTGHLPSSFSFKLPSSFCW

SEQ ID NO: 663 - protein, 135 aa, Solanum lycopersicum
MDTQIPILSPNNNIDEFEDLEVTQFDEDTLRKILFEEELQPNKDSINIVQDNIIQPMMVDTTSNFSKIEEEEEEELVIEDFDWIEMMELSDTIVSHEGVNEIFDVGELDFDFSHFCSSSIPMEEIGYDVLWQNNL

SEQ ID NO: 664 - protein, 246 aa, Solanum lycopersicum
MAAAFSSSFTSSAIGAQFYRPKFVKPKTFVNTIRCAGRLEWDPDGLLGPPQTGHIARLEFQRRLENDAAAREEFERQVREEKERRRVLRESRVIPDTVEGLVEFFLDTEAQEIEFEIARMRPRLNKEFFDHLQVELGKLRFSVNKTQAVEDRLFELEALQKALQEATEAYDKLQADLVATKKNLTEILTSKDVKATLLDLVERNALNRPLLTLLDENIATAHSVNQKQAAEYMEKLRGLVLKYLTV

SEQ ID NO: 665 - protein, 173 aa, Solanum lycopersicum
MTMATPISPMKQFPSTALQPFPSIFQRKPVLISSLRKTPHLFSYSSPKSFVPLSACLAVLLWSSPANAGFLSGYTGIESVPGPELPKIEFLNRWNDNNQKKYAELDEKFKESPLLKQLLEKSKQNKEKNKRSIEDKYCLRGAEWGVGDCSTAGMTPEDRDSFIAMLKQKAGVE

SEQ ID NO: 666 - protein, 274 aa, Solanum lycopersicum
MSVLPKIDSIKIREVWSDNLEKEFALIRQIVDDYPYIAMDTEFPGVVLRPVGNFKHINEYNYQTLKDNVDMLNLIQLGLTFSDENGNLPTCESEYYYVWQFNFREFDTKANIFANDSIELLIQSGIDFKKNNEMGIDAKQFGELLMSSGIVLNDMVHWVTFHSGYDFGYLLKLLTCRTLPETQSGFFDLLNMYFPLVYDIKHLMKFCNSLHGGLNKLAELLEIERVGICHQAGSDSLLTSCAFKKLKDNFFNGSTEKYAGVLYGLGVEYGSDNK

SEQ ID NO: 667 - protein, 560 aa, Solanum lycopersicum
MHPTPFSSQKSLTIMALQQPFLSELLLHSSSIRTTLPKSSLFSLQIPQRFNLYLQNKQIKKQGTSCYAIAENLEAEDQSLILENSSLDELRGQREIVGYDWTEEWYPLYLTKNVPNDAPLGLTVFDKQVVLYKDGSGELRCFEDRCPHRLAKLSEGQLYDGKLECLYHGWQFDGDGKCVKIPQLPENAKIPRSACTKTYEIRDSQGVVWIWMSHGTPPNINKIPWFENFERKGFRDISTIHELPYDHSILLENLMDPAHVPISHDRTDFTAKREDAGPLFFEVTERTNRGFAGWWGKERDQGKANYTPNFLRFESPCVLQNNREIVDESGEKHYFSGLFLCRPSGQGKSMLIVRFGNTRKRTGILKFIPNWFLHQNASKVFEQDMGFLSSQNEILMKEKVPTKKLYLNLKSSDTWVAEYRKWMDKVGHGMPYHFGHSTIFLPQQPAVVEHAPAGFVANFSAAQPAKGGIGGIYAPNPANRYFRHVVHCRDCSNVVKAFETWKKALSVIALVSTAFAILVSGRQWKALLLLSTSLCLAGAYACSTAIAMNTTNFIRTHRRL

SEQ ID NO: 668 - protein, 156 aa, Solanum lycopersicum
MASSKVFLIFILAALIATPVAVAQLGGLLGGLLAPTSIEGVLFCSLNGKIDVLNGATTPIFPDASVQLRCGAGNVVSSTTTNGSGAFSLVTSPVQSLLSSLLSDCNIVVTTPLSTCNATLPSVGVLQAPLQIVGKTAGGGLLNIVKLVTGAFQLIN

SEQ ID NO: 669 - protein, 112 aa, Solanum lycopersicum
MASFAEAPPGNPKAGEKIFKTKCAQCHTVDKGAGHKQGPNLNGLFGRQSGTTAGYSYSNANKNMAVNWGENTLYDYLLNPKKYIPGTKMVFPGLKKPQERADLIAYLKEATA

SEQ ID NO: 670 - protein, 517 aa, Solanum lycopersicum
MAFQGSFWAISLLIFLANFLSMIEFSKAANAKVPSHTISNPFNRTIFSPDFLFGASTSSYQYEGAWNEDGKGPSIVDTFVHTHPEKILDRSNGDIALDFYHRYKEDVKLAKFEGLDAFRISIAWTRILPKGSVKKGINQAGIDYYNSLINEIVALGIKPLVTLFHWDLPQALEDEYLGFLSPKVVDDYVDFVEICFKNFGDRVKLWATMNEPWIFTSTGYDSGSLAPGRCSAWMNNNCTIGNSGTEPYIAGHNILLAHAAASKLYRQKYKPIQKGQIGTIVVSHWFEPASNKPEDIKASIRALDFMLGWFMHPLTYGDYPTSMRKLVGKRLPKFTPKESMLVKDSCDFIGLNYYTSNFAAHISKPPNTVNISSGTDNLVNQTTSLNGKLIGDPTGVSIFYVAPKGLYKLLVYIKKFYKNPIVYITECGMGESNIDDVAKGINDAQRVDFYQRHIKALYRAFREGVHVKGFFAWSFYDNFEWGSGYTQRFGINFVDYKNNLKRYPKRSALWMKKFLLK

SEQ ID NO: 671 - protein, 147 aa, Solanum lycopersicum
MGLKGKLIASVEMKCGEGSFFDIFHINTNQVPNISPKNIVHFGIHEGESVKTGSIVSWKYNEAGQEMYMKHLIEAADPQQKLIKWKVIEGDLLKLYKYCNFTTSCDGQWTTWTIDYEKKTEDTPEPLLHLGVILAMTKDIESHLLKK

SEQ ID NO: 672 - protein, 166 aa, Solanum lycopersicum
MQNQQQLQTLMQAGQISGSLSFNGNLSKEDEEMSKSALSTFKAKEEEIEKKKLEVKEKVQAQLGRIEEETRRLAIIREELEALADPMKKEVSTVRKRIDIVNKELKPLGQTCQKKEREYKEALEAFNEKHKEKVQLISRLMELVGESEKMRMKKLEELSKSVETIH

SEQ ID NO: 673 - protein, 339 aa, Solanum lycopersicum
MMNSERLANVALAGLSLAPLVVNVDPNLNVVLTACLTVFVGCYRSVKPTPPTETMSKEHAMRFPLVGSAMLLSLFLLFKFLSKDLVNAVLTCYFFVLGIAAFAATLLPAIKRFLPEKWNEDLVIWHFPYFRSLEFEFTRSQIVAAIPGTMFCVWYAKQKHWLANNVLGLAFSIQGIEMLSLGSFKTGAILLAGLFVYDIFWVFFTPVMVSVAKSFDAPIKLLFPTADLKRPFSMLGLGDIVIPGIFVALALRFDVSRGKGPQYFISAFSGYAVGVISTIIVMNWFQAAQPALLYIVPAVIGFVAVHCIWNGDMKPLLEFDESKTQSTEEVAAEESKKVE

SEQ ID NO: 674 - protein, 248 aa, Solanum lycopersicum
MVKPNSKDTEFSQSSSSSLYRGVRKRKWGKWVSEIRLPNSRERIWLGSYDTPEKAAKAFDAALFCLRGKGANFNFPENPPEIRNGRTMTPSEIQSAAAQFANNTEPELIRVGPRENSDLSSSSSEIFRAESPSVSVSDRVESEKTEITLGNDFIDVYRVESRVESEKTEMSLDNGFVDMFSSLGTVNDMSDFGIFPGFDDLSGEFFIPPPSSPQPSPLQMPNLESLEEENYLNYDGFQSQGTSFLWNF

SEQ ID NO: 675 - protein, 95 aa, Solanum lycopersicum
MAAQEEVKQLAECSVSNALGTWVFSVAGALLAIPVGIKRKSLAPLVFFGTTGTMLDIIMGISACEREHAERQMKLLEEAQGSVAVDTLTDAATEH

SEQ ID NO: 676 - protein, 97 aa, Solanum lycopersicum
MARSFSNSKTLSAFVSDSVSAFLSRRGYAAASQGAVSGVAKGVPRSNVMMQKSGEESVKTSWVPDPVTGYYRPEGQANEIDAAELRKMLLKHRSGSN

SEQ ID NO: 677 - protein, 126 aa, Triticum aestivum
MASALTNVSLSTFAPTARGDVLARPQVAAARVTFPTAYRGSGALSCRAGGPATPPGISDKMSDSIKEAQETCSEDAASGECAAAWDEVEELSAAASHARDKLKDSDPLENYCKENPETDECRTYDS

SEQ ID NO: 678 - protein, 490 aa, Triticum aestivum
MDPNSFKTGGLLLPTIERRCASPPSVIVIGGGISGIAAARVLSNSSFEVTVLESRDRIGGRVHTDYSFGCPIDMGASWLHGVSNENSLAPLIGHLGLRLYHTSGDNSVLYDHDLESCSLFDKNGVAVPMETAAKVGVIFEKILKETVKLRDEQEHDMPLEQAISMVLERHPDLKLEGLDDRILQWCVCRLEAWFAADADEISLKNWDQEHVLTGGHGLMVDGYFPVIQALAQGLDIRLNQRVKKITRQHKGVTVTIEDGTQYSADACIITVPLGVLKANIIKFEPELPSWKSSAIADLGVGIENKVAMHFDKAFWPNVQVLGMVGPTPKTCGYFLNLHKATGHPVLVFMAAGRFAQDVEKLSDKEAVELVMCHLRKMIPDATEPTQYLVSRWGSDPNSLGSYSCDLVGKPSDVCERFSAPVESVLYFAGEAASAEHSGAVHGAYSSGMDAAEECRRRLLMSKGVPDLIQVGAAACEEMADVVAPLQICRT

SEQ ID NO: 679 - protein, 408 aa, Triticum aestivum
MPATDYQGSSSSSHSPFASFGRSLLSRSRDTPASPAMLPSGGEAEVEAFQRHVAVSLAELRDGEDFLSVAWIRRLLEAFLLCQEEFRAVAAEARRRGGGGALAERLVGEYHERAVKALDVCNAARDGVDQVRRWGRLAGIAASVLLAPEEIHEGQLRRARKALSDLSILLVDDAAAAGGGGGVASFLASHRNRSFGRGSRASPSRASSASSSSSSSSHFRSLSWSVSRTWSASRQLQAIGAGLAAPRAHEAGLAAPVYAMGCLLHLASWALVAAVPCPDRAAALQAHHLPAAPPRGAFAWAPPLLTLQDRLTEEGKRKDRRNSCGLLKEIHALEKCAQRLAEAIDAAPIPLTGEREAAVREAAAELAAVCSAMKDGLEPLERQVREVFHRIVRSRMEGLDSPMPNAAD

SEQ ID NO: 680 - protein, 505 aa, Triticum aestivum
MAAGTGRVLPLLAVAAALAAALLYTAPFSKSLGGEGCSLLPHGHFWIASQRVVALGRVGPAAVEVKEGLINAIAVGDYRSFVLRRPLVDYGDAVIMPGLIDVHAHLDEPGREEWEGFSTGTRAAAAGGITTLVDMPLNSFPSTVSEETLKLKVDAARDKLYVDVGFWGGLVPENALNPSKLESLLNAGVLGLKSFMCPSGINDFPMTNSTHIEEGLVTLAKYKRPLLIHAERIPDVTSDEELDGELDPRSYATYLNSRTPAWEESAVRDLNRAMKDTEVGGRSEGAHLHIVHLSDSKTTLDLLKDAKHSGAKVTIETCPHYLAFSAEEVPDGDTRFKCSPPIRDAANKENLWEALLDGHIDMLSSDHSPSTPDLKLMEEGNFMKAWGGISSLQFVLPVTWSHGKKYGITLNQLASWWSEKPAELAGQKNKGSILPGYHADIVVWKPEAQFHLDDTHAVYHKHRNISAYLGKELSGKVLSTFVRGNLVFAEGKHAGAACGATILAK

SEQ ID NO: 681 - protein, 170 aa, Triticum aestivum
MATDAILETIKPRRSPWLEDLPVTNGGAAKGGKVDLSGMRRRVSSSLSLSLQPLSSSSSAAFRRARSMPSIKALAAAGAVRQWWEWGLGWVMTRKPSFARGLEMSEDEAALLGCHCRGTLRHVFYKARAEVRRLLGRDGRPLGGVAAQDFRYDSVSYAQNFDNGDVDARC

SEQ ID NO: 682 - protein, 532 aa, Triticum aestivum
MAAAADVGQLAGAAAATLLAAVLFAAALGRQRQRRRRGAPVEGIPAPEDGCAVADGAGSAAVDGPTDVIIVGAGVAGSALAYTLGKDGRRVHVIERDLTEPDRIVGELLQPGGYLKLMELGLQDCVDEIDAQRVLGYALFKDGKNTKLSYPLEKFHSDVAGRSFHNGRFIQRMREKAASLPNVQLEQGTVTSLLEENGTVKGVQYKIKSGEELKAYAPLTIVCDGCFSNLRRALCSPKVEVPSCFVGLVLENCELPHANHGHVILANPSPILFYPISSTEVRCLVDVPGQKVPSIASGEMANYLKTVVAPQIPPQIYDSFIAAIDKGSIRTMPNRSMPAAPHPTPGALLMGDAFNMRHPLTGGGMTVALSDIVVLRNLIKPLRNLHDASALCKYLESFYTLRKPVASTINTLAGALYKVFSSSPDKARDEMRQACFDYLSLGGVCSNGPIALLSGLNPRPLSLVAHFFAVAIFGVGRLMLPLPSPKRMWTGARLISGACGIIFPIIKAEGVRQMFFPATVPAYYRAPPEAEF

SEQ ID NO: 683 - protein, 343 aa, Zea mays
MNVAVPPQSPHLRLYDFAKSAIIKIFAFPYATVCDLYCDGGMDTDKWCDAQVGHYIGIDASASGVNYARELWENRRKPFTAEFIELDPSDDGFEAQVQEKGIQADMVCCMQHLQLCFENEEQAKKLLNNVSSLLKPGGYFFGITPDSSTIWTKYQKNVEASHNKGLKTVPNSIRSENYTITFEVEEEKFPFFGKKYQLKFASDAVFENQCLVHFPTLMRLSREAGLEYVEIQNLTEFYDDNRTQFAPMLGGYGASFLDARGKLVARSYDILGLYSAFVFQKPDPEAIPPIVTPDLPDPDKGHEEEWLQPQQASVEDGRRSHADVLPIDPEKGILGPGPADMRL

SEQ ID NO: 684 - protein, 326 aa, Arabidopsis thaliana
MNRDEILSKFISYSNKQEKKMERSLKKTKNNYNNSIKSNLMKDDELFHVIHKVPCGDTPYVRAKHAQLIEKNPEMAIVWFWKAINTGDRVDSALKDMAVVMKQLDRSEEAIEAIKSFRPRCSKNSQDSLDNVLIDLYKKCGRMEEQVELLKRKLRQIYQGEAFNGKPTKTARSHGKKFQVTVQQEISRLLGNLGWAYMQQAKYLSAEAVYRKAQMVEPDANKSCNLAMCLIKQGRFEEGRLVLDDVLEYRVLGADDCRTRQRAEELLSELESSLPRMRDAEMEDVLGNILDDDFVLGLEEMTSTSFKSKRLPIFEQISSFRNTLVC

SEQ ID NO: 685 - protein, 128 aa, Hordeum vulgare
CVRYCEGTPPADGTPADWAHETLLEHDQARRFFRYEMNDNNMGFGAFFAVFRVVPAAAGGCELRWEFECEPVRGTPKEALEARLQAGLDGMAARVHGHLISARGAVAAAGTAGLEAADELKLDNSIAA

SEQ ID NO: 686 - protein, 632 aa, Hordeum vulgare
MLSLLLREAMKKCFGEDAKTEECSVVQSNEFFSQVLGGCEPCGFASVVMEHPLRLRVFCAQVRAGMWRKNGDAAVLSAEWYRSVQWLEQGLESDLFLLQCCGALSSPEFFVRTIQERFGLSDYTSMDLTEQNEYESVLIQEMLTFLVQLVKERRFCGRPTADNLKRELIYKLAVRDATHSQIVKSLPRDLSSSEQLQIVLDSLAVYSDPSGKKKGKYVLREAFWKELDLYHPRWSSMELEIAKERYYRCCKVSALGAQLPQWTHVFSPLRSISKIATSKAVLQIVHAVLFYAVYTDTSSVSRAPDNVLVTALHLLSLALDICESESQMSADQYGMDLVQHDDESWVVLSSDAVEAFPILTYSTELVSPESDKLKKESMITLLVSLMHKEKNDSTFSGCNIPSLVESLLKRFAKLSKQCMSAVRQMAPQVLPSIPEHASAKQNLGSPDSTGNSQCKATIMAKMGAEQSKLAESMKSSGNEGPDVPTFEPDAPRSTAIEMRPFCSLCQDSDSKSPLCCLIRLQAALETMMAETAEDGQTPRSVAEFASNILSHVGSTGSLKSPAVEVLEDKLRAERRGAAALREEIDALKKQAEKADAVIAKTQEEMEEVRKKQAETDQVLQLLLRRSQGNPGS

SEQ ID NO: 687 - protein, 300 aa, Hordeum vulgare
MQSLVKAQARVRARQVRIGLEGQVTQKKAPEQNAHDDHAREIEERWCGSIGSAEDMQAKVLKKQEAAAKRERAMAYALTHQRQAGSRKLKAADVQGPEADENQWGRNWVERWVAVRPWENRLLDSNAKESVPIGDDKEAEENGDRDVNNPKGKVAVSGIQSNGSSQTKDAKHKKSHSDASGSSSGQSAAAPPTASLGSSKLKPKPSDQTSEEVSPQPTDPAPRSTSNPKERPAQVSAPTKKRLSLPNNAVGGAARKGQVSSSERTRSVGSKNTVKGASKPESKQRPSPGSATAKRVQAQA

SEQ ID NO: 688 - protein, 375 aa, Hordeum vulgare
MALPAAKAAPATPFSSQTHGGGILLGRASSPPPPAAALRLGPLFWPWEKVNVGPLSVSPMGFGTWAWGNQLLWGYEESMDSELQECFNLALKNGINLFDTADSYGTGKLNGQSERLLGKFIRECQGPIKSPDDVVIATKFAAYPWRLTSGQFVNACRSSLERLQIDRLGIGQLHWSTANYAPLQERALWDGLVEMYDKGLVRAVGVSNYGPKQLLKIHSYLASRGVPLSSAQVQFSLLSMGEEQMELKTVCDSLGVRLIAYSPLGLGMLTGKYDASNLPNGPRSVLFRQILPGLESLLSCLKSIADRKGKTMSQVAINWCICKGAIPIPGVKTVRHVEDNLGALGWRLSPGEISELEAAAMECPKKMVQNIFQTT

SEQ ID NO: 689 - protein, 116 aa, Hordeum vulgare
MDRVGSGEKHLEDCTVANALGTWVFSVAGALLAIPVGIKRKSFAPLVFFGTTGTMLDIIMGISQCEREHAERQMKLLEAQNLATNASVEGESLTDSFTNVDKRDGAYCGVSFDGIP

SEQ ID NO: 690 - protein, 184 aa, Hordeum vulgare
MTELLQSSSSMAKVCDELAQVIGSKRNIEEDDIIRLPYLQAVIKETFRLHPPAPLLLPRQPETTVKIAGYTIPKGSRVFINVWAIGRDKDVWTEPEKFMPERFLGSTIDFKGLDFELLPFGAGRRICPGMALAIRMVHVMLASLLNQFKWSLPLELEHDGIDMEDQFGLTLAKVVPLHIIATPI

SEQ ID NO: 691 - protein, 447 aa, Brachypodium distachyon
MPLPVACCCSGRVESTAVIPMHASGAAAASGLQEPLVAHGLYKHRPLVPSSDAAFLLEAKKLLTHSVLFATAERAYIFEIMGGSMWMRYAPHNMMILVQLSYTLMYFVTEDAFNRGLNPYVYVTYRHLLVALLLCPFAYFHEKKLRPKMTLMLFLEIFVLSLLGVSLTLNMYFASLKYTSPTFVTAMANTVASITFAIAIVLRMEIVDVKSPRGLAKVAGTAVSFAGVTTMTFYKGAAIASPWKAPIHIHGSNAVHGSWVKGSLLAVASCVCWSIWYIMQAGSVERYPAELSLTAWMATVGGIQSAAFTVLLQHRKEDWLVGFGLNFWCIIYSGIACSGFAVFAQLWCTEKKGPVFVTMFNPVSTIMVAILAYFICGENLYVGSIIGGGVVILGMYMLLWGKDKDQEYNASSSKELQGSDLDWEKQAKMADVSSVQNDSQPETKTMT

SEQ ID NO: 692 - protein, 307 aa, Setaria italica
FTSEGSSSYLRRHGTSAFAQEFVASFIDNDIEEEDEETHGMALPYQPAYRYMENTRRHPCRYRILRLSETADMKSKWRVLLQPGIRHALCYGMLIQALQQSAGISVLLRYTPEILEQVGVVSLFSDIGLSPHSTSILISALNALLLLPCITAAMLLMDVCGRRALILATTPILMLSLSVMSLSTLVDMGSLERAILFHLALTICFCSYVVGLGPIPNILCSEMFPTKARATCVSFCSLSFWFGGLLSAYCFPVMLSTIGLGGACGIYALVCCIPLCLVYYRIPETRTLNLELIAEVFKLSRQLPYVQ

SEQ ID NO: 693 - protein, 336 aa, Zea mays
RLFQARRALRALRGLVRLQALVRGHQVRRQVHLTMRCMQALVRAQARVRARRLTQHPLLLLPPPTPPASSPTLLLGAGRPLCVELALQGDHDVGDDGEVADLLLQQRSRSRGRFGRGDDNGGARSPSGAWDSSSRTLEDARAEGARRHDAAARRERALAYAYAYQQRQWQRQEDEKAGLGFHWLERWMAATTQAQQQEHAPDHAKTHQSTPTRTTSSYVTAAAAFANGMSEKTVETETTSRSPLNQASAAAHGRPPAIPGYMAATRSARAKARPAPPSATPTHARSRSGGGLAGDTSSSGQNGSAVAGYSPDSSCTGDWTPPRLGVSTRTSRVAYT

SEQ ID NO: 694 - protein, 422 aa, Zea mays
MHANPTRRGRPMASVGLPCPASCHLIYIYAASGRPLQSSKTKQKQPSSLQRLTPPHSTVMVVMGKEQQHEEEEVQGKVVQEEVQVVQETVVPVPSEEDKEAEAALVHKISSLAAAIAKLPSLSPSPEVNALFTELVTACIPRSSVDVERLGPELQEMRGGLIRLCADAEALLEAHYSDLLASFDNPLEHLSLFPYINNYILLSQLEHGLLARHVPGPAPARVAFVGSGPLPLSSLVLAARHLPGASFDNYDICGEANDRARRLVRGDGALQARMAFRTSDVADVTRELASYDAVFLAALVGMAAEEKARVVAHLGRHMAPGAALVVRSAHGARGFLYPVVDPEEIRRGGFDVLAVHHPEGEVINSVIIARKPVAVDAHATGGVGHAHAHAHGAVLNRPCLCCEMEARAHQKMEEVAVEQLPS

SEQ ID NO: 695 - protein, 293 aa, Zea mays
MYIKYILSLYFIQIAGKLNNIIREQCLRDVGQLEQDLVFGDAGTKELINFLRTQLVVSRENKLRLLMIYAALNPEKFESDKGAKLMQLAGLSADDMIAVNNMRCLCGPDTKKSSVGGFTLKFDVHKKKHTNRKERTGEESTWALSRFYPILEQLIENLSKGELPKDEYNCMNDPSPTVHGLPTSSSARTSPAHSMRSRRTGGTWARPRGSDDGYSSDSVLKHASSDFRKLGQRIFVFVIGGATRSELRAAHKLSSKLKRDIILGSSSLDDPPQFITKLKLMSVEELTLDDLQL

SEQ ID NO: 696 - protein, 322 aa, Zea mays
MVPAAAAVAAASPAALPRSTSPRGRRPRARACSFRCAGPSARSSALVSSYKSGSAGHGHPRIRQLRGRPDCSRQAEVMGSTVDDDEACELVSGSDLVIGEGDDSVSAYLFKAVKNNNGTGILLLSDIFGFQDSATRDFAYRVACNGYNVLVPDLFRGNPWKLNVPFDGDSFERWRAGQAPGRVSGDIDACTRWLVDEFKAAGVSKKLGVIGFCYGGGRLVETLARDAESCFSAGVCFYGSRMDASLGDRVAAPVLFVCGDGDPLCPVETVRELEGRARGARAAVYAGRGHGFAHRPQSVEEDGDAEDAFNAMRGWLHDHLLA

SEQ ID NO: 697 - protein, 642 aa, Sorghum bicolor
MNCFSGLLSGKRKASKGKNKGAYVKKGSGNDCPKVKPVEFMDMADTVVDDVVSRGGDSSVPASACNSRFVVHAAAQLPRHASGENGDKAAAKKESSAADDDLVAGVGSSGHSSYGTGNSDAKSTEPDDGERSSLGRMSPTASPKLMRSCSNIETTRSVVPAGSDLPAKSRSYNDLKILPPGRSTAARSGAIDASPTASFRTSCSADRVMLKKRSSRQVLPSRSRKLWWQMFLWSHRNLHRPGASATMPTLLPPSPGQEEEEEEGGAAHQHDGYTSDTLGAVTADAKNKGVAIEADPITSQWVAFSAEASPLDRVSAWVNSLGDGSFHAVDEDDATGHGSGGEGAARPRRQRCSEIVELSTATAGGKRNPEAKRRAADEAAQASGIVQTLNTFSSVAHIAGMGLKTVPTIAAFSTLRAVNLSGNTIVEISAGSLPKGLHSLDLSRNKIAIIEGLRELTRLRVLNLSYNRISRIGHGLSSCTAIRELYLAGNKISDVEGLHRLLKLAVLDVSFNKITTAKSLGQLVANYGSLRAINLLGNPVQANTGDDTLRKAVSGLLPRIEYLNKQAVKPQRAREVAKDSVAQAALGNAGWNSRRRLTRRLSQSPGSAGKGGRGRDGNGNGSRRGSRSRSMTRPQSSSLPRR

SEQ ID NO: 698 - protein, 166 aa, Sorghum bicolor
MSWLLVVAVLAGFALGPSAGTDHIVGANHGWNPNINYSLWSGNQTFYVGDLISFRYQKGTHNVFEVNETGYDNCTMAGVAGNWTSGKDFIPLPEARRYYFICGNGFCLQGMKVAITVHPLPHNATSKGSSTRGGTGAQEEAAAAALGARSAAWLATLAVAAVSAIC

SEQ ID NO: 699 - protein, 150 aa, Sorghum bicolor
MGGGSCCVCKEAPPKYKCPSCRTPYCSVTCFKKHKEESCQKTSPQEEISKSPLQEEVTLNTTCIAESPNTVGPTKALEVEDPSWVVDNNRLRSLAELKGIQDALRDPELQKMILKIDGSLEPEKELEKLMEGQAFGQFADKILDIVSPQE

SEQ ID NO: 700 - protein, 391 aa, Sorghum bicolor
VPTAKCSTPREEPPVPIRHGTLAAMLPAALLPSPPGRLLASIPLRCHAPTQQPSTAAAAAARGLLLGGARSPVVKRVPDGGGWLLWHQSGPRVALSTSMDGLRWSAPVSPDPLLPTEDWWAFDTASVRPSDVLLISGPAASSRRFPSSAVYWLYYTGSTDERFGSPFPDADVPALPGLAISQDGRHWARIEGDHHTGALFSVAEDGEEPRGWETRCIVAPKVVMHADGDLRMYYHSFDETSQRPAIGLARSRDGIRWKKTGKVLEAGRAGSFDECGVRHGHVVRDRAAGRYVMVFEGVDADGRVSIGMAVSEDGLKDWRRSSEIPVLCPSDDDDGWDGAGVGSPCLVQMDGAYDWRLYYMGVGRDGEASIGMAHSEGQALLKFEKCDAILM

SEQ ID NO: 701 - protein, 403 aa, Sorghum bicolor
MPQGAAATAVDSNGKDGGGGANPTSTARPAAALPLKLLRPLLLLAVLGTGFLAVVVLFLGGPTYSAMLPRLSLAPDAVLPAPASAGKAPLDRWKRAPASAWHNMTDEELLWAASWRPSVRRYPYRRTPKVAFMFLTRGPLPLAPLWDRFFAGAGDAALFSVYVHATPGYRHDFPPASAFHRRFVPSQVAEWGKASMLDAERRLLANALLDPANELFVLLSESCIPLYGFPAVYSYLTRSRASFVGAFDDPGPAGRGRYRAGLAPEVRREQFRKGAQWFELDRELAVDVVADERYYPKFREHCRPPCYVDEHYLPTALSIEAPARIANRSVTWVDWSRGGAHPATFAGKDVDEAFLKRLTAAPAKQNCTYNGQPSEVCFLFARKFAPSTLRPLLRLAPKLLGYG

SEQ ID NO: 702 - protein, 505 aa, Triticum aestivum
MAAGTGRVLPLLAVAAALAAALLYTAPFSKSLGGEGCSLLPHGHFWIASQRVVALGRVGPAAVEVKEGLINAIAVGDYRSFVLRRPLVDYGDAVIMPGLIDVHAHLDEPGREEWEGFSTGTRAAAAGGITTLVDMPLNSFPSTVSEETLKLKVDAARDKLYVDVGFWGGLVPENALNPSKLESLLNAGVLGLKSFMCPSGINDFPMTNSTHIEEGLVTLAKYKRPLLIHAERIPDVVSDEELDGELDPRSYATYLKSRTPAWEESAVRDLKRAMKDTEVGGRSEGAHLHIVHLSDSKTTLELLKDAKHSGAKVTIETCPHYLAFSAEEVPDGDTRFKCSPPIRDAANKENLWEALLDGHIDMLSSDHSPSTPDLKLMEEGNFMKAWGGISSLQFVLPVTWSHGKKYGITLNQLASWWSEKPAELAGQKNKGSILPGYHADIVVWKPEAQFHLDDTHAVYHKHRNISAYIGKELSGKVLSTFVRGNLVFAEGKHAGAACGATILAK

SEQ ID NO: 703 - protein, 491 aa, Triticum aestivum
EGIPAPEDGCAVADGAGSAAVDGPTDVIIVGAGVAGSALAYTLGKDGRRVHVIERDLTEPDRIVGELLQPGGYLKLMELGLQDCVDEIDAQRVLGYALFKDGKNTKLSYPLEKFHSDVAGRSFHNGRFIQRMREKAASLPNVQLEQGTVTSLLEENGTVKGVQYKIKSGEELKAYAPLTIVCDGCFSNLRRALCSPKVEVPSCFVGLVLENCELPHANHGHVILANPSPILFYPISSTEVRCLVDVPGQKVPSIASGEMANYLKTVVAPQIPPQIYDSFIAAIDKGSIRTMPNRSMPAAPHPTPGALLMGDAFNMRHPLTGGGMTVALSDIVVLRNLIKPLRNLHDASALCKYLESFYTLRKPVASTINTLAGALYKVFSSSPDKARDEMRQACFDYLSLGGVCSNGPIALLSGLNPRPLSLVAHFFAVAIFGVGRLMLPLPSPKRMWTGARLISGACGIIFPIIKAEGVRQMFFPATVPAYYRAPPEAEF

SEQ ID NO: 704 - protein, 299 aa, Arabidopsis thaliana
MAGTCTSIRPRLIGSSSIVELSRLINRAGVPFSVRFSTRTRALHGGGLTAPTSREEGPSCIFVGPIDSARKETLEALYRQAKDAYYNGKPLIVDDMFDRVELKLRWYGSKSVVKYPRCSLLRQSTYADAEDDASQVLLLATVWIMIFLFGSSACVLPTIYGVGLVYGGDPFDSGLVYSSQLSSSVPILSKFNGILLSVLGPAFGYPIASSAVRVLKGLWRNDLTALKGDCPNCGEEVFAFVRSDQSNRSAHKADCHVCECTLEFRTKVEKSASRLGRKWVYGRIYLVSRPRRDRRSKFT

SEQ ID NO: 705 - protein, 328 aa, Hordeum vulgare
MGDLGVRVVGRGCAAPMEPRKEMAPPPPMEQHHPPLFMDFSRRDGVADGGNVRKRPREAVAPPARLFSLQAPQGSPGHKVIHLAQLHRRPAATGLRLDFDEGGSEHVACTSSSPSSVLPGELAAQCGQYSNEIDRLLQEHAERLRLALADTRRRQNRSLLGAAEALAARRVREMEAETFKAARRGVELEEQLARLRAEAASWQAKAMSDQSTAAALHAQLQQAAATAQARSGKAALDDDGAAGAADDAESGFVDPDRVVEVIAPPPAARPCRACRLRPASTVLLPCRHLCVCDACDPGVPAALAGTAPAAACPACRCPVTGTVQVFFA

SEQ ID NO: 706 - protein, 108 aa, Hordeum vulgare
MTTTAKLGELMWEHRLRAAAAVAFLAVAVVSISAVGPRLGAVVSFFWPLLVSTGFFLVAITVLLRISPPPGGADESGKEIIDFVAGCRPEHLLPEASATVEVPPEPEI

SEQ ID NO: 707 - protein, 511 aa, Hordeum vulgare
MDSLYCFVQLLSLLCFFVFYYRHLQSKKISKAEPTEWPILGHLFGMVANLSHFHDWATGILTGTRYNFEARAGITGVRFFVTCDPANVRHIFTSNFLNYPKGQDFADIFDVFGDGIFNADGDSWSRQRAKSQLIMAGPRFRAFSARYTRDKVETSLLPFLAHAADAGTPCDLHDVFLRLTFDMTCNLVFGVDPGCLQVGLPVVPFARAMDDVLETLFLRHIISPACWKLMYRYEVGTERKMAAGRRTIDRFAADTIAKRRADHKLRDEGVTDSSDMLSSFICNGDASEYSDEFLRDTTVNLLLAGRDTTGAALSWFFYLLSKNPRVEQKILDELAPIASRKKQLAGDMVVLDVSELSGMVYLHAALCECLRLYPSVPFEHKAAVADDVLPSGHEMKAGDKILIFSYCMARMEGVWGKDCMEFRPERWVYADGKLRYEPSYKFISFNAGPRTCLGKEMAFVQMKTAAAAVLWNFAVEAVPGHVVEPKLSIILHMKNGLAVTVKRRNVAAVHG

SEQ ID NO: 708 - protein, 1311 aa, Hordeum vulgare
MAGIDDGGAAAQLVQKLAICGVPEEQQHQEGLLVYLEEHNDKIPQITAAILSAGTDLMESGNSSKDKDDSSSSSNAYSESMLWLQWMMFGRNPDAMLHDMELSSEDDRAVCGTVWGQNCLAYRCRTCESDSTCAICVPCFQNGNHKDHDYSIMETGGGCCDCGDATAWKPEGFCSRHKGAEQIKPLTKELASSVGPVLDELLLFWKESICVPREKSDDCKKRVARELTISIADMLLRFCACSESLLSFVSQRIHECPGLLDALMRAEMLLDKKVVEKLHELLLKLIAEPAFKYEFAKVFIQYYPVAFSEVIEGGNDYVLEEYLLIQNFSVQIFTVPMLTTMLVRDHNLLGILLECLTALFLSCVGEDGHLQTSKWVNLYDASIRLLEDARYVLRHEEVSMYVASERPDLTRSWIKLLSLVQGMDPQKRVTSIHVEDENENLYAPSTLGHYFGIIHNLLMKGAFSSPGQQESTDFTVCSIATKGIESAENQRLAKVGRISQENSVCNLSTRKSFSSSKLPSPAACLIRQCLEAIDSWLEPGPLRRKSLSVDAIRGGSDKHIGEMGMKVNEGSQLDDVADYYEVIDPPIQEPDNMVMIGKGGMPHVGNVTGKGKMQETSSVPDVQLHSENFIAVALTDGSLLYAHPDSRTDELGILNMTSWPRVVFDVTSQETSFHIPLHRMLSLLLREAMKKCFGEDAKTEECSVVQSNEFFSQVLGGCEPCGFASVVMEHPLRLRVFCAQVRAGMWRKNGDAAVLSAEWYRSVQWLEQGLESDLFLLQCCGALSSPEFFVRTIQERFGLSDYTSMDLTEQNEYESVLIQEMLTFLVQLVKERRFCGRPTADNLKRELIYKLAVRDATHSQIVKSLPRDLSSSEQLQNVLDSLAVYSDPSGKKKGKYVLREAFWKELDLYHPRWSSMELEIAKERYYRCCKVSALGAQLPQWTHVFSPLRSISKIATSKAVLQIVHAVLFYAVYTDTSSVSRAPDNVLVTALHLLSLALDICESESQMSADQYGMDLVQHDDESWVVLSSDAVEAFPILTYSTELVSPESDKLKKESMITLLVSLMHKEKNDSTFSGCNIPSLVESLLKRFAKLSKQCMSAVRQMAPQVLPSIPEHASAKQNLGSPDSTGNSQCEATIMAKMGAEQSKLAESMKSSGNEGPDVPTFEPDAPRSTAIEMRPFCSLCQDSDSKSPLCCLIRLQAALETMTAETAEDGQTPRSVAEFASNILSHVGSTGSLKSPAVEVLEDKLRAERRGAAALREEIDALKKQAEKADAVIAKTQQEMEEVRKKQAETDQVLQLLLRRSQGNPGS

SEQ ID NO: 709 - protein, 507 aa, Hordeum vulgare
MAPAVGIKRTAAAQTVTVQAPPPPDARLVREAVRTSTIAGAVAPAALEAPAPALEGFLCLEEVDGRRWKYVVDAAPGKAKAKAKGRGRGGSAVPLGASVRAVPLQSPLPPAEEIMAFVRSYVVPEGFPDSVTPSYVPYMTWRALKHFFGGAMGVFTTRTLLSSVGVSQSKVTPGAIAINWILKDGAGRVGKMLFARQGKKFDNDLKQLRFSSDLLLEIGAGIELATAAFPQFFLPMACVANVVKNVAAVTSTSTRTPIYKAYARGENIGDVTAKGESVGNIADLLGTGLSIFITKRNPSLVTSFALLSCGYLLSSYHEVRSVVLNTLNRARFTVAVDSFIRTGYVPSLKEGNSQETIFIHPWRHEPVSIGSRFGEAFQEPVSFVATRPLFEDERYMVTYNPTKDKVYALLKDQAKPDDILKAAFHAHVLLHFINVSHERKRMSSNRSDHYGNPHPRNMDFLAHIAESCKIVSSSYGTFRKKAKEQGWIMSESLLNPGKARLCVTRPQ

SEQ ID NO: 710 - protein, 272 aa, Hordeum vulgare
MSPPAPCQLLGAESAHATAEPFRVYVGYDSREDIAYRVCRRSLLRRSSVPLEVIPIVQQELREAGLYWRERGPTESTEFSFTRFLTPHLAGYRGWALFVDCDFLFVADVAELARMADPRYAVLCVHHDYTPKEATKMDGAVQTAYPRKNWSSMVLFNCGHPKNRAALTPEAVSTQSGAHLHRFAWLDDADVGEVPFAWNFLVGHNSVDPADVGGTAPRAIHYTSGGPWFELYKDCEFADLWIQERDAYESEEKEGEVAGTRVPSSSAVAVDA

SEQ ID NO: 711 - protein, 84 aa, Hordeum vulgare
MMWGVAAAVASAAAVAVASGAELLACDCAPTDPAAAVAVGRCDDFLLRQREPPSSSAGSGVTDDKFAPRFDGLRFIETLVTAHR

SEQ ID NO: 712 - protein, 428 aa, Hordeum vulgare
MGISSKWIKSLVGIKKHGKAQNGESSRERSSAAQVLHKRKHSVDTEGALAVAEHTVQTEPLASDTNTQTVSSQTELNTKEHQAATVIQSAFRAFLARRALRALKGLVRLQALVRGHAVRKQAAETLQCMQSLVKAQARVRARQVRIGLEGQVTQKKAPEQNAHDDHAREIEERWCGSIGSAEDMQAKVLKKQEAAAKRERAMAYALTHQRQAGSRKLKAADVQGPEADENQWGRNWVERWVAVRPWENRLLDSNAKESVPIGDDKEAEENGDRDVNNPKGKVAVSGIQSNGSSQTKDAKHKKSHSDASGSSSGQSAAAPPTASLGSSKLKPKPSDQTSEEVSPQPTDPAPRSTSNPKERPAQVSAPTKKRLSLPNNAVGGAARKGQVSSSERTRSVGSKNTVKGASKPESKQRPSPGSATAKRVQAQA

SEQ ID NO: 713 - protein, 355 aa, Hordeum vulgare
MRGKKPVKELTLSVPAQETPVDKFLTASGTFKDGELRLNQRGLQLISEENGDEHQSTKMKVEDVQLSMDDLEMIQVIGKGSGGVVQLVRHKWVGTFYALKGIQMNIQESVRKQIVQELKINQATQSPHIVLCHQSFYHNGVIYLVLEYMDRGSLADIIKQVKTILEPYLAVLCKQVLEGLLYLHHERHVIHRDIKPSNLLVNHKGEVKITDFGVSAVLASSIGQRDTFVGTYNYMAPERISGSSYDYKSDVWSLGLVILECAIGRFPYTPPEGEGWLSFYELLEAIVDQPPPSAPADQFSPEFCSFISSCIQKDPAERKSASELLNHAFIKKFEDKDLDLRILVESLEQPMNVPE

SEQ ID NO: 714 - protein, 355 aa, Hordeum vulgare
MGARSTATAGEAVARRGSRKKAAMAPSLGGVEAGGRRRGPPRLVGYEELPEYLKDNEYIRGHYRVEWPIRDALLSAFSWHNETLNVWTHLGGFLLFLALAVAGGGPEAAHEAAPGIMRFVVGSANSSWKSDQSGLPSHDAAAAVLGGHGVPRWPRMVFLVGAMACLAISATAHLLACHSHRATVVFWQLDYAGISIMIVASFVPPVYYAFLCHPPARIAYLSAITVLGALVVAVLLSPSCSSPRYRRLRATLFLAMGMSGVIPAVHALWINWGHTACYMALGLEVAMGLAYAVGAWFYVSRVPEKWRPGVFDVVGHSHQIFHVFVLVGAITHYVAVAVLLDWREKAAVSCGGVTS

SEQ ID NO: 715 - protein, 118 aa, Hordeum vulgare
MAGGKEPIEVKFRLFDGTDIGPSKYDPATTVSALKDFILAQWPQDKEITPKTVNDLKLINGGKILENNRTLAESRVTIGEVPGGVITMHVVVRPPQVDKNQKQLGNSPKQNRCGCTIL

SEQ ID NO: 716 - protein, 242 aa, Hordeum vulgare
MEALGLLGRACRLGHSCRRSTATPSPSPPRSSSNRGRAVRAGAKAASSSAPQAMEAKREEKPRVVTLRPVEATPESFAPFGQVIAASPDGDQFGPHDAQLDLSRGIPRFYIMRLESRPLKFSAITHHASVTQCLGSIGGQDWYLGVAKPSIVNEHSGQDGGRSPVQSRAGHYYLPPDPAEVCVFRVSGPKFLKLHAGTWHAGPLFKADAVDFYNLELSDTNVVDHTTHCFKEHDGVTFAIED

SEQ ID NO: 717 - protein, 126 aa, Hordeum vulgare
MKAKAGSRAGGSRLAVKKSKAEKDPNKPKRPPSAFFVFMDTFRKEYREKHPDVKLASVIGKAGGEKWKSLSDAEKAPYNAKAEKLKAEYTKKINAYNNPQAGEASGDSDKSKSEVNDEDDGSEGDA

SEQ ID NO: 718 - protein, 375 aa, Hordeum vulgare
MALPAAKAAPATPFSSQTHGGGILLRRATSPPPPAAALRLGPLFWPWEKVNVGPLSVSPMGFGTWAWGNQLLWGYQESMDSELQECFNLALKNGINLFDTADSYGTGRLNGQSERLLGKFIRECQGPIKSPDDVVIATKFAAYPWRLTSGQFVNACKSSLERLQIDRLGIGQLHWSTANYAPLQERALWDGLVEMYDKGLVRAVGVSNYGPKQLLKIHSYLASRGVPLSSAQVQFSLLSMGDEQMELKTVCDSLGVRLIAYSPLGLGMLTGKYDASNLPNGPRSVLFRQILPGLESLLSCLKSIADRKGKTMSQVAINWCICKGAIPIPGVKTVRHVEDNLGALGWRLSPGEISELEAAAMECPKKMVQNIFQTT

SEQ ID NO: 719 - protein, 1067 aa, Hordeum vulgare
MRLTVRVIGARNLRAMDFNGFSDPYVKLQVGKQRFKTKVVKMNLNPEWDQEFSFVAADVREVLKLDVYDEDMIGTDDFLGQVRVTLEDLLAVENFSLGTRWYQLLPKTKSDKAVDCGEICLAISLETAGATRSWSDDLATELTGTRKEYSLASSQSAGSSSAALAYEENEASKEDNVNEYFSDGTEVPEEDKCGEVRAPEDRFNGIPTEISNEAETSKTEKLDKPSLVDRVYQMFAKKNDDISSTSLRKTEASEEVQQATAVFEAPLSQNSDICSDVTFDELLGSFESRHEEVEMPVNLQGILVNQSYFTSPSDLNNLLFSPDSDFRQTLVQLQNCTDFKTEPWRIDNDGESLKRVISYTTAPSKLVKAVKATEEQSYLKANGKEYSVLLSASTPDVPCGTYFRTEVLFRIMPGPELDSEQQTSHLVISWRMNFLQSTMMKSLIENGARQGLEQNYSQFSDLLSEKIKPIDVDDAGSDKEQVLASLQGGQESDWKIAFLYFCNFGVLSSLFVALYIGVHVSLVNSGAVQGLEFPGLDLPDSLSEIVMGGLLFLQVQHIFKKIICFFQAREQKVGDHGVKAQGDGWLLTVALIEGTKLAPVDATGFSDPYVVFTCNGKTKTSSIKFQTLEPQWNDIFEFDAMDDPPSVMNVHVYDFDGPFDEVTSLGHAEINFVKSNLSELADVWIPLEGNLAKSRQSKLHLRIFLNNSKGTGMVTEYLSKMEKEVGKKMTLRSPRTNTAFQELFSLPAEEFLISSFTCYLKRKLPTQGHLFLSPRIIGFYSSMFGRKTKFFFLWEDIEDIQAIPPSLSTWSPSLSITLHRGRGMDAKHGAKSVESGKLKFSLQSFASFSVANRTIMALWKARSLSSESKVQIAEEQSQNNTLQSEDSGIFVGVDDSKSLQMSEVFSSTISANMNSLLEVFEGGSLEMKVMEKVGCLKYSATQWESDKPDEYQRQIHYKFSRKLSPVGGEVTGTQLKSPMPNKKGWIIEEVMELQGVLLGDFFTLHIKYQFEDLAPKQKVCSVQVYLGIEWSKTTRHQKRIEKNVLSSSSARLKEMFSLASKQLSSTR

SEQ ID NO: 720 - protein, 554 aa, Hordeum vulgare
MEATTTLTLSSSPAIAARRSPVRATISQSHLRHCPVRTSRLHVAQSLASRPLSSGWRWRRRGSGLVVRAETFGQLTTGLESAWNKLRGVDVLTKETIVEPMRDIRRALLEADVSLPVVRRFVSSVSEKALGSDVIRGIRPEQQLVKIVHDELVQLMGGEVSDLVFAKTGPTVILLAGLQGVGKTTVCAKLAFYLKKLGKSCMLVAADVYRPAAIDQLTVLGEQVGVPVYSEGTTAKPAEITKNAMEEAKRNNIDAIVVDTAGRLQIDKTMMVELKEVKKSVNPTEILLVVDAMTGQEAAALVTTFNIEIGISGAILTKLDGDSRGGAALSVKEVSGKPIKFVGRGERMEDLELFYPDRMAQRVLGMGDVLSFVEKAQEVVRQEDTTELQKKIMSAKFDFNDFLKQTQNVAKMGSMSRVIGMIPGMNKVTPAQIREAEKRLAFVESMINAMTAEEKEKPELLAESRERRIRVAEESEKTEQEVSQLVAQLFQMRAQMKKLMGMMQGQEAIAGMGDLMDSLNADEKAPPGTARRRRRRSEPPRQRELDAVGGASRP

SEQ ID NO: 721 - protein, 212 aa, Hordeum vulgare
MATDTFVTVVDFEDDEITATVTSSGDAVKAWLRQIRYVYRWVYHKLIVGLDVEWRPSFGRAQNPVALLQLCVGRRCLIFQLLHADFIPLALRRFLADPDFRFVGVGVQNDVDRLNDDHGLEVANVVDLRSLAADEMRRPWLRQAGLKDVAGVVMGANLHKPRRVTMGPWDACRLSQEQIQYACIDAFVSFEDGRKLLTGDYSDSEEEDDSGY

SEQ ID NO: 722 - protein, 347 aa, Brachypodium distachyon
MPQVKSTAGAGAMPSGSKGGDGEVEAGFAKLQGEDFEYYMQTYSIMLGRNSKKSSVDVDLSSLGGGMNISRHHARIFYDFQRRRFALDVIGKNGCLVEGVLHLPGNPPVKLDSQDLLQIGDKKFYFLLPARSIFASFAAARQVPVIPTQIPPPSFVRPGHPNVSNYHDQPFEGDYGREGDDIRNGINESGTRGKLIKRTKKPSGDLGIYGGHRINVEAIGTLGEGENISDVRPRGDKDMDNQQLLQMEEKEVVSSVATVLSDLCGPGEWMPMRKLHTELVDQFGNVWHHSRVRKYLTAEEWSPVEAKGRPWFGLLGLLRKYPEHFVINTKCKGRAISEFVSLVSLLS

SEQ ID NO: 723 - protein, 259 aa, Setaria italica
MASRIALLCLLGLLVASPAIADSGIYYQLELMWPGAYCEQSSAGCCKPTTSAKPARDFFISGFTVYNATTDAPVNRCSNKAPFDPNEITDIPGLKQYWSNIKCPSNNGQGGWKNAWKKSGACSGLKEKDFFEKALEFRSRLNPLVRLQKNGIQPDFELYSLKKIKKVFQSGINATPLVQCSMGPFNKYMLYKLYFCATEQGTFIDCPVAPKYTCSAEILFHPFKRWMLQQLQGEDAEFAAAADGDDQDAFVLPGVAMDM

SEQ ID NO: 724 - protein, 325 aa, Zea mays
MENPAPSIVVAIAAPVAAEFVKLTFRALYMRRAGPGSREMTVPGRPSDQLGRRVVTDSPVYDGRGADARLVARIQGVTVLVGNADALFTMVFETDRLKGSTLVINGMVTDGSDEWAIYGGTGVFAMATGVMKRRNLAGGSNDGNSDELALEVFCPVFGASQQPISKQQDSISSVTKIGLWGGQGGSAQDITAEQPPRRLHSITVRAGVAVDSIEFTYTDDAGQRRTAGRWGGLGGNVRTIDLGDAEDVREVSGTYGAFEGAITLTSLRLVTSSRTWGPWGIENGTRFSITAPNGSSIAGFYARAGTRLVDAIGVYIRPVVPGRPR

SEQ ID NO: 725 - protein, 393 aa, Zea mays
MKVLVLAVLALVAAAAAAGQGEEGGGPPLPFAVGAAPAGCDVAQGEWVRDDDARPWYQEWECPYIQPQLTCQAHGRPDKAYQSWRWQPRGCSLPSFNATLMLEMLRGKRMLFVGDSLNRGQYVSLLCLLHRAIPDGAKSFETVDSLSVFRAKNYDATIEFYWAPMLAESNSDDAVVHSADDRLIRGAPMDRHSSFWKGADVLVFNSYLWWVAGDKIQILRGADNDPSKDIVEMKSEEAYRLVLHQVVRWLERNVDPGKSRVFFVTASPTHTDGRAWGDDDAEGSGNCYNQTSPISAASSYRGGTSQEMLRATEEVLATSRVPVGLVNITRLSEYRRDAHTQTYKKQWVEPTAEQRADPRSYADCTHWCLPGVPDTWNELLYWKLFFPSNDQVL

SEQ ID NO: 726 - protein, 170 aa, Unknown
  Sequence found in Organisms: Zea mays, Setaria italica, Saccharum officinarum
MPRSRINGNFIDKTFSIVANILLQIIPTTSGEKRAFTYYRDGMLAQSEGNYAEALQNYYEAMRLEIDPYDRSYILYNIGLIHTSNGEHTKALEYYFRALERNPFLPQAFNNMAVICHYRGEQAILQGDSEIAEAWFDQAAEYWKQAIALTPGNYIEAQNWLKITKRFEFE

SEQ ID NO: 727 - protein, 290 aa, Zea mays
MPAPPHPTPLLPPAGEPFRVFVGYDPREHEAYEVCRRSLLRRSSIPLDVRPIRQAELRAAGLYTRARGPTESTEFSFTRFLTPYLAGYRGWALFVDCDFLYLADLADLLAAAAAADRAAGAGRIAVACVKHEYQPAEATKMDGAIQTVYPRKNWSSMVLYNCGHPKNVAALTPEAVSTQTGAFLHRFAWLDDDEIGEVPFAWNFLVGHNRVDPADPDTRPRAIHYTSGGPWFERYRDCEFADLWLKEAEELRADKDKEKDKLKLLKEMDDANGKQEVEEEAAQEKEEKGK

SEQ ID NO: 728 - protein, 499 aa, Zea mays
MGKKHAAGGGWFAAVRKVFRPSGSGGSSATATTTTSSSKDKDKDAVQHGKQDAAAAEEPEVLLLEHFPASETSAEASNEGGDAEAEPAAAATKGRRRREDEVDDEDGEMEEELADDMERARALAAAAEAAVAAAEAAARVVRLAALRRLSREERAAVRIQAYYRGYLARRALRALRGLVRLQALVRGHQVRRQVHLTMRCMQALVRAQARVRARRLTQHPLLLLPPPTPPASSPTLLLGAGRPLCVELALQGDHDVGDDGEVADLLLQQRSRSRGRFGRGDDNGGARSPSGAWDSSSRTLEDARAEGARRHDAAARRERALAYAYAYQQRQWQRQEDEKAGLGFHWLERWMAATTQAQQQEHAPDHAKTHQSTPTRTSSSYVTAAAAFANGMSEKTVETETTSRSPLNQAAAAAHGRPPAIPGYMAATRSARAKARPAPPSATPTHARSRSGGGLAGDTSSSGQNGSAVAGYSPDSSCTGDWTPPRLGVSTRTSRVAYT

SEQ ID NO: 729 - protein, 635 aa, Zea mays
MGDRNHGRSLPLLLYLHLLLPILPFAMADIASEKQALLAFASAVYHGNKLNWSQNIPVCSWHGVTCSLDRSCILALRVPGAGLIGTIPADTLGRLVSLQVLSMRSNRLSGSLPNDVVSLPSLQAIFVQHNELSGDLPPFLSPNLNTLDLSYNSFTGQIPSGLQNLTKLSVLNLAENSLSGPIPDLKLPSLRQLNLSNNELNGSIPPFFQIFSNSSFLGNSGLCGPPLTECSFLSSPTPSQVPSPPKLPNHEKKAGNGLVIVAVAGSFVIFLLAAVMFTMCISKRKEKKDEAGYNGKVTDGGRIEKRKEDLSSGVQMAHKNKLVFLEGCSYNFDLEDLLRASAEVLGKGSYGTAYKAILEDGSTVVVKRLKDVVAGKKEFEQQMELIGRVGKHANIAPIRAYYYSKDEKLVVYEYIGRGSFSALLHGIKGVCEKTPLDWNTRMKIILGTARGLEHIHSEGGSRLAHGNIKSTNVLLDGDHNPYVSDYGLSSLTSLPITTSRAVAGYRAQETFESRKFTHKSDVYGFGVLLMETLTGKAPLQSQGQDDAVDLPRWVHSVVREEWTAEVFDVQLMKYPNIEDELVQMLRIAMACTAWSPDRRPTMAQVVRMVEELRHSASGSRALSVGSPKESSPLSA

SEQ ID NO: 730 - protein, 325 aa, Zea mays
MAPPPPPYARVMEDMVKGREYATQLQALLRESPEASRLVDRILHAISLTIQTAKAAAAAAEEEEEEEASEVQSEVTCTGKRKAAGGAGKRAAACRRRAQPSSVVTKSVRDLEDGHAWRKYGQKEIQNCKHPKAYFRCTHKHDQQCAAQRQVQRRDDDPDAYTVTYIGAHTCRDPATAADDELHAGSRLISFAAANATTASTTTTTGNASNRQAGHKGAVLPAEPPRQLEGGGGGGEREQELELEEVLSSLTPAGSSAATAEAVRTATPGPDQGDVTSGLQLQQQQQHWFGGGGLSGVAHLGYDDTFDLEDIVFGSITGGMYAAEY

SEQ ID NO: 731 - protein, 397 aa, Zea mays
MPGLTAPSDYAEEPPRHPALKINSKEPFNAEPHRSELVASYITPVDFFYKRNHGPIPKVEDLSRYAVSISGLVNKSIQLSMADIWSLPKYNVTATLQCAGNRRTAMSNVRKVRGVGWDISALGTATWGGAKLSDVLELVGIPKLSSVTSLGGKHVEFVSVDKCKEEKGGPYTASIPLNQATNPDADVLLAYEMNGEVLNRDHGYPLRVVVPGVIGARSVKWLDSINVKEEECQGFFMQKDYKMFPPTVDWDNINWSTRRPQMDFPVQSAICTLEDVDVIKEGQARIAGYALSGGGRGIERVDVSADGGKTWVEARRYQKDNVAYVSDGPQSDKWAWVLFEATLDVPANPEIVVKAVDSAANVQPEKVEDIWNLRGILNTSWHRIKIQRSLCVERSKL

SEQ ID NO: 732 - protein, 570 aa, Zea mays
MDLHQLLKYRLTGANVYYEFPTENNLANTPWPASPLKSEFSSSSYTPLSSQLECDNLSALSNTPDNQSSTETISAQPISPLEVDSSYKQAAILRENTQVRPDPLYTTSRHNMQHALREIETVLMAPDADDAATSTKHEFEEHKPAQLMRQRSRTWSHESRQPSPGVVRTQLASGYPTARYEFRPEKRLRELREDPQSMVKQLLTKCAEALSEERIEEFLNLVQQARGVVSITGEPIQRLGAYLLEGLVARHANSGTNIYRALKCREPESNELLSYMKILYNICPYLKFGYMAANGAIAEALRNEDRIHIIDFQIAQGTQWITLIQALAARPGGPPHVRITGIDDPVSEYARGEGLDLVGKMLKSMSEEFRIPLEFTPLPGIYATQVTKEMLDIRSGEALAVNFTLQLHHTPDESVDVNNPRDGLLRMVKGLSPKVTTLVEQESHTNTTPFLMRFTETLDYYSAMFESIDTNLPRDNKERINVEQHCLAKDIVNIIACEGKDRVERHELLGKWRSRLTMAGFRPYPLSSYVNSVIRKLLACYSDKYTLEEKDGAMLLGWKNRKLISASAWH

SEQ ID NO: 733 - protein, 221 aa, Zea mays
MARPCRSSSSAAARLLLLLAAVAAALQAAAATPPVASGFIRKSCRATQYPSVCEQSLAAYGGSPPPRSPRELARAALAVSADRARAASAYVGRLCGSRSGSGDGSPRRGAGAGAKKGSAAAGPVRDCLENLADSVGHLRDAAQEIGGAGMARAGTRAFRWHLSNVQTWCSAALTDENTCLDGLSSRAVDAATRAAVRGRVVEVAQVTSNALALVNKVGPGY

SEQ ID NO: 734 - protein, 661 aa, Zea mays
MSLDSEASSQGGDYRSFRQITRDRLLFEMLRSTRKNSKSTWKVLIMDKFTVKIMSYACKMADITEEGVSLVEDLYKRRQPLPSLDAIYFIQPTKENIVMFLSDMSGRSPLYKKAYVFFSSPVHKELVAQIKKDSSVLPRIAALSEMNLEYFAIDSQGFITDHERALEELFSENAEGSHKYNACLNTMATRISTVFASMREFPRVHYRIAKTIDASTMTTLRDLVPTKLAASVWNCLAKYKTTIPEFPQTETCELLIVDRSIDQIAPIIHEWTYDAMCHDLLCMDGNKYVHEVPTKNGSATEKKEVLLEDHDPVWLELRHAHIADASERLHDKMTNFISKNKAAQLHQARTDGELSTRDLQKMVQALPQYSDQIDKLSLHVEIAGKLNNIIREQCLRDVGQLEQDLVFGDAGTKELINFLRTQLVVSRENKLRLLMIYAALNPEKFESDKGAKLMQLAGLSADDMIAVNNMRCLCGPDTKKSSVGGFTLKFDVHKKKHTNRKERTGEESTWALSRFYPILEQLIENLSKGELPKDEYNCMNDPSPTVHGLPTSSSARTSPAHSMRSRRTGGTWARPRGSDDGYSSDSVLKHASSDFRKLGQRIFVFVIGGATRSELRAAHKLSSKLKRDIILGSSSLDDPPQFITKLKLMSVEELTLDDLQL

SEQ ID NO: 735 - protein, 166 aa, Zea mays
MASEHAAGGDAKHHQKQSLMDKAKGFVAEKIAHIPKPEATLDGVTFKGLSRECITLHSSVNVSNPYDHRLPICEVTYTLRCAGKEVASGTMPDPGWIAASGSTALEIPAKVPYDFLVSLVRDVGRDWDIDYELQVGLTVDLPIVGNFTIPLSTSGEFKLPTLKDLF

SEQ ID NO: 736 - protein, 509 aa, Zea mays
MTIDMSIPGSSGLLNAAGKRDMKFFSNPYVLALTGAAGIGGFLFGYDTGVISGALLYIRDDFPAVKDNYFLQETIVSMALVGAMIGAAGGGWINDAYGRKKSTLLADLMFALGSLVMCAAAGPYILIIGRLLVGLGVGVASVTAPVYIAEAAPSEIRGGLVSTNVLMITGGQFFSYLINLGFTEVPGTWRWMLGVAAVPAIIQFVLMLFLPESPRWLYWKDEKAKAIAVLERIYESDRLEEEVELLATSSMHEFQSNNTGSYLDVFKSKELRLAFFAGAGLQAFQQFTGINTVMYYSPTIVQMAGFSSNRLALLLSLIVAAMNAAGTIVGIYLIDRCGRRRLALTSLAGVVVSLAILATAFILQSSSGLCMSAASGTCQGALGWFAVAGLALYIAFFSPGMGPVPWAVNSEIYPEAYRGTCGGMSATVNWVSNLVVAQTFLSIVGLVGTGPTFLIVAGIAVLAFVFVATYVPETKGLTFEQVEQMWRKRAWGNSGGNCESLLAGTAAAP

SEQ ID NO: 737 - protein, 511 aa, Zea mays
MERRRRRPPRLPLLVFVLVATTCPLGSSAGIGSFGVGAESNGASSSFRTRSLLQIGDRNEDGLFHLPHTRALTHKSRSHRKVPTPAPAPESAPAPSPSMSPPDSSPSPSPHGSHPMPRQSTSHRHPSITPPHLVRPGPRQDGNDPLVYTPAHSRHKHFWTTYGLVAAGIAVFLLVSAASILCFRAKKMGTVRPWATGLSGQLQKAFVTGVPSLKRSELETACEDFSNIIGSTSTCMLYKGTLSSGVEIAVASSLVTSAKDWSKENESQYRKKITNLSKVSHKNFMNLLGYCEEEHPFTRVMVFEYAPNGTLFEHLHVREAEKLDWMARLRISMGIAYCLEHMHQLQTPAALRNFDSTTVYLTDDFAAKVSDLEFWNDAKGHNSTTNNELAFSPDTEDIVRKYGMVLLEILTGRVPSSEDDGPLENWVSRYFEGGMRLEELIDPSIGFFPEDTARALCEVVRSCIDRDPKKRPQMKEVAARMREITALGPDGATPKVSPLWWAELEIMTSES

SEQ ID NO: 738 - protein, 252 aa, Zea mays
MWHAAAAPNNLHPAVATTSSPALRRARWPITRPSSSVKVQSSIRNGNGSADNLDHLQRASKGRQQRQGASAPGPRARRVVRTTPFGLWWDSFPEARTLDQMVRTIMDADDADTDTRFGGVVPAAAAAAPTAVPRADHGRTPWEVRERAGEYLVRFDMPGMARDDVRVSVQDRTLVVAAEKKQQPAADGGGDEEGDNEEEAWPPASFGRYRTRVELPENVDVERIAAEVKDGVLYLTIPKLSAGAKVVNIQVQ

SEQ ID NO: 739 - protein, 220 aa, Zea mays
MQRDARSWSPAPATDAAGPYAMPSPVQPSTKSTKETVKNALSRWGRKVGEATRKAEDLSRNTWQHLRTAPSIAEAAVGRIAQGTKVLAEGGHDRIFRQAFSAPPDEQLRKSYACYLSTAAGPVMGVLYLSTARVAFCSDSPLSYEASGGDRTEWTHYKVAIPLQRLRAASPSANKTKPAEKFIQLVSVDSHEFWFMGFVNYDGAVAHLQEALSGFRNLQA

SEQ ID NO: 740 - protein, 303 aa, Zea mays
MFLADKYSSLLPFHHHHSKPSRRQQQKGEAHRFGTALAARLRGLLPLPASPLAALVRVADLLALTLAEAGPALACSGEGAAVAAHLDAGVALLDACNAIAARLDGLRRRRLLASLALHLLLSSTSPSGRTRARAALADRDTPAASPAPPPLPWLPFEQPRGQLTAAARVLAAVDAVSSLAAAAAATVLAGGPATFPWISGGGGDDLPWAEPFNALSGQLAALGAGEVRAVDEAVRRLASVLDSGTDDEGAVRAAAQEVGRRTEELAPRLDRLSDAVGGVFRAALGLRNAELDCLMVGPAGKPV

SEQ ID NO: 741 - protein, 102 aa, Zea mays
MAEKGALQSAREWVVDHKLRAVGTLWLSGIVGSIAYNWSRPGMKTSVKIIHARLHAQALTLAALAGSALVEYYDHQQGSGSKVHQYAKQFLSSDSNSGQQKE

SEQ ID NO: 742 - protein, 446 aa, Zea mays
MHHQQRMKQAAAAAAAAQQQQLMQQALLLQQQQQSQAQPPLFPGHHPHPGLLAAPQIEPIVSGNLPPGFDSSTCRSVYVGNIHLQVTDTVLQEVFQSIGPVEGCKLIRKEKSSFGFIDYYDRRYAALAILSLNGRQLYGQPIKVNWAYTSTPREDTSGHFNIFVGDLCPEVTDATLFAFFSGYSTCSDARVMWDQKTGRSRGFGFVSFRNQQDAQSAINDLNGKWLGNRQIRCNWATKGANAGEEKQILDTKVDLSNGSSESGKENPNDDGPENNPQFTTVYVGNLPHEATMNDVHLFFHSLGAGSIEEVRVTRDKGFGFVRYSTHEEAALAIQMGNGQLIGGRQIKCSWGSKPTPQGTASLPLPPPALAPFSTGVSATDLLAYQRLTLSKMASNPALMGQHALKQVAALGIGGGASQSIYDGGFQGINTATGTTSVQQQQQLMYY

SEQ ID NO: 743 - protein, 571 aa, Oryza sativa
MEGALLCAANHAPLTPITFLDRAALVYPDRPAIVASSSGLTRTWRETRDRCLRLTAALAALGVHRHHVVAVFAQNIPAMCELHFGIPMAGAVICTLNSRLDAAMASVLLRHSEAKLIFVDCALLDVAHDAIRRISQSGATPPVLVLISELLDDPSDAKLPSGRVDYEYEHLVGNAGSSPEFAVRWPADENEPIALNYTSGTTSRPKGVIYSHRGAYLNSLAAVLLNDMASTPVYLWTVPMFHCNGWCMAWGVAAQGGTNVCVRRVTAATIFDAVARHGVTHMGGAPTVLSMIVNATAEEQRPVARRVTVMTGGAPPPPKVLHRMEEQGFLVIHSYGLTETYGPATVCTWRPEWDALPAEERARIKSRQGVHYHGLEVDVKDPATMRSVPRDGKTMGEVMLRGNTVMSGYYKDGAATAEALAGGWFRSGDLAVRHEDGYVKVLDRSKDIIISGGENISTIEVEAALFSHPAVEEAAVVGRPDDYWGETPCAFVKLRPGAAAAAKAGVVEEELMAYCRARLPRYMAPRTVVVVEEGLPKTATGKVQKFELRARAKAMGTVPAAAAAKSKRSKL

SEQ ID NO: 744 - protein, 381 aa, Sorghum bicolor
MTSCFNGGAGWPEPVVRVQHVSDTCGDTIPERYVKPPSERPCLSPAAASSGGVGGGGGGGPNIPVVDLSMLDVDATSRAVAAACREWGFFQAVNHGVRPELLRSGRAAWRGFFRQPAVVRERYANSPATYEGYGSRLGTAKGGPLDWGDYYFLHLLPASLKSHEKWPSLPSSLRGTTEEYGEEVLQLCRRVMRLLSSGLGLEAGRLQAAFGGEGGEGACLRVNLYPRCPQPELTLGVAGHSDPGGMTMLLVDDHVKGLQVRSPDGQWIIVDPVPDAFIVNVGDQIQVLSNASYKSVEHRVTVSAAEDRLSMAFFYNPRSDLPIAPMPELVGPGRPALYPEMTFDEYRVFIRQRGLAGKAQLQSLQANQTAAAAAGSSSTCS

SEQ ID NO: 745 - protein, 366 aa, Sorghum bicolor
MWVTSSMPQVWDEEAAAKGGGAAAVTPAPAAAMLGSLAGWLSRTVQPQPPPPRVCGTEGGPPVTAPRLRLRDGRHLAYCESGVPRDQARFKVVFSHGFTGSREDSVRASQEVAEELGVYMVGFDRAGYGQSDPNPNRSVKSAALDVEELADALGLGPKFYVIGISLGCHAVWGALKYIPDRIAGAVMMAPVVNYWWPGFPPELAAEVYAKQEVGDQWALRVSHHAPGILHWWMDQSWLPTSTVVAGTTPLPNARDAEIRRNMQADGTFQQKREQATQQGIHESYYRDMTVMFGKWEFDPMALPEPPCPVHLWQGDEDGLVPVVLQRYLAGKLAWVNYHELPGTGHFLSAVPGLGDTVLRTLFGQKQ

SEQ ID NO: 746 - protein, 2182 aa, Sorghum bicolor
MANLGGGAEAHARFKQYEYRANSSLVLTTDSRPRDTHEPTGEPETLWGRIDPRSFGDRAVQNKPPELEEKLSKSRTKKSKRDAAAAADPADLPRRDAKRRRRAASTQEVSVLSLTDDAVYKPQTKETRAAYEALLSLIQQQLGGQPLDVLAGAADEVLATLKNDKVKNPDKKKDIEQLLNPISSQLFDQLVSIGKLITDFHDAAAGDAAGVPSADGTDTTLDDDVGVAVEFEEDEDEESDFDQVQDDLDEDDEDDMAELNGPGGMQMGGELDDDDMQNANQGLAVNVQDIDAYWLQRKISQAYGDGDIDAQQSQKLAEDILKIIAEGDDRDVENRLVMLLDYEKFDLIKLLLRNRLKIVWCTRLARAEDQEQRKKIEEEMASDPSLAPILEQLHATRASAKERQKNLEKSIRDEAKRLLNNDAGADGARDRRAAERDMESGWLKGQRQLLDLESLSFHQGGLFMANKKCELPTGSFRTPHKGYEEVHVPALKAKPYETSEKIVKISDMPEFARSAFDGMTQLNRVQSRVYDTALFKPDNILLCAPTGAGKTNVAVLTILQQIGLHMQDDGQFDNTKYKIVYVAPMKALVAEVVGNLSNRLAGYNVTVRELSGDQNLTKQQIDETQIIVTTPEKWDIVTRKSGDRTYTQMVKLLIIDEIHLLHDNRGPVLESIVARTVRQIETTKEHIRLVGLSATLPNYEDVALFLRVRKESLFYFDNSYRPCPLAQQYIGITVRKPLQRMQLMNEICYEKVMAAAGKHQVLIFVHSRKETAKTAKAIRDTALANDTVSRFLKNESASQEILGTHAELVKNNDLKDLLPYGFAIHHAGMARVDRELVEELFADKHIQVLVSTATLAWGVNLPAHTVIIKGTQIYNPEKGAWTELSPLDVMQMLGRAGRPQYDTHGEGIILTGHSELQFYLSLMNQQLPIESQFISKLADQLNAEIVLGTIQNAREACSWLGYTYLYIRMLRNPTLYGLPADILESDKTLDERRADLIHSAANLLDRNNLIKYDRKTGYFQVTDLGRIASYYYISHGTISTYNEYLKPTMGDIELCRLFSLSEEFKYVGVRLDEKMELAKLLDRVPIPVKESLEEPSAKINVLLQAYISRLKLEGLSLSSDMVYIRQSAGRLLRALFEIVLKRGWAQLAEKALNLCKMVDKQMWSVQTPLRQFTGIPKEILMKLEKKELAWERYYDLSSQEIGELIRYPKMGRQLHKCIHQLPKLNLSAHVQPITRTVLGFELTITPDFQWDDKVHGYVEPFWVIVEDNDGEYILHHEYFMLKKQYVDEDHTLNFTVPIYEPLPPQYFIRVVSDKWLGSQTILPVCFRHLILPEKYAPPTELLDLQPLPVSALRNARYEGLYSAFKHFNPIQTQVFTVLYNSDDSVLVAAPTGSGKTICAEFAILRNHQRAVSGESNMRVVYIAPIEALAKERYRDWERKFGEFAKVVELTGETAADLKLLDKGEIIISTPEKWDALSRRWKQRKHIQQVSLFIVDELHLLGSDKGHVLEVIVSRMRRISSHIGSNIRIVALSASLANAKDLGEWIGATSHGLFNFPPAVRPVPLEIHIQGVDIANFEARMQAMTKPTYTAITQHARNSKPALVYVPTRKHARLTALDLCAYSSVEGAGTPFLLGSEDEMDTFTRGVEEETLKNTLKCGVGYLHEGLSELDQELVTQLFLGGRIQVCVASSTMCWGRPLPAHLVVVMGTQYYDGRENAHTDYPITDLLQMMGHASRPLQDNSGKCVILCHAPRKEYYKKFLFEAFPVESNLHHFLHDHMNAEVVVGVVENKQDAVDYLTWTFMYRRLTKNPNFYNLQGVSHRHLSDHLSELVETVLNDLESSKCVAIEEDMYLKPLNLGLIASYYYISYTTIERFSSMLTQKTKVKGLLEILASASEYAELPGRPGEEEFIERLVRHQRFSIEKPKYGDPHVKANALLQAHFSRHTVVGNLAADQREILLSAHRLLQAMVDVISSNGWLSLALSAMELSQMVTQGMWDRDSVLLQVPHFTKDLARRCQENEGKPIESIFDLAEMGVDEMRDLLQLSNSQLQDIIEFFKRFPNVDMTYEVREGDDITAGDNVTVQVTLERDMTNVSSEVGPVHAPRFPKPKEEGWWLVIGDSSTNQLLAIKRVALQKRARVKLEFSAPAEAGRKDYMIYLMSDSYLGCDQEYEFTVDVKDAGGD

SEQ ID NO: 747 - protein, 120 aa, Sorghum bicolor
MQAVGIRRGLTIDPAGEEEPAAARVGRLVQESPVVIFARPGCCMAHVMKRLLQAVGAHATVIELDAGAAEEEELAAGAEGAGVPALFVGGDPVGGLEGLMALHLSGRLEPRLRELGALCA

SEQ ID NO: 748 - protein, 301 aa, Sorghum bicolor
MVLLRVCHRFGRPPRFPSFLSMAAPQQPAPLSGSAPKRFRAMATDVAAAAVDPPAARGCPAMKAEFAKHAEYLNALNDKRERLVKASRDVTMNSKKVIFQVHRITKVNRDEVLSKAENDLAAVVNQYIAKLVKELQGTDFWKLRRAYTFGVQEYVEAATLCRFCKTGTLLSLAEINDSLLALSDKSVEPLQLNVLDYLLGVADLSGELMRLAIGRISDGEVEYAKTICAFVRDIYRELTLVVPLMDDNNEMKKKMEVMLQSVVKIENACFSVHVRGSEYIPLLGSSGDPDYSFFGASDFDQ

SEQ ID NO: 749 - protein, 367 aa, Sorghum bicolor
MLPAALLPSPPGRLLASIPLRCHAPTQQPSTAAAAAARGLLLGGARSPVVKRVPDGGGWLLWHQSGPRVALSTSMDGLRWSALVSPDPLLPTEDWWAFDTASVRPSDVLLISGPAASSRRFPSSAVYWLYYTGSTDERFGSPFPDADVPALPGLAISQDGRHWARIEGDHHTGALFSVAEDGEEPRGWETRCIVAPKVVMHADGDLRMYYHSFDETSQRPAIGLARSRDGIRWKKTGKVLEAGRAGSFDECGVRHGHVVRDRAAGRYVMVFEGVDADGRVSIGMAVSEDGLKDWRRSSEIPVLCPSDDDDGWDGAGVGSPCLVQMDGAYDWRLYYMGVGRDGEASIGMAHSEGQALLKFEKCDAILM

SEQ ID NO: 750 - protein, 443 aa, Sorghum bicolor
MKVDVVGTTLVAPSEDTPRRELWLSNLDLAVPKTHTPLVYYYPAPAPAAATGTDDGGDRAAFFAPERLEAALARALVPFYPLAGRLGVGVGEGGRLRIDCNAQGALFVVARADFAGEDVFGDTDGGYEPSPEVRRMFVPFVPSGDPPCVMSMFQVTFLKCGGVVLGTGIHHVTMDGMGAFHFMQTWTGVARGLDVAEACGPLPPFHDRTLLRARSPPTPAFDHPVYSPSLLNGRPRPFVTRVYAVSPKLLADVKSRCAPGVSTYCAVTAHLWRCMCVARGLAPCSDTRLRVPANVRHRLRPALPRSYFGNAIVRDLVVARVEDVLDRPLGFVAQAIKDAVDRVDDAYVRSVVDYLEVESEKGSQAARGQLMPESDLWVVSWLGMPMYDADFGWGTPRFVAPAQMFGSGTAYVTQRANKDDGIAVLFGLEPEYLQCFEKVFYGE

SEQ ID NO: 751 - protein, 407 aa, Sorghum bicolor
MLIGMPQGAAATAVDSNGKDGGGGANPTSTARPAAALPLKLLRPLLLLAVLGTGFLAVVVLFLGGPTYSAMLPRLSLAPDAVLPAPASAGKAPLDRWKRAPASAWHNMTDEELLWAASWRPSVRRYPYRRTPKVAFMFLTRGPLPLAPLWDRFFAGAGDAALFSVYVHATPGYRHDFPPASAFHRRFVPSQVAEWGKASMLDAERRLLANALLDPANELFVLLSESCIPLYGFPAVYSYLTRSRASFVGAFDDPGPAGRGRYRAGLAPEVRREQFRKGAQWFELDRELAVDVVADERYYPKFRDHCRPPCYVDEHYLPTALSIEAPARIANRSVTWVDWSRGGAHPATFAGKDVDEAFLKRLTAAPAKQNCTYNGQPSEVCFLFARKFAPSTLRPLLRLAPKLLGYG

SEQ ID NO: 752 - protein, 79 aa, Sorghum bicolor
MPPLAPTTTSSSEPEPPFRPREKILEKQRYFQSVHRPTYLKGRHDVITSVAIPLALALSSMYLVGRGIYNMSHGIGKKE

SEQ ID NO: 753 - protein, 296 aa, Sorghum bicolor
MGRQPCCDKVGMKKGPWTAEEDQKLVGFLLTHGHCCWRVVPKLAGLLRCGKSCRLRWTNYLRPDLKRGLLSDDEERLVIDLHAQLGNRWSKIAAQLPGRTDNEIKNHWNTHIRKKLLRMGIDPVTHLPLQEPPAPPPPPPPEQEPDDQEEEPQQQEQQAGKLMQEGGAGEDDVAPMVQPHETIMAPPPPPTTAASNCGSAAVSSASAGSASVVSPSCSSSSASAPAVTGVEATEWPEPVYLFGMDGIMDAGWAGLFPSTGAGAGGCFGLGGVDPFDQYPGVGVGGAGFDQDDGHWM

SEQ ID NO: 754 - protein, 694 aa, Sorghum bicolor
MAALEAARSWAGSVIPPELAAAAGGDPLAALAATAAALVAGLLILAVWFRSGGGAPSKPVAAPVRPPPVKVDADADVDDGRKRVTIFFGTQTGTAEGFAKSMAEEARARYEKAVFKVVDLDDYAQEDEEYEEKLKKETVVLFFLATYGDGEPTDNAARFYKWFTEGKEKEVWLKDLKYGIFGLGNRQYEHFNKVAKVVDELLEEQGGKRLVPVGLGDDDQCIEDDFTAWKELVWPELDQLLRDEDDTTGASTPYTAAIPEYRVVFIDKSDLSFQDRSWTLANGTGVIDIQHPCRANVAVRKELHKPASDRSCIHLEFDISGTGLVYETGDHVGVYAENSVETVEEAERLLDLSPDTFFSIHADAEDGSPRKGGGSLAPPFPSPCTLRTALLRYADLLNPPKKAALLALASHASDPAEAERLRFLASPAGKDEYSQWITASQRSLIEVMAAFPSAKPPLGVFFAAIAPRLQPRYYSISSSPMMAPSRIHVTCALVYGPSPTGRIHQGVCSTWMKNTIPLEYSEESSWAPIFVRQSNFKLPADPSTPIIMIGPGTGLAPFRGFLQERLALKQSGTELGTSILFFGCRNRNMDYIYEDELQTFLEEGALSELIIAFSREGPTKEYVQHKMVEKATEIWNIISHGGYLYVCGDAKGMARDVHRMLHTIVQEQGSLDSSKTESYVKSLQMEGRYLRDVW

SEQ ID NO: 755 - protein, 470 aa, Solanum lycopersicum
MVQPHVLLVTFPAQGHINPSLQFAKRLIEMGIEVTFTTSVFAHRRMAKIAASTAPKGLNLAAFSDGFDDGFKSNVDDSKRYMSEIRSRGSQTLRDVILKSSDEGRPVTSLVYTLLLPWAAEVARELHIPSALLWIQPATVLDIYYYYFNGYEDEMKCSSSNDPNWSIQLPRLPLLKSQDLPSFLVSSSSKDDKYSFALPTFKEQLDTLDGEENPKVLVNTFDALELEPLKAVEKYNLIGIGPLIPSSFLGGKDSLESSFGGDLFQKSNDDYMEWLNTKPKSSIVYISFGSLLNLSRNQKEEIAKGLIEIERPFLWVIRDQEEEKEEEKLSCMMELEKQGKIVPWCSQLEVLTHPSLGCFVSHCGWNSTLESLSSGVPVVAFPHWTDQGTNAKLIEDVWKTGVRMRVNEDGVVESDEIKRCIEIVMDGGEKGEEMRKNAQKWKELARAAVKEGGSSEVNLKAFVLQVSKSC

SEQ ID NO: 756 - protein, 648 aa, Solanum lycopersicum
MALTTTFFSLFLLIITVAGQTTPVAEAPAPAADDCNGIFLQYVFNSGSKIKPTLKTRQPYKFQSILSITNNGLEELKLWRVFVGFQHDEILVSASNALLADGESFPALVGNGTVFAGFPAADLKTAVETAGDTTQTSVQIKIVGTQFGVGSPNVPMPSNISLENDGFICPKPSMQGKSVMQVCCIKDENFKTNLTLGEKFSPRQDGDLTIMYDILRTYDSNYWAQVTIANHNPLGRLDNWKLSWDWMKDEFIWEMKGAYPSVVDTSECVFGPQAKFYQNLDFSTGLNCQRRPTLIDLPLEKTNDTKLGMIPFCCRNGTILPPAMDPSKSVSAFQMNVFKMPPDLNRSSFTPPQNWKIEGRLNPDYKCGPPVRVSPTQVPDPSGLLPATSVFASWQVVCNITQPKGASPRCCVSFSAFYNESIIPCPTCACGCPSNTARTCSTKAPALLLPSQALLVPFDNRTKMSLAWAEINHLPVSNPLPCGDNCGVSINWHLFTDYRGGWSARITIFNWEDAAFADWFTAVELDKAAAGFDAVYSFNGTMLDGVNNTIFMQGLPGLNYIVAEADGANPAKDPRVPGKQQSVISFTKKNIPNINVAAGDGFPTKLYFNGEECSLPKLLPTSSSSRISSFTVTTSILAAVVVFMLVRQ

SEQ ID NO: 757 - protein, 543 aa, Solanum lycopersicum
MQAVKASSFSPFHLNLNSTSSFPKTTNLYIQQNYENPISCFPSIQTQNAKFKVFTATSPSVSTESETPFDEKTENENQEEKFEWYAEWYPIMPICDLDKRRPHGKKVMGIDVVVWWDRNEKEWKVMDDSCPHRYAPLSEGRIDQWGRLQCVYHGWCFNGAGDCKLIPQAPRDGPQVHTSKRACATVYPSCVQNDILWFWPNSDPLYKDIYLMKRPPYIPELDDSSFSKTFIVRDISYGYELLIENLMDPAHVQYSHYGIMNVPVAPQSVKADREGGRPLDITITKLDVNVITANQGPGRNTFVPPCVYYSYFAFGGSQGKTTAVSSGTVQEKPSAEKQKKALLVFICIPVSPGHSRIIFASPRNFATWADRIIPRWIFHLGQNLILDSDLYLLHVEERKLKEIGSYNWHKACYVPTKADAIVVAFRRWLNKYAGGQVDWRGKYNGDLPPTPPREQLLDRYWTHTVSCTSCNLAYKSLNALEVVLQIVSIGAIGIVAALKQGTLSAVTRYSLVTVALLCFVASRWLSHFIYKNFHFHDYDHAFR

SEQ ID NO: 758 - protein, 147 aa, Solanum lycopersicum
MGLKGKLIASVEMKCGEGSFFDIFHINTNQVPNISPKNIVHFGIHEGESVKAGSIVSWKYNEAGQEMYMKHLIEAADPQQKLIKWKVIEGDLLKLYKYCNFTTSCDGQWTTWTIDYEKKTEDTPEPLLHLGVILAMTKDIESHLLKK

SEQ ID NO: 759 - protein, 408 aa, Triticum aestivum
MPATDYQGSSSSSHSPFASFGRSLLSRSRDTPASPAMLPSGGEAEVEAFQRHVAVSLAELRDGEDFLSIAWIRQLLEAFLLCQEEFRAVAAEVRRRGCGGALAERLVGEYHERAVKALDVCNAARDGVDQVRRWGRLAGIAASVLLAPEEIHEGQLRRARKALSDLSILLVDDAAAAGGGGGVASFLASHRNRSFGRGSRASPSRASSASSSSSSSSHFRSLSWSVSRTWSASRQLQAIGSGLAAPRAHEAGLAAPVYAMGCLLHLASWALVAAVPCPDRVAALQAHHLPAAPPRGAFAWAPPLLTLQDRLTEEGKRKDRRNSCGLLKEIHALEKCAQRLAEAIDAAPIPLTGEREAAVREAAAELAAVCSAMKDGLEPLERQVREVFHRIVRSRMEGLDSPMPNAAD

SEQ ID NO: 760 - protein, 505 aa, Triticum aestivum
MAAGTGRVLPLLAVAAALAAALLYTAPFSKSLGGEGCSLLPHGHFWIASQRVVALGRVGPAAVEVKEGLINAIAVGDYRSFVLRRPLVDYGDAVIMPGLIDVHAHLDEPGREEWEGFSTGTRAAAAGGITTLVDMPLNSFPSTVSEETLKLKVDAARDKLYVDVGFWGGLVPENALNPSKLESLLNAGVLGLKSFMCPSGINDFPMTNSTHIEEGLVTLAKYKRPLLIHAERIPDVSSDEELDGELDPRSYATYLKSRTPAWEESAVRDLNRAMKDTEVGGRSEGAHLHIVHLSDSKTTLDLLKDAKHSGAKVTIETCPHYLAFSAEEVPDGDTRFKCSPPIRDAANKENLWEALLDGHIDMLSSDHSPSTPDLKLMEEGNFMKAWGGISSLQFVLPVTWSHGKKYGITLNQLASWWSEKPAELAGQKNKGSILPGYHADIVVWKPEAQFHLDDTHAVYHKHRNISAYLGKELSGKVLSTFVRGNLVFAEGKHAGAACGATILAK

SEQ ID NO: 761 - protein, 170 aa, Triticum aestivum
MATDAILETIKPRRSPWLEDLPVTNGGAAKGGKVDLSGMRRRVSSSLSLSLQPLSSSSSAAFRRARSMPSIKALAAAGAVRQWWEWGLGWVMTRKPSFARGLKMSEDEAALLGCHCRGTLRHVFYKARAEVRRLLGRDGRPLGGVAAQDFRYDSVSYAQNFDNGDVDARC

SEQ ID NO: 762 - protein, 532 aa, Triticum aestivum
MAAAADVGQLAGAAAATLLAAVLFAAALGRQRQRRRRGAPVEGIPAPDDGCAVADGAGSAAVDGPTDVIIVGAGVAGSALAYTLGKDGRRVHVIERDLTEPDRIVGELLQPGGYLKLMELGLQDCVDEIDAQRVLGYALFKDGKNTKLSYPLEKFHSDVAGRSFHNGRFIQRMREKAASLPNVQLEQGTVTSLLEENGTVKGVQYKIKSGEELKAYAPLTIVCDGCFSNLRRALCSPKVEVPSCFVGLVLENCELPHANHGHVILANPSPILFYPISSTEVRCLVDVPGQKVPSIASGEMANYLKTVVAPQIPPQIYDSFIAAIDKGSIRTMPNRSMPAAPHPTPGALLMGDAFNMRHPLTGGGMTVALSDIVVLRNLLKPLRNLHDASALCKYLESFYTLRKPVASTINTLAGALYKVFSSSPDKARDEMRQACFDYLSLGGVCSNGPIALLSGLNPRPLSLVAHFFAVAIFGVGRLMLPLPSPKRMWTGARLISGACGIIFPIIKAEGVRQMFFPATVPAYYRAPPEAEF

SEQ ID NO: 763 - DNA, 1913 bp, Arabidopsis lyrata
atcttcctcttttccattctcttaaacacacattttccttaaaaaaaataaaccaagaaaatggacccttggtcatggatatgcgagcttcccgaagctcccgagttcagcgagtctgattcacacgcagtgtttcagcttgcaggcgatttgacacgttcgatcaaacttagagccgaacgggcttcgggttctgacctagagtctcactctctcaccttcaaagtggtagcagagggtttcaacctccttaagtcatcgaccatttgggtctcggacacatgtcccttgtcgtcggagaaaccgttcctccctcttgttctccagcttcttcaagaactaatcacccattcccctacctcacgtgccggcgcgtgcacaaagtttgaacaacttgaaatcaaaccaggtccggttagctgggtcatggactctcactcacctgaatccttctcatcagtctttaatctaatcctcctcacgcgcctcttctggttgtgtgtatttgacgcgcctagcgaagtaggctctttcttcttccaacacctactaggtccacacgtgaacgcgcttacatgtcaacacgcacctgtgttacgaacgtttctcgtttcacttggtgtagacgccgagctgtgtatcgtacgagccgcttcttacgccttatccaaatggatgatctctaaagagataggacttgggaatctcgggttgaaacagttaagtagcagcctcatgcctcgtcattcattgggattttcgtatgcaacagaagctcatgggctttggatcttgaaaggctatttcccaatcttgtcaatgaacgtcacaaataatagctctaacgaggttcacaacaagatcatcaagtttccattcgtagagcctaaagaagctgtcctacgttacgctttgtcgcatcaacaagcggaaatactagtacagtttgaatactccgttaggttctacgagaactacataaaagtgaacgcacgtgtagacaacatacgcatccacgtatcaaagttagggtttaacaaaggaggagttggcgtggagaatcagatagcggattgttactcggaggagaggtacttcccgtcacgggtacgggtctggctcgggccagaactcgggtcgagccacgtatcggggctaagcctaggaaagtcaacgaagaacgaagagagagatattgaggtgactagggtgctaaagggaaatttcggaaaaggtaaagtggctccaagagtcaaggcaagagcaagaatgtcaacgaagaggaaggttaaagattggagaatcgagcaggagagtgaaggaaacgcagctgttttcgatgcggtgttgtacgatagagagagcggccaagaagtgacaacggttatgccgaagccaaaccaagagggtttaaagaatgtgtttacgaagagtggagggatggtatttggaagggatgcgtatggagatgaagttgggtggagagtagggagagagatggaaggaagtgtgttgaagtggagaatgggtggcaaaatttggctaacttattggccaaacaagttgaacactttgttttatgagactagatgtgtagagtggtgtgatgaggttgatttgcctttgcttcccacttgttagagtcgcaaataagaaaaaatatataggtacataaaataattggatataggtcataaattggtatatgtgtttgtaaatatttactcttgaggtatctcaaatattgttttcgtataattgtcatttgcatacgcacacctatagctttatctgaaataaatagctaaccattttgtatgtgtttggcaaaaatctattgttgttcagcactagaaagtcaattagctttgtaaggaccaaatcttctttataacacttgctttaattttttg

SEQ ID NO: 764 - DNA, 1970 bp, Eutrema parvulum
tgaggatattgtaaagccacagataaatttttgatccgtgattgctccgttgaagggtctttgattagtttaacatccttcatggcttctcttccaccacatgatctctctataaaattctctaccttcgttccttgcaaaaaagaattgtatcctccctttttttcatctactaaacacattttcgcgataaattcaaacaaatctaagcatatggatccgtggtcgtggatttgcgagcttccggattcaccagagttcgccgagtctgagtcccatgcagaatttcagctcgcaggcgactcgattcgttcaatcctacttagggttgaacgaggttctgagtcggattcagaatctctgtctcttattttcaaagtgatagtggaaggttttagccgtcttaaatcatcgaccatatgggtttccgacaaatgtcacttgacatcggagaaaccgttcttccctcttgttctccaacttcttcgagaactaatctcacgctcccctaccacacgtgacagcacgtgcacaaagtctgagcttcttgaaatcaaaccaggaccggttaactgggtcatggactctcactcgccggaatctttctcttccgtctttaatctaatccttctcacgcgcctcttttggctatgtgtgtacaacgcgccaagcgaagttggctctttcttcttccaacacctattaggtcctcacgtgaactcactgacgtgtcaacacgcgcctgtgttgagaacgtttctcgtctcactcggtgtagatgctgagctgtgtatcgtacgcgccgcttcttacgctttatccaaatggatgatctccaaggaagtgggacttgggaatctcggattgaaacagatcagtaacactttgccacgtcattcattgggcttttcttatgcaacagaagcccatgggctttggatcttgaaaggctatttcccaatcttgtcgatgagcgtcacaactaataataataatagctctaacgaggttcataacaacaagatcatcaagtttccgatcgtagagcctaaagaagctgtccttcgttacgctttgtcgcaccaacaagctgaagtaatcgtgcagtttgaatactccgttgagttccacgagaactacataaaagtgaacgcacgtgtcgacaatatacgcatccacgtgtggaagctagggtttcacaagggaggaggcgtggagaataagatagcagattgttactcggaggagaagtactttccctcgcgggtaaaggtctgggtcgggccagagatcgggtcaagccatgtgtccgggctaagcctaggacggtcgacaaagaacgaggagagagaggtcgaggtaacgagggtactaaaaggaaattttggtaaagggaaagtggctccgagagtgaaggcaagagcaagaatgtgtacgagaaggaagataaaagattggagaatcgagcaagagagtgaaggaaacgctgctgttttcgatgcggtgttgtacgatagagagagtggccaagaagtgacgacggtgaagccaaatcatgaggggtttaagaatgcgtttacaaagagtggagggattgtgtttgggagagatgagtatggagatgaagttggatggagagttggtagagagatggaaggaagtgtgttgaagtggagaattggtggcaaaatttggctaacttattggccaaacaagttgaacacttcgttttatgagacgagatgtgtggagtggtgtgatgagattgatttgcctttgcttcccacttcttaattagacgcaaataagactaaagatgacaaagagtgttggtatatgttattgtaaatattaattaaacctaaggttattgtagtaatatctcaaatatgtgtaattcgtattaattgtctacatgtgcagacgcaatatggttacatatagcttcagaaatacatagcaaaaactaa

SEQ ID NO: 765 - DNA, 2115 bp, Eutrema halophilum
tgaggatattgtaaagccacagatatatttttgatccgtgattgcttcgttgaagagtctctgatcgataagttcaatatccttcatggcttctccaccaccacacgatgtctctataaaattctttacctccgtttctcgctagaagaattttattctcccctttttcacatctaccaaaacacacatatattttcccgagaaaaataaaataagctcaagaaaaatggacccgtggtcgtggatatgcgagcttcctgaatcttctgagtttgccgaatctgattcacccgcagtgtttcagctcgcaggggacttgactcgttcaatccaactcacggttgaacgagcttcagggtctgaccaagaatctctctcactcattttcaaagtgatagtaaagggtttccaccgccttaaatcatcgaccatatgggtctccgacacgtgtctcttgtcgtcggagaaaccgttcctccctctagttctccagctcctccgagaactaatctcccactcccctaccacacgtgacagcgcgtgcacaaagtctgacctacttgaagttaaaccgggtccggttaactgggtcatggactctcactcgccggaatccttctcatcagtctttaatctaatcctcctcacgcgcctttttcggctatgtgcgttcgacgcgcctagcgaagttggctctttcttcttccagcacttactaggtcctcacgtgaactcgcttacctgtcaacacgcacctgtgctgaaaaagtttctcgtctcagtcggtgtagaccccgagctgtgtatcgtacgcgccgcttcttacgccttatccaaatggatgatctccaaggaagtgggacttgagaatctcgggttgaaacagctcagaagctcattgccacgtcatccattggggttttcatatgcaacagaagcccatgggctttggatcttgaaaggctattaccctatcttgtcgatgaacgtcacaggtaataatagctctaacgaggttcacaacaatatcatcaagtttcccatcgtagagcctaaagaagctgtcctacgttacgctttgtcgcaccagcaagttgaaataatcgtgcagtacgattactccgttaggtttcacgagaactacataaaagtgaatgctcgtgtggataacatacgcatccacgtgtcaaagctagggcttcataagggagggggcatggagaatcagatagcagattgttactcggaggagaagtacttcccgtcgcgggttagggtctgggtcgggccagaaatcgggtcaagccatgtgtccggactaagcctaggacgttcaacgaaaaatgaggagagagaggtggaggtgatgagggttctaaaaggaaatttcgggaaagggaaagtggctccgagagtgaaggcaagagcaagaatgtctacgaggaggaagatcaaagattggagaatcgagcaggacagtgaaggaaacgctgcggtttttgatgctgtgttgtacgatagagagagcggccaagaagtgacgaacgtgaagccgaaccctgagggttttaagaatgtgtttacgaagagtggtgggatggtttttggaagagatgagtatggagatgaagttgggtggagagttgggagagagatggaagggagtgtgttgaaatggagaatgggtggcaaaatttggttaacttattggccaaacaagttgaacacttcgttctatgagacaagatgtgtggagtggtgtgatgaggttgattttcctttgcttcacacgtcatagagacacaattagagtagttgaggcggaaaatataggtaaactaaatagaactcgagcacaagttgtgtatttgttttgtaaatattacttaaaccttaaagtagttgtaatggtatccgtatctctaatatttgtattcgtattattatttttatatatataatatatattcgtattaaatgtgtacatgtgcaaatgcaactatggttaccctatgggttcagaattaaataactaaaaggatttcagattagttatgaaaggtatttgtgactatatgtacaccattgtcatatatatatatatattttttaatt

SEQ ID NO: 766 - DNA, 2265 bp, Brassica napus
cccgtctaacaaacacacacattgtctcgagagaataaaacaagttcaagaaaatggatccttggtcgtggatatgcgagcttccggagtcccacgactttgccgagtctgacacacacgcagtgtttcagctcgcaggagacttgactcattcaatccaacttagggttgaaagagcttctagctctgacctagaatctctgtctctaactttcaaagtggtcgtagagggttttagccatcttaaatcatcgaccatatgggtctccgacacgtgtgccttgtcgtcggagaaaccattcctccctctagttctcctgctccttcaagaactaatctcctactctcctaccacaggcgaaagcacgtgcacaaagtctgagcctcttgaaatcaaatcgggtccggttagctgggtcatggactctcactctccggaatccttctcgtcagtctttaatctaatcctcctcacgcgtcttttctggctatgtgtgtttgacgcgcctagcgaagttggctctttcttcttccaacacttactaggtccccacgtgaaatcgctgacgtgtcaacatgcgcctgtgttgagaacgtttctcgtctcacttggtgtagacgccgagctgtgcatcgtacgcgctgcaagttacgccttgtccaaatggatgatctccaaggaagtgggacttgggaatctcggcttgaaacagatcacaagccccctgccacatcaatcattgggcttttcttatgcaacagaagcccatgggctttggagcttgaaaggctatttcccgatcttgtcgatgaacctcacaaataataacagctctagtgagattcataacaacaagatcatcaagttcccgttcgtagagcccaaagaagctgtcctacgctacgctttgtcacaccaacatgccgaagtaatcgtgcagtttgaatactctgtcacgttccacgagaactacataaaagtgaacgcacgcgtcgacaacatacgcgtccacgtatcgaagctagggtttcacaagggaagagggatggagaatcagatagcagattgttactcagacgagaagtacttcccgtcgcgggtacaggtctgggtggggccggaaatcgggtcgaaccacgtgtccggactaagcctaggccggtcgacgaagaacgaggagagagaggtcgaggtaatgagagtcctaaagggaaatttcgggaaagggaaagtggctccgagggtgaaggcaagagcaagaatctcaaccaggagaaagattaaggattggagaatcgatcaggaaagtgaaggaaacgctgccgttttcgatgcggtgttgtatgatagagagagcggccaagaagtggtgacggtgaagccgaaccaagagggtatgaagaatgtttttaccaagagcggagggatggtttttggaagggatgagtatggagatggtgctggatggagagttgggagagaaatggaaggaagtgtgttgaaatggagaatgggaggcaaaatttggctaacatattggccaaacaagttgtgcacttcattttatgagactagatgtgtggagtggtgtgatgaggtcgatttacctttggttcccacttcctaattagacgcaaacaacacttaaatgagaaagtccaagtagaaagataaatgaaactgggtgacaagttgttatgtgtttgtaagtattaattacaccttaagctagttgtgttggtctctcaaatgtttgtattcgtattaattgcggcatgtgcagacgcaaatatggttactacatatagctccggtaataattaatagctaaactaagagcatgagcattggtgaaccccactttggggttcaccaaatttttttaatattttttttgggtccatgaacagttatgaacccgaatttgttgttttctgcattagtgaacccgaagaaagagttcataggaataaaataataatattttttatttttttttaaatttaaaattattcagaatacatgaataaaatattaaaatatattataaaatttatgaaaacactttattcaacctatgttttagttttggagtttaagttttggttttgagatatgttttaatattttggtttttgttttcagatgtagaaaagctatgttagagttttggagtttatgttgtttcttaacttaaattcaattcatagaaacattttgttcgatgatcagtctacgcattcccgcgtatactctgcgttgat

SEQ ID NO: 767 - DNA, 2066 bp, Brassica rapa
tgaggatattgtagcgccacagatatattattcatccgtgtctgctcctctgaggggtctttgattagttttatatccttcatggcttctcctccaccacatactctctctatatagttcgtcacttccgatactcactaaagaaattttatctcccactttaccccgtctaacaaacacacacattgtctcgagaaaataaaacaagttcaagaaaatggatccttggtcgtggatatgcgagcttccggagtcccacgactttgccgagtctgacacacacgcagtgtttcagctcgcagaagacttgactcattcaatccaacttagggttgaaagagcttctagctctgacctagaatctctgtctctaactttcaaaatggtcgtagagggttttagccatcttaaatcatcgaccatatgggtctccgacacgtgtgccttgtcgtcggagaaaccattcctccctctagttctccagctccttcaagaactaatctcctactctcctaccacaggcgaaagcacgtgcacaaagtctgagcctcttgaaatcaaatcgggtccggttagctgggtcatggactctcactctccggaatccttctcgtcagtctttaatctaatcctcctcacgcgtcttttctggctatgtgtgttcgacgcgcctagcgaagttggctctttcttcttccaacacttactaggcccccacgtgaaatcgctgacgtgtcaacatgcgcctgtgttgagaacgtttctcgcctcactcggtgtagacgccgagctgtgcatcgtacgcgctgcaagttacgccttgtccaaatggatgatctccaaggaagtgggacttgggaatctcggcttgaaacagatcacaagccccctgccacatcaatcattgggcttttcctatgcaacagaagcccatgggctgtggagcttgaaaggctatttcccgatcttgtcgatgaacctcacaaataatatcagctctagtgagatgcataacaacaagatcatcaagttcccgttcgtagagcccaaagaagctgtcctacgctacgctttgtcacaccaacatgccgaagtaatcgtgcagtttgaatactctgtcacgttccacgagaactacataaaagtgaacgcacgcgtcgacaacatacgcgtccacgtatcgaagctagggtttcacaagggaagagggatggagaatcagatagcagaatgttactcagacgagaagtacttcccgtcgcgggtacaggtctgggtggggccggaagtcgggtccaaccacgtgtccggactaagcctaggacggtcgacgaagaacgaggagagagaagtcgaggtaatgagagtcctaaagggaaatttcgggaaagggaaagtggctccgagagtgaaggcaagagcaagaatctcaaccaggagaaagattaaggattggagaatcgagcaggagtgtgaaggaaacgctgctgttttcgatgcggtgttgtatgatagagagagcggccaagaagtgatgacggtgaagccgaaccaagagggtatgaagaatgtttttaccaagagcggagggatggtttttggaagggatgagtatggagatggtgctggatggagagttgggagagagatggaaggaagtgtgttgaaatggagaatgggtggtaaaatttggctaacatattggccaaacaagttgtgcacttcgttttatgagactagatgtgtggagtggtgtgatgaggtggatttgcctttggttcccacttcctaattagacgcgcgcaaacaacacttaaatgagaaagtccaagtagaaagataaaagaaactgggtgaatgtgtttgtaaatattaattacaccttaagctagttgtattagtatctcaaatcaaatgtttgtattcgtattaattgcggcatgtccagacgcaaatatggttactacatatagctccggtaataattaatagctaaactagggacttttattttattggttccataatcacctctactttgagtaatataataataatatgttgaa

SEQ ID NO: 768 - DNA, 1273 bp, Arabidopsis lyrata
taaaatactactactaaacttaattaaaaacaatgataatcattgagtatttcaagaggtgaacactatattacaaagtaaccaatgaaaataacaaagagtcgagtccaaaccaaaaccttagtccaaattggtttctacgacccagtggatataacaatttcataaaattcatagccaccggttaaacctggacccaataccgaactcacacacataactgaaactccagttcacctcctatagccggttcccttctctcacactctcagaaatttccaagcaatttctcaccgtttcattatctacaaatccactatatatacttcactctttcaactccatatattctctcacattccattactctttatctttataccctcaccatcctccactatttacagttttgccactctgactttatgttattagcttcttccggtgaccggcgacaacacgagagcgccaccgtatctccaagcttcatacgataaaaaatctataaaacatgaagaacggtaaccggaaaacaacgccggaaacagagaagtctcaccggagaaagttatcagagaaagcgatgtcgtttcacggcagaggaacaacgccggtatcgaatccaggagagcttcgaagaccgaaaacattaccggagttattctccaccggtcaaagcatcaccggaccggtgacggaatcgttcccgccgcgtctaacgaaacttttactcaacgtaacggtgcaaggaagtttaggagctgtacaaattataatctcgccggaatccaccgtgagtgatctaatcgacgccgcgattcgtcagtatgttaaagaagctcgccggccatttttaccggaatctgaaccgtcaagatttgatcttcattattctcagtttagtcttgaaagtattggaagagaggagaagctgatatcgcttgggtcgaggaactttttcttatgtggccggaaagagaccggaggctttatcggcggtggttcatcatcggaatcttgttcaaaggaagctgagaaagtggctaaaactggttttcattggctcaaatttatgggattctagaagtttttaatcattttggattattgcttttttcgaattagttccatttttaggaaaaggatatataaaacaaaaaaaaaatttggtaatctgtatatattttctatgtagaaatgaaaatcattaatttgtggtgtataatgtattttaatcaaattatattctaccaagatgattatagaaagttct

SEQ ID NO: 769 - DNA, 1130 bp, Brassica rapa
cctcacatccaactttaaccattttgccctcgtcctccttcgctatttacagttgtgccactccggttatgatagcttcctgtgaccggcgccaatacaagaacctcccgccactcctggcgtcgtcagattgaaaagccgctgatttgttgaacatgccggtaaactcgaagaccgctaaccggaaaggaaccaccggagaaacggagaaaaatcgtcgaggaaagctacaggagaaagcgatgtcgtttcacggcagaggaacggtgcctcattcgaacccaggagagcttcgaagaccgaagacgttgccggaattattctccagcggtcgaaccgtcgtcgaaccggtgtcttctaaaccgccgcgtctgacgaaactgcttctcaacgtgacggttcaagggagtttgggagctctgcagattataatttcgccggaatccaccgtggacgatttgatcgacgccgcgattcgtctttacgtgaaggaagctcgccgacctttcttaccggaatctgaaccggcccggtttgatctccattactcgcagttcagcctcgaaagtataggaagggaacagaagctgatctcgcttgggtctaggaacttcttcttgtgcggtcggaaagagaacggaggattggtcggaagtggaacgtcggaatcttgttcgaaggaagcagagaaagtggcggcgaaaactggttttcactggctcaaattcatgggtttctagaagtttttaccatttctaaatttaatttaaacttctatttttattttttttctcttattttaggaaataaatattgattttaggaaacttcgtgttgccttcctagaaagggccaaaagataggggattgtttgcattctattatgagtcaaacgttttaaatctgtgtatattagtaatctatatagaagaaataaagtcattaactaagtgggatataatgtatttttatcaaattatatgccaataattgtacctgattttttttttaatatctgtttgtttgtaagaaatgtggttcggactttcggtttatgtaataacgactgaagccaaccttatcccccaaagtcaagaaagtttggtgacaacgacaaaccaattaagttc

SEQ ID NO: 770 - DNA, 956 bp, Brassica rapa
acacatccaactttaaccattttgccctcgtcctccttcgctatttacagttgtgccactccggttatgatagcttcctgtgaccggcgccaatacaagaacctcccgccactcctggcgtcgtcagattgaaaagccgctgatttgttgaacatgccggtaaactcgaagaccgctaaccggaaaggaaccaccggagaaacggagaaaaatcgtcgaggaaagctacaggagaaagcgatgtcgtttcacggcagaggaacggtgcctcattcgaacccaggagagcttcgaagaccgaagacgttgccggaattattctccagcggtcgaaccgtcgtcgaaccggtgtcttctaaaccgccgcgtctgacgaaactgcttctcaacgtgacggttcaagggagtttgggagctctgcagattataatttcgccggaatccaccgtggacgatttgatcgacgccgcgattcgtctttacgtgaaggaagctcgccgacctttcttaccggaatctgaaccggcccggtttgatctccattactcgcagttcagcctcgaaagtataggaagggaacagaagctgatctcgcttgggtctaggaacttcttcttgtgcggtcggaaagagaacggaggattggtcggaagtggaacgtcggaatcttgttcgaaggaagcagagaaagtggcggcgaaaactggttttcactggctcaaattcatgggtttctagaagtttttaccatttctaaatttaatttaaacttctatttttattttttttctcttattttaggaaataaatattgattttaggaaacttcgtgttgccttcctagaaagggccaaaagataggggattgtttgcattctattatgagtcaaacgttttaaatctgtgtatattagtaatctatatagaagaaataaagtcattaactaagtgggata

SEQ ID NO: 771 - DNA, 1131 bp, Brassica napus
gcctcacatccaactttaaccattttgccctcgtcctccttcgctatttacagttgtgccactctggttatgatagcttcctgtgaccggcgccaatacaagaacctcccgccactcctggcgtcgtcagattgaaaagccgctgatttgttgaacatgccggtaaactcgaagaccgctaaccggaaaggaaccaccggagaaacggagaaaaatcgtcgaggaaagctacaggagaaagcgatgtcgtttcacggcagaggaacggtgcctcattcgaacccaggcgagcttcgaagaccgaagacgttgccggaattattctccagcggtcgaaccgtcgtcgaaccggtgtcttctaaaccgccgcgtctgacgaaactgcttctcaacgtgacggttcaagggagtttgggagctctgcagattataatttcgccggaatccaccgtggacgatttgatcgacgccgcgattcgtctttacgtgaaggaagctcgccgacctttcttaccggaatctgaaccggcccggtttgatctccattactcgcagttcagcctcgaaagtataggaagggaacagaagctgatctcgcttgggtctaggaacttcttcttgtgcggtcggaaagagaacggaggattggtcggaagtggaacgtcggaatcttgttcgaaggaagcagagaaagtggcggcgaaaactggttttcactggctcaaattcatgggtttctagaagtttttaccatttctaaatttaatttaaacttctatttttatttttttttctcttattttaggaaataaatattgattttaggaaacttcgtgttgccttcctagaaagggccaaaagataggggattgtttgcattctattatgagtcaaacgttttaaatctgtgtatattagtaatctatatagaagaaataaagtcattaactaagtgggatataatgtatttttatcaaattatatgccaataattgtacctgatttttttttaatatctgtttgtttgtaagaaatgtggttcggactttcggtttatgtaataacgactgaagccaaccttatcccccaaagtcaagaaagtttggtgacaacgacaaaccaattaagttc

SEQ ID NO: 772 - DNA, 1001 bp, Brassica napus
gcctcacatccaactttaaccattttgccctcgtcctccttcgctatttacagttgtgccactctggttatgatagcttcctgtgaccggcgccaatacaagaacctcccgccactcctggcgtcgtcagattgaaaagccgctgatttgttgaacatgccggtaaactcgaagaccgctaaccggaaaggaaccaccggagaaacggagaaaaatcgtcgaggaaagctacaggagaaagcgatgtcgtttcacggcagaggaacggtgcctcattcgaacccaggcgagcttcgaagaccgaagacgttgccggaattattctccagcggtcgaaccgtcgtcgaaccggtgtcttctaaaccgccgcgtctgacgaaactgcttctcaacgtgacggttcaagggagtttgggagctctgcagattataatttcgccggaatccaccgtggacgatttgatcgacgccgcgattcgtctttacgtgaaggaagctcgccgacctttcttaccggaatctgaaccggcccggtttgatctccattactcgcagttcagcctcgaaagtataggaagggaacagaagctgatctcgcttgggtctaggaacttcttcttgtgcggtcggaaagagaacggaggattggtcggaagtggaacgtcggaatcttgttcgaaggaagcagagaaagtggcggcgaaaactggttttcactggctcaaattcatgggtttctagaagtttttaccatttctaaatttaatttaaacttctatttttatttttttttctcttattttaggaaataaatattgattttaggaaacttcgtgttgccttcctagaaagggccaaaagataggggattgtttgcattctattatgagtcaaacgttttaaatctgtgtatattagtaatctatatagaagaaataaagtcattaactaagtgggatataatgtatttttatcaaattatatgccaataattgtacctg

SEQ ID NO: 773 - DNA, 861 bp, Brassica napus
atggacgcctgtggtccggtccggatttccgggtcgagacagcgtccgccttctcgccctcgtcctccttcactatttacagttgtgccactctggttatgttagcttcctgtgaccggcgccaatacaagaacctccctccactcctggcttcatcagattccggcgagaaagatttgaaaagccgctgatttttcaagcatgccggtaaactcgaagaacgctaaccggaaaggaaccaccggagaaaccgagaagaatcgtcgaggaaagttacaggagaaagcgatgtcatttcacggcagaggaacggtgcctcattcgaatccaggagagcttcgacgaccgaagacgttaccggaactattctccagcggtcgaaccgtcgttgaaccggtgtcttctaaaccgccgcgtctgacgaaactgcttctcaacgtgactgttcaagggagtttgggagctctgcagattataatttcgccggaatccaccgtggacgatttgatcgacgccgcgattcgtctttatgtgaaggaagctcgccgaccgttcttaccggaatctgaaccgtcccggtttgatctccattactcgcagtttagcctcgaaagtataggaagagaacagaagctgatctcgcttgggtctaggaacttcttcttgtgcggtcggaaagagaacggaggattggtcggaagtggatcgtcggaatcttgttcgaaggaagcagagaaagtggcggcgaaaactggttttcactggctcaaattcatgggtttctagaagtttttaccatttctaaatttattactttaaactttttttttttcttatttagtaaataattattagtattta

SEQ ID NO: 774 - DNA, 974 bp, Raphanus sativus
  misc_feature (925)..(926): n is a, c, g, or t
tgggacatccaactttatcctctctgccctcatcttccttcgctatttacagttgtgccactctggttatgctagcttccttggacccggcgagaaagatttgaaaagccgctgcgttaagcatgccggtaaactcgaagaacgctaaccggaaaggagaaaccgagaagagtcgccgaggaaagctacaggagaaagcgatgtcgtttcacggcagaggaacgatgcctcatccgaatccaggagagcttcgaagaccgaagactctaccggagttattctccagcggtcgaaccgccgtcgtcgaaccggtttcttctaaaccgccgcgtctgacgaaactgctcctcaacgtgacggttcaagggagttcaggagctctgcagattataatctcgccggaatcaaccgtggacgatttgatcgacgccgcgattcgtctttacgtgaaggaagctcgccgacctttcttgccggagtctgaaccgtcccggtttgatctccattactcgcaattcagcctcgaaagtattggaagagaacagaagctgatctcgcttgggtcaaggaactttttcttgtgtggtcggaaagagaacggaggattggtcgggagtggatcgtcggaatcttgttcaaaggaagcagagaaagcggggaaaactggttttcactggctcaaattcatgggtttctagaagtttttttaccatttttaaatttaattcaaacttctatttttattttttttattttttaggaaataaatatggatttaaggaaacttcgtgttaccttcctaggaaggacaaaaagatagggattgtttgctctattatatgagtcaaacgtttaaaatctgtgtatatatctagtattctagataagaagaaacaaagagaaaaaaaacaaagtcattaactannggggtataatgtatttttaatcaaattatatgccaataattgtaacca

SEQ ID NO: 775 - DNA, 891 bp, Brassica napus
aagaacctcccgccactcctggcgtcgtcagattgaaaagccgctgatttttcaaacatgccggtaaactcgaagaccgctaaccggaaaggaaccaccggagaaacggagaaaaatcgtcgaggaaagctacaggagaaagcgatgtcgtttcacggcagaggaacggtgccttattcgaacccaggagagcttcgaagaccgaagacgttgccggaattattctccagcggtcgaaccgtcgtcgaaccggtgtcttctaaaccgccgcgtctgacgaaactgcttctcaacgtgacggttcaagggagtttgggagctctgcagattataatttcgccggaatccaccgtggacgatttgatcgacgccgcgattcgtctttacgtgaaggaagctcgccgacctttcttaccggaatctgaaccggcccggtttgatctccattactcgcagttcagcctcgaatgtataggaagagaacagaagctgatctcgcttgggtctaggaacttcttcttgtgcggtcggaaagagaacggaggattggtcggaagtggaacgtcggaatcttgttcgaaggaagcagagaaagtggcggcgaaaactggttttcactggctcaaattcatgggtttctagaagtttttaccatttctaaatttaatttaaacttctatttttatttttttctcttattttaggaaataaatattgattttaggaaacttcgtgttgcctccctagaaagggccacaagataggggattgtttgcattctagtatgagtcaaacgtttaaaatctgtgtatatatagtatcctatatagaagaaataaagtcattattaactaagtgggatataatgtatttttaatcaaattatatgcc

SEQ ID NO: 776 - DNA, 777 bp, Brassica juncea
gacatccaactttaccctttctaccctcgtcttccttcactatttacagttgcgccactttgttatgttggcttcgggtgaccggcgccaatacaagaacttccgcgactcctggcttcgttcgaactgctgtatataaacaatccatctcgcatctgttaaacatgccgataaactcgaagagcgctaaccggaaaggagccaccggagaaaccgagaagagtcgccgaggaaagttacaggagaaagcgatgtcgtttcacggcagagggacgatgcctcattcgaatccaggagagctccgacgaccgaagacgttaccggagttattctccagcggtcgaactgtcgtcgaaccggtgtctactaaaccgccgcgtctgacgaaactgcttctcaacgtcacggttcaagggagtttaggagctctgcagattataatttcgccggaatccaccgtggacgatttgatcgacgccgcgattcgcctttacgtgaaggaagctcgccgacctttcttaccggcatctgaaccggcccggtttgatctccattactcgcaattcagcctcgaaagtataggaagagaacagaagctgatctcgcttgggtcaaggaacttcttcttgtgtggtcggaaagagaacggaggattggtcggaagtggaacgtcggaatcttgttcgaaggaagcagagaaagtggccaaaactggttttcactggctcaaattcatgggtttctagaagtttttaccatttctaaatttaattcaaa

SEQ ID NO: 777 - DNA, 983 bp, Brassica oleracea
gggagcgtccgcgtcctccttcactatttacagttgtgccactctggttatgttagcttcctgtgaccggcgccaatacaagaacctccctccactcctggcttcatcagattccggcgagaaagatttgaaaagccgctgatttttcaagcatgccggtaaactcgaagaacgctaaccggaaaggaaccaccggagaaaccgagaagaatcgtcgaggaaagttacaggagaaagcgatgtcatttcacggcagaggaacggtgcctcattcgaatccaggagagcttcgacgaccgaagacgttaccggaactattctccagcggtcgaaccgtcgttgaaccggtgtcttctaaaccgccgcgtctgacgaaactgcttctcaacgtgactgttcaagggagtttgggagctctgcagattataatttcgccggaatccaccgtggacgatttgatcgacgccgcgattcgtctttatgtgaaggaagctcgccgaccgttcttaccggaatctgaaccgtcccggtttgatctccattactcgcagtttagcctcgaaagtataggaagagaacagaagctgatctcgcttgggtctaggaacttcttcttgtgcggtcggaaagagaacggaggattggtcggaagtggatcgtcggaatcttgttcgaaggaagcagagaaagtggcggcgaaaactggttttcactggctcaaattcatgggtttgtagaagtttttaccatttctaaatttaattcaaacttttttttttctttcttattttaggaaataaatattgattttaggaaacttcgtgttgcctccctagaaagggccacaagataggggattgtttgcattctagtatgagtcaaacgtttaaaatctgtgtatatatagtatcctatatagaagaaataaagtcattattaactaagtgggatataatgtatttttaatcaaattatatgccaat

SEQ ID NO: 778 - DNA, 951 bp, Brassica napus
acatccaactttaaccttctcgccctcgtcctccttcactatttacagttgtgccactctggttatgttagcttcctgtgaccggcgccaatacaagaacctccctccactcctggcttcatcagattccggcgagaaagatttgaaaagccgctgatttttcaagcatgccggtaaactcgaagaacgctaaccggaaaggaaccaccggagaaaccgagaagaatcgtcgaggaaagttacaggagaaagcgatgtcatttcacggcagaggaacggtgcctcattcgaatccaggagagcttcgacgaccgaagacgttaccggaactattctccagcggtcgaaccgtcgttgaaccggtgtcttctaaaccgccgcgtctgacgaaactgcttctcaacgtgactgttcaagggagtttgggagctctgcagattataatttcgccggaatccaccgtggacgatttgatcgacgccgcgattcgtctttatgtgaaggaagctcgccgaccgttcttaccggaatctgaaccgtcccggtttgatctccattactcgcagtttagcctcgaaagtataggaagagaacagaagctgatctcgcttgggtctaggaacttcttcttgtgcggtcggaaagagaacggaggattggtcggaagtggatcgtcggaatcttgttcgaaggaagcagagaaagtggcggcgaaaactggttttcactggctcaaattcatgggtttgtagaagtttttaccatttctaaatttaattcaaacttttttttttctttcttattttaggaaataaatattgattttaggaaacttcgtgttgcctccctagaaagggccacaagataggggattgtttgcattctagtatgagtcaaacgtttaaaatctgtgtatatatagtatcctatatagaagaaataaagtcatta

SEQ ID NO: 779 - DNA, 1716 bp, Arabidopsis lyrata
acttgttccttacaaataataaacaatagctttaatttgaagaagaacaacaatggagatcaccactctcatattccttatcatctcctctgtcacattcgtcatcttccttaaactcatcttcttctcctcaactcacaaactaccaccgggaccacctcgttttccggtcatcggaaacatcatctggcttaagaaaaacaacttctccgatttccaaggcgttctccgtgacttagcctcccgtcacggaccaatcataaccctccacgtaggctcaaaaccttccatctgggtcacagacagatcactcgctcaccaagcccttgtccaaaacggtgccgttttctccgaccgtcctatcgctctccccacaactaaagttatcaccagcaaccaacacgacatccactcctccgtctacggctctctctggagaaccctccgccgcaacctcacctccgaaatcctccaaccggcgcgcgtgaaagctcacgcgccgtcgaggaaatggtctctcgagatcctcgtcgatctgttcgaaacagagcagagagagaaaggacatgtctccgacgctttagatcatctccgtcacgcgatgttttatttattggctctgatgtgtttcggagagaaactgaaaagagaagagatcagagagatcgaagaagctcagtaccaaatgctcataagctacaccaagttcagcgtcctcaacatcttcccaagcgtaaccaagttctcgctccggcgaaaatggaaagagttcttagaactaaggaaatctcaagagaacgttatactccgatacgtaaacgcaaggagcaaagaaaccaccggagatgttctctgttacgtcgatacgctactgaatctagagattccaacggaggaggataaagaaggagggaagaagaggaaactgagtgaatcggagatcgtgagtctgtgttcggagtttcttaacgcagctacggatccaacggcgacggcgatgcagtggatcatggcgatcatggtgaagtatccagagattcagaggaaggtatacgatgaaatgaagagtgtgttgttcgccggagaagaagaggaaagagaagagatcagagaagaggatttggggaagttgagttacctcaaagctgtgatcttggagtgtttaagaagacaccctcctggtcattacttgtcttaccataaggtcacacacgacaccgttttgggtggattcctcgttcctcgccaaggtactataaacttcatggtaggagagatgggccgggatccaaaaatatgggaagatcctctaacgttcaagccagaaagatttctagagaacggagaagcctatgatttcgatatgacgggaactcgcgatatcaagatgatgccgtttggagcgggacgacgtatgtgtcccggttacgccctttcgttgcttcacctcgaatattatgtggccaatttggtttggaaattcgagtggaaatgtgtggaaggtgaagaagttgatctatccgagaagcaacaattcatcacaatggtcatgaaaaaccctttcaaggcaaatatttatccaaggagaagaaagtgataattgcttattgttatatcatcaaaaaagcccaatgggcttatttgtcgtatgtatattaaaaactttgtctcatatgtgttaaaactagctgggcctttaatgggtttctatataaa

SEQ ID NO: 780 - DNA, 1676 bp, Brassica napus
tgaacgcaagcaacaatggagatcatcacaatcatcttcctcaccatcatctctctcatcttcatcaaactcatcttcttctcccctccccacaaactcccaccaggcccacctcgtttcccggtgatcggaaacatcatctggctcaagaaaaacagcttctcagacttccaaggcgtcctccgcgacttatcctcccgtcacggaccaatcataaccctccacgtaggctcaaaaccttccatatgggtcaccgacaggtccctcgcccacgaagccctcgtccaaaacggcgccgttttctccgaccgtcccctcgctctcccgaccaccagagtcatcacgagcaaccagcacgacatacactcctccgtctacggctctctctggagaaccctccgccggaacctcacgtcagaaatcctccagccggcccgcgttaaggcccatgggccgtcgaggaaatgggctttggagattctcgtcgatctcttcgaaacggagcagagagagaaaggcttcgtctcggaggccttggatcatctccgacacgcgatgttctgtctgctggctctgatgtgtttcggggagaaacttaaaagagaagagatcagagagatcgaagaggctcagtaccagatgctcataagctacaccaagttcagcgtcctcaacatcttcccgagcgtcaccaagttcttgctccggcgaaagtggaaagagtatctagaactccggaagtctcaggagagcgtcttgctcaaattcgtgaacgctagggggagagaaacctccggagatgttctctgctacgtcgacacgctgctgaatctcgagatcccgacggaggaagacgaagggaagaagaggaagctgagcgactcggagatagtgagcctctgctcggagtttctaaacgcggcgacggatcctaccgcgacggccatgcagtggatcttggcgatcatggtgaagtatccggagatacagaggaaggtgtacgaggagatgaagagtgttttggaagaaggagaagagatcagagaagaggatttggggaagctgagttatctcaaagctgtgatcttggagagtttgagaagacaccctcctggtcattacttgtcttaccataaggtcactaacgacaccgttttgggtggtttcctcgttccgcgccaaggtactataaacttcatggtaggagaaatgggccgtgacccgaagatatgggaggatcctttaacgttcaagccagaacgttttctagagaacggggaagcgcatgggttcgatatgaccggaactcgtgagatcaagatgatgccgtttggagccggacgaaggatgtgtccgggttacggtctttcgctacttcaccttgaatactatgtggccaatttggtttggaagtttgagtggaaatgcgtagaaggtgaagaggttgatctctctgagaagcaacagttcatcacaatggtcatgaaaactcctttcaaggcaaatatgtatccaaggagaaagtgatgttgctttgacttgatggcaatatgtatgtaaaatatatatatgtttttattatagtcaaacattttattttgaaatatctaaggatactaaaaactacattatcgcacttagcacaattaatttgaatacagtattaacaagacttc

SEQ ID NO: 781 - DNA, 1675 bp, Brassica napus
tatcgatagcttgatattcgaattcgatcggccattacgggcggggactttgaacgcaagcaacaatggagatcatcacaatcatcttcctcaccatcatctctctcatcttcatcaaactcatcttcttctcccctccccacaaactcccaccaggcccacctcgtttcccggtgatcggaaacatcatctggctcaagaaaaacagcttctcagacttccaaggcgtcctccgcgacttatcctcccgtcacggaccaatcataaccctccacgtaggctcaaaaccttccatatgggtcaccgacaggtccctcgcccacgaagccctcgtccaaaacggcgccgttttctccgaccgtcccctcgctctcccgaccaccagagtcatcacgagcaaccagcacgacatacactcctccgtctacggctctctctggagaaccctccgccggaacctcacgtcagaaatcctccagccggcccgcgttaaggcccatgggccgtcgaggaaatgggctttggagattctcgtcgatctcttcgaaacggagcagagagagaaaggcttcgtctcggaggccttggatcatctccgacacgcgatgttctgtctgctggctctgatgtgtttcggggagaaacttaaaagagaagagatcagagagatcgaagaggctcagtaccagatgctcataagctacaccaagttcagcgtcctcaacatcttcccgagcgtcaccaagttcttgctccggcgaaagtggaaagagtatctagaactccggaagtctcaggagagcgtcttgctcaaattcgtgaacgctagggggagagaaacctccggagatgttctctgctacgtcgacacgctgctgaatctcgagattccgacggaggaagacgaagggaagaagaggaagctgagcgactcggagatagtgagcctctgctcggagtttctaaacgcggcgacggatcctaccgcgacggccatgcagtggatcttggcgatcatggtgaagtatccggagatacagaggaaggtgtacgaggagatgaagagtgttttggaagaaggagaagagatcagagaagaggatttggggaagctgagttatctcaaagctgtgatcttggagagtttgagaagacaccctcctggtcattacttgtcttaccataaggtcactaacgacaccgttttgggtggtttcctcgttccgcgccaaggtactataaacttcatggtaggagaaatgggccgtgacccgaagatatgggaggatcctttaacgttcaagccagaacgttttctagagaacggggaagcgcatgggttcgatatgaccggaactcgtgagatcaagatgatgccgtttggagccggacgaaggatgtgtccgggttacggtctttcgctacttcaccttgaatactatgtggccaatttggtttggaagtttgagtggaaatgcgtagaaggtgaagaggttgatctctctgagaagcaacagttcatcacaatggtcatgaaaactcctttcaaggcaaatatgtatccaaggagaaagtgatgttgctttgacttgatggcaatatgtatgtaaaatatatatatgtttttattatagtcaaacattttattttgaaatatctaaggatactaaaaact

SEQ ID NO: 782 - DNA, 1753 bp, Brassica rapa
taaaagtagtaactccctttcccttcttttatctcccactttgaacgcaagcaacaatggagatcatcacaatcatcttcctcaccatcatctctctcatcttcatcaaactcatcttcttctcccctccccacaaactcccaccaggcccacctcgtttcccggtgatcggaaacatcatctggctcaagaaaaacagcttctcagacttccaaggcgtcctccgcgacttagcctcccgtcacggaccaatcataaccctccacgtaggctcaaaaccttccatatgggtcaccgacaggtccctcgcccacgaagccctcgtccaaaacggcgccgttttctccgaccgtcccctcgctctccccaccacgagagtcatcacgagcaaccagcacgacatacactcctccgtctacggctctctctggagaaccctccgccggaacctcaccgccgaaatcctccagccggcccgcgttaaggcccatgggccgtcaaggaaatgggctttagagattctcgtcgatctctttgaaacggagcagagagagaaaggcttcgtctcggaggcgttggatcatctccgacacgcgatgttctgtctgctggctctgatgtgtttcggcgagaaacttagaagagaagagataaaagagatcgaagaggctcagtaccagatgctcataagctacaccaagttcagcgtcctcaacatcttcccgaccgtcaccaagttcttgctccggcgaaagtggaaagagtatctagaactccggaagtctcaggagagcgtcttgctcaaattcgtgaacgctagggggagagaaacctccggagatgttctctgctacgtcgacacgctgctgagtctcgagatcccgacggaggaagacgaagggaagaagaggaagctgagtgactcggagatagtgagtctatgctcggagtttcttaacgcggctacggatcctaccgcgacggccatgcagtggatcttggcgatcatggtgaagtatccggagatacagaggaaggtgtacgaggagatgaagagtgttttggaagaaggagaagagatcagagaagaggatttggggaagctgagttatctcaaagctgtgatcttggagagtttgagaagacaccctcctggtcattacttgtcctaccataaggttactaacgacaccgttttgggtggtttcctcgttccgcgccaaggtactataaacttcatggtaggagaaatgggccgtgacccgaagatatgggaggatcctttaacgttcaagccagaacgttttctagagaacggggaagcgcacgggttcgatatgaccggaactcgtgagatcaagatgatgccgtttggagccggacgaaggatgtgtcctggttacggcctttcgctgctacaccttgaatactatgtggccaatttggtttggaagtttgagtggaaatgcgtagaaggtgaagaggttgatttgtctgagaagcaacagttcattacaatggtcatgaaaacccctttcaaggcaaatatgtatccaaggagaaagtgatgttgctttgacttgttggcaatatgtatgtaaaatatatatgttattattatagtcaaacattttattttgaaatatctaaggatactaaaaactacattatcacacttagcactattcatgtgaaaaacaagacttcactgacttatcatgttttcttgggtgaaattgaaaacgtaaaatta

SEQ ID NO: 783 - DNA, 1672 bp, Eutrema halophilum
aggagcaattagcaacaatggagatcatcacagtcttcttcctcatcatcatctccctctccttgtccattttccttaaactcatcttcttttccccaacccacaaactcccgccgggtccaccgcgttttccggtcatcggaaacatcatctggctcaagaagaacagcttctccgatttccaaggcgttcttcgtgacttagcttcccgtcacggaccaatcataaccctccacgtaggctccaaaccttcgatctgggtcaccgacagatcactcgctcacgaggcccttgtccagaacggcgccgttttcgccgaccgtcctctcgctctccccaccaccagagtaatcacaagcaaccaacacgacatccactcctccgtctacggccctctctggagaacccttcgccggaatctcacctccgaaatcctccaaccggcgcgtgtgaaagcccacgcgccgtcgagaaaatgggctctcgagattctcgtcgatctactcgagtcggagcagagagggaaagggcatgtctcggatgccttgggtcatctccgtcacgcgatgttctgtttgttggctctgatgtgtttcggcgagaaactgaagagagaagaaatcagagaaatcgaagaagctcagtaccaaatgctcataagctacaccaaattcagcgtcctcaacatcttcccaagcgtgaccaagttcttactccgacgaaaatggaaagaatttttcgatctgcggaaatctcaggagaacgttatactccgattcgtgaacgccagaagcagagaaaaagccggagatgttctctgttacgtcgatacgctgctgggtctagagattccgacggaggaggaagaggggaagaagaggaaactgagtgaatcggagatcgtgagtctgtgctcggagtttctaaacgcagcgacggatccgacggcgacggcgatgcagtggatcatggcgatcatggtgaaatacccagagatacagaggaaggtatacgaggagatgaagagtgttttagccggagaagaagagataagagaagaggatttggggaagctgagttatctcaaagctgtgatcttggagtctctaagaagacaccctcctggtcactacttatcttaccataaagtcacaaaggatacagttttaggtgaattcctcgttcctcgccaaggtacaataaatttcatggtaggagaaatgggccgagacccgaaaatatgggaggatcctttgaccttcaagccggaaagatttctagagaacggggaagcacatggctttgatatgaccggaactcgtgagatcaagatgatgccgtttggagcgggacgaaggatgtgtcctggttacagcctttcgctgcttcacctcgaatatttcgtggccaatttggtctggaaattcgagtggaaatgtgtggaaggtgaagaggttgatctatccgagaagcaacagttcatcacaatggtcatgaaaacccctttcaaggctaatatgtatccaaggagaaagtgatttgccttttgcttcattacattttcaatagcccattgggcttgttagtcatctgtatatatcatcaactacttgtctcatgtgtgctaaaaccaatttgggccgtaaatgggcttcaataatatatattatca

SEQ ID NO: 784 - DNA, 1672 bp, Eutrema parvulum
ccttaatttgaaagcaagagaggaggcatgcaagcaacaatggagatcattacattcttcttcatctctctctcctttgcgatcttccttaaactcatcttcttctccccttcccacaaactcccccctggcccacctcgttttccggtcatcggtaacatcatctggcttaagaaaaacagcttctccgatttccaaggcgttctccgtgacttagcctcccgtcacggaccaatcgtagctctccacgtaggctctaaaccatctatctgggtcaccgacagatcactcgctcacgaagcccttgtccagaatggagccgttttctccgaccgtcctctcgccctccccacgaccagagtcatcacgagcaaccaacacgatatacactcctccgtctacggctccctctggagaaccctccgccggaatctcacctccgaaatcctccagccggcgcgcgtgaaagcccacgcgccgtcgaggaaatgggctcttgagatcctcgtcgatctattcgagtcggagcagagagagaaagggcatgtctccgatgcattggatcatctccgacacgcgatgttctgtctgttggctctcatgtgtttcggcgagaaactgaaaagagaagaaatcagagaaatcgaagaagctcagtatcaaatgttcataagctacaccaaattcagcgttctcaacatcttcccaagcgtgacaaagttcttgctccggcgtaaatggagagaatttttagatctgcggaagtctcaggagaacgtcatactccgattcgtgaacgcgaggggcagagaaaccgccggagatgttctctgttacgtcgatacgctgctgggtctagagattccgacggaggaggaagaaggaaagaagaggaaactgagtgaatcggagatcgtgagtctgtgctcggagtttctaaacgcagcgacggatccaacggcgacggcgatgcagtggatcatggcgatcatggtgaaatacccagagatacagaggaaggtgtacgaggaaatgaagagtattttagccggagaagaagaaagagaagagatcagagaagaggatttggggaagctgagttatctcaaagctgtgatcttggagagtttaagaagacaccctcctggtcattacttgtcttaccataaggtcaccaacgacaccgttttgggtggattcctcgttccgcgccaaggtactataaacttcatggtcggagaaatgggccgtgacccgaaaatatgggaggatcctttaacgttcaagcctgaacgatttctagagaacggggaagcacaagggcttgatatgacaggaactcgtgagatcaagatgatgccgtttggtgcgggacgaaggatgtgtcccggttacagcctttccctacttcaccttgaatattatgttgccaatttggtttggagattcgagtggaactgtgtggaaggtgaagaggttgatctatctgagaagcaacagttcataacaatggtcatgaaaaatcctttcaaggcaaatatgtatccaaggagaaagtgattttgctttgttatatcatcaaaaagcccattaggcttgttaatcatctgtaactacttatctcatgtgtgttaaaaaaacatattgggcctttaatgggcttcggtacata

SEQ ID NO: 785 - DNA, 1646 bp, Brassica rapa
ctaagtgtgataatgtagtttttagtatccttagatatttcaaaataaaatgtttgactataataataacatatatattttacatacatattgccaacaagtcaaagcaacatcactttctccttggatacatatttgccttgaaaggggttttcatgaccattgtaatgaactgttgcttctcagacaaatcaacctcttcaccttctacgcatttccactcaaacttccaaaccaaattggccacatagtattcaaggtgtagcagcgaaaggccgtaaccaggacacatccttcgtccggctccaaacggcatcatcttgatctcacgagttccggtcatatcgaacccgtgcgcttccccgttctctagaaaacgttctggcttgaacgttaaaggatcctcccatatcttcgggtcacggcccatttctcctaccatgaagtttatactaccttggcgcggaacgaggaaaccacccaaaacggtgtcgttagtaaccttatggtaggacaagtaatgaccaggagggtgtcttctcaaactctccaagatcacagctttgagataactcagcttccccaaatcctcttctctgatctcttctccttcttccaaaacactcttcatctcctcgtacaccttcctctgtatctccggatacttcaccatgatcgccaagatccactgcatggccgtcgcggtaggatccgtagccgcgttaagaaactccgagcatagactcactatctccgagtcactcagcttcctcttcttcccttcgtcttcctccgtcgggatctcgagactcagcagcgtgtcgacgtagcagagaacatctccggaggtttctctccccctagcgttcacgaatttgagcaagacgctctcctgagacttccggagttctagatactctttccactttcgccggagcaagaacttggtgacggtcgggaagatgttgaggacgctgaacttggtgtagcttatgagcatctggtactgagcctcttcgatctcttttatctcttctcttctaagtttctcgccgaaacacatcagagccagcagacagaacatcgcgtgtcggagatgatccaacgcctccgagacgaagcctttctctctctgctccgtttcaaagagatcgacgagaatctctaaagcccatttccttgacggcccatgggccttaacgcgggccggctggaggatttcggcggtgaggttccggcggagggttctccagagagagccgtagacggaggagtgtatgtcgtgctggttgctcgtgatgactctcgtggtggggagagcgaggggacggtcggagaaaacggcgccgttttggacgagggcttcgtgggcgagggacctgtcggtgacccatatggaaggttttgagcctacgtggagggttatgattggtccgtgacgggaggctaagtcgcggaggacgccttggaagtctgagaagctgtttttcttgagccagatgatgtttccgatcaccgggaaacgaggtgggcctggtgggagtttgtggggaggggagaagaagatgagtttgatgaagatgagagagatgatggtgaggaagatgattgtgatgatctccattgttgcttgcgttcaaagtggg

SEQ ID NO: 786 - DNA, 1619 bp, Brassica napus
agtaactccctttcccttctttaatctccactttgaacgcaagcaacaatggagatcatcacaatcatcttcctcaccatcatctctctcatcttcatcaaactcatcttcttctcccctccccacaaactcccaccaggcccacctcgtttcccggtgatcggaaacatcatctggctcaagaaaacaacttctcagacttccaaggcgtcctccgcgacttagcctcccgtcacggaccaatcataacactccacgtaggctcaaagccttcaatatgggtcaccgacaggtccctctcccacgaagccctcgtccaaaacggcgccgttttctccgaccgtcccctcgctctccccacgaccagagtcatcacaagcaaccagcacgacatacactcctcagtctacggctctctctggagaaccctccgccggaacctcacctccgaaatcctccagccggcccgcgtcaaggcccatgggccgtcgaggaaatgggctttggagattctcgtcgatctcttcgaaacggagcagagagagaaaggcttcgtctcggaggcgttggatcatctccgacacgcgatgttctgtctgctggcgctgatgtgtttcggggagaaacttaaaagagaagagataaaagagatcgaagaggctcagtaccagatgctcataagctacaccaagttcagcgtcctcaacatcttcccgaccgtcaccaagttcttgctccggcgaaagtggaaagagtatcttgaactccggaagtctcaggagagcgtcttgctcaaattcgtgaacgctagggggagagaagcctccggagatgttctctgctacgtcgacacgctgctgagtctcgagatcccgacggaggaagacgaagggaagaagaggaagctgagcgactcggagatagtgagcctctgctcggagtttcttaacgcggcgacggatcctaccgcgacggccatgcagtggatcttggcgatcgtggtgaagtatccggagatacagaggaaggtgtacgaggagatgaagagtgttttggaagaaggagaagagatcagagaagaggatttggggaagctgagttatctcaaagctgtgatcttggagagtttgagaagacaccctcctggtcattacttgtcctaccataaggttactaacgacaccgttttgagtggtttcctcgttccgcgccaaggtactataaacttcatggtaggagaaatgggccgtgacccgaagatatgggaggatcctttaacgttcaagccagaacgttttctagagaacggggaagcgcacgggttcgatatgaccggaactcgtgagatcaagatgatgccgtttggagccggacgaaggatgtgtcctggttacggcctttcgctgctacaccttgaatactatgtggccaatttggtttggaagtttgagtggaaatgcgtagaaggtgaagaggttgatttgtctgagaagcaacagttcattacaatggtcatgaaaacccctttcaaggcaaatatgtatccaaggagaaagtgatgttgctttaacttgttggcaatatgtatgtaaaatatatatgtttttattatagtcaaa

SEQ ID NO: 787 - DNA, 1231 bp, Eutrema parvulum
atactattaaacgcatgttgcgtgcacgcgccgaatcgtttcgtgtggccaccatttctcggactcaaccgcctccaccacacgcttcttcttcttctcctctttgttttttccggcgagatttagatattttgttttcatggagggcacttgcacctcgattaggcctcgcctcattgggtcttgctcgattgttgagctctccaggttgattaatcgagccggagttcctttctccgttcggatctctacgagaagaaggttcagaacccgaggccaaggaggtggattcacggcaccggcctcctcacgggaggaaggtccttcttgcatcttcgttggtccgattgattccgctagaaaagaaactcttgaagctctttatcgccaagcgagggatgcttactacaatggcaagcctttgatagttgatgacatgtttgacagagttgagctaaagcttcggtggtatggttcgaaatcggtagtcaagtaccctcggtgcagcctcctgcgacagtcaacttatgctgatgcagaggatgatgcatctcaagttctcctgttagctaccatatggatcttgattctcgtgtttggtagctcagcatgcgtattgcccacgatatacggcctcggcttagtctatggaggagatccgttcgactcggggcttgtctatggcagccaattgtcgtcttctgtgcctcttctatcaaagttgaacggcatcctcctcaccgtgctaggacctgcttttggatacccgattgcatcttctgcagttggagtacttaaagggttatggagaaatgacttaacggctctaaaaggaaactgcccaaattgtggggaagaggttttcgcgtttgtgagatccgatcaatcaaaccgatctgctcacaaagccgactgtcatgtctgtgaatgcaccttggagttccgaaccaaaatagaacttcaaaaatctgcgtcacgattgggtagaaaatgggtttacggcaggatatatcttgtttcacggccaaggagagatcggtgttccaagtatacataattctgacaaaaaagaaagaattttttggggatggtttctactctattgtatatttattgaaaaaaaaaggatactagaaactagaaagcttttgtaacattcaaaagattcataaaaattgtaactataaacgttttgtctttcgtagcctttttcttcagacagtttacaaaa

SEQ ID NO: 788 - DNA, 1124 bp, Arabidopsis lyrata
atgaacagagccgaaatattgtccaaattcatttcttacagtaacaaacagagaaaaatatggatagaagcttgaagaagatgaagaacaattacaacaactcgataaagagcaatcttatgaaagatgatgaaatgtttcatgtgattcacaaagttccttgtggagatactccttatgtcagagccaaacatgctcagttgatagagaagaacccggagatggcaatcgtgtggttttggaaagccatcaacactggagacagagtagacagtgctcttaaggacatggctgttgtaatgaaacaacttgaccgttccgaagaagccatcgaagctatcaaatccttccgtcctcgttgttccaagaattctcaagattcccttgacaatgtcctcatcgacttatacaagaaatgcggtagaatggaggagcaagttgagttgttgaagaggaagctaaggcagatctatcaaggggaggctttcaacggtaaacccaccaagaccgctcgctctcacggcaaaaaatttcaagtgaccgttcaacaagaaatctcaagattactgggtaacttggggtgggcatatatgcaacaagccaagtacttgtcggcagaggcggtatacagaaaagcccagatggttgagccagatgcaaacaaatcgtgcaaccttgcgatgtgccttatcaaacaaggcaggtttgaggagggaagattggttcttgatgatgttctcgagtcaagggttttgggtgcggatgattgtagaacaaggcaacgggccgaagagcttctgagtgaattagagtcttcactgccacggatgggagatgctgagatggaggatgtcttggggaatatcttagacgatgattttgttcttgggcttgaacagatgacatccactagttttaaatcgaagagactcccaatcttcgaacagatctcgtcttttagaaatacattagtttgctagtttattcattttgtgtttttttttttcttatgtatcatatatctttgctgctttagttttgatgagttggtaaatatgtgttatgtttctctatagtgactttgtatatatacaacaataataatgggaataaagtcatttaag

SEQ ID NO: 789 - DNA, 1175 bp, Brassica rapa
gcgtgtataaattaagacactctgtataggctttaattattcagagagagaaagagatggagagaagcttgaagaagatgaagagtaacaataccaactcaacaagaagcaatctgatgaaagatagtgaactgtttcatgtgattcacaaagttccatgtggggatactccctatgtcaaagccaaacatgctcagttgatagagaagaacccggagatggcaatagtgtggttttggaaagccattaacacaggagacagagtagacagtgctctcaaggacatggctgttgtaatgaaacaacttgaccgttctgaagaagccatcgaagccatcaaatcttttcgtcctcgttgttccaagaactcccaagattccctcgacaatgtcctcatcgacttatacaagaaatgcgggagaatggaggagcaagttgagttgttgaagaggaaactaaggcagatctatcaaggagagactttcaacggtaaacccacaaagaccgctcgatcccacggcaaaaagtttcaagtgaccgttcaacaagaaatcgcaagactactggggaacttgggatgggcatacatgcaacaagccaagtacttgtcagcagaagcggtatacagaaaagcacagatggtggagccagacgctaacaaatcttgcaacctcgcgatgtgtcttatcaaacaaggcaggtttgaggaaggaagatcggttcttgacgatgttctcgagtctagggttttgggtgcggatgattgtaaaacaaggcaacgagctgatgagctcctgagtgagctagaggcttccctgccacttcggcgagatgctgagatggagaatgtattggggaatatcttagacgatgattttgttcttgggcttgaacagattacgaccactagtttcagatctaagagattgccaatcttcgaacagatctcttcttttagaaatcagctagtttgctaacagtttgattttatgtttcctaaatgtatcatatatatttcgtgtttcatagtttaatgtgttagaacatataatgttttcttgcgtaaattctgtaaatacaacaataatagtgtcaccttgaggacttctagttgctttacttacggttgatatcagtggttgagtgttaagactccagtggatcatcggttggat

SEQ ID NO: 790 - DNA, 1053 bp, Brassica napus
gattcagagagagaaagagatggagagaagcttgaagaagatgaagagtaacaataccaactcaacaagaagcaatctgatgaaagatagtgaactgtttcatgtgattcacaaagttccatgtggggatactccctatgtcaaagccaaacatgctcagttgatagagaagaacccggagatggcaatagtgtggttttggaaagccattaacacaggagacagagtagacagtgctctcaaggacatggctgttgtaatgaaacaacttgaccgttctgaagaagccatcgaagccatcaaatcttttcgtcctcgttgttccaagaactcccaagattccctcgacaatgtcctcatcgacttatacaagaaatgcgggagaatggaggagcaagttgagttgttgaagaggaaactaaggcagatctatcaaggagagactttcaacggtaaacccacaaagaccgctcgatcccacggcaaaaagtttcaagtgaccgttcaacaagaaatcgcaagactactggggaacttgggatgggcatacatgcaacaagccaagtacttgtcagcagaagcggtatacagaaaagcacagatggtggagccagacgctaacaaatcttgcaacctcgcgatgtgtcttatcaaacaaggcaggtttgaggaaggaagatcggttcttgacgatgttctcgagtctagggttttgggtgcggatgattgtaaaacaaggcaacgagctgatgagctcctgagtgagctagaggcttccctgccacttcggcgagatgctgagatggagaatgtattggggaatatcttagacgatgattttgttcttgggcttgaacagattacgaccactagtttcagatctaagagattgccaatcttcgaacagatctcttcttttagaaatcagctagtttgctaacagtttgattttatgtttcctaaatgtatcatatatatttcgtgtttcatagtttaatggggtagaacatataatgttttcttgggtaaattctgtaaatacaacaataatag

SEQ ID NO: 791 - DNA, 1074 bp, Brassica napus
ctgtataggcgttaattattcagagagagaaagagatggagagaagcttgaagaagatgaagagtaacaataccaactcaacaagaagcaatctgatgaaagatagtgaactgtttcatgtgattcacaaagttccatgtggggatactccctatgtcaaagccaaacatgctcagttgatagagaagaacccggagatggcaatagtgtggttttggaaagccattaacacaggagacagagtagacagtgctctcaaggacatggctgttgtaatgaaacaacttgaccgttctgaagaagccatcgaagccatcaaatcttttcgtcctcgttgttccaagaactcccaagattccctcgacaatgtcctcatcgacttatacaagaaatgcgggagaatggaggagcaagttgagttgttgaagaggaaactaaggcagatctatcaaggagagactttcaacggtaaacccacaaagaccgctcgatcccacggcaaaaagtttcaagtgaccgttcaacaagaaatcgcaagactactggggaacttgggatgggcatacatgcaacaagccaagtacttgtcagcagaagcggtatacagaaaagcacagatggtggagccagacgctaacaaatcttgcaacctcgcgatgtgtcttatcaaacaaggcaggtttgaggaaggaagatcggttcttgacgatgttctcgagtctagggttttgggtgcggatgattgtaaaacaaggcaacgagctgatgagctcctgagtgagctagaggcttccctgccacttcggcgagatgctgagatggagaatgtattggggaatatcttagacgatgattttgttcttgggcttgaacagattacgaccactagtttcagatctaagagattgccaatcttcgaacagatctcttcttttagaaatcagctagtttgctaacagtttgattttatgtttcctaaatgtatcatatatatttcgtgtttcatagtttaatgtgttagaacatataatgttttcttgcgtaaattctgtaaatacaacaataatagtgtca

SEQ ID NO: 792 - DNA, 1148 bp, Brassica rapa
gtatacttcaatatttagtgagaggtatagatggagagaagcttgaagaaaatgaagaataataacatcaactcaacaagaagcaatatgatgaaagacaatgaattgtttcatgtgatacacaaagttccttgtggagatactccctatgtcaaagccaaacatgctcagttgatagagaagaacccggagatggcaatagtttggttttggaaagccattaacacaggagaccgagtagatagtgctctcaaagacatggctgttgtaatgaaacaactagaccgttccgaagaagccatcgaagctatcaaatcatttcgtcctcgttgttccaagaactctcaagattcactcgacaatgtccttatcgacttgtacaagaaatgcggtaggatggaggagcaagttgaattgttgaagaggaaactgagacagatctatcaaggagaagctttcaacggtaaacccaccaagaccgctagatcacacggcaagaagtttcaagtgaccgttcaacaagaaatctcaagattactggggaacttggggtgggcatatatgcaacaagccaagtacttgtcggcagaagctgtatacagaaaagcacagattgtggagccagacgctaacaaatcttgcaacctcgccatgtgccttatcaaacaaggcaggtttgaagaaggaagagcgattcttgacgatgttctcgagtctaaggtttcgggttcggatgattgtaaaacaaggcaacgagctgatgagcttctgagtgagctggaggcttcactgccacgtgggcgagatgctgagatggaggatgtcttgggaaatatgttggacgatgactttgttcttgggtttgaagagaggacagccactagttttaagtctaagagactgccaatttttgaacagatctcgccgtttagaaatcaattagtttgctaagtatgcatatagctttcccgttcgcaggtttgatggattggacaataagcactatgttctcttatgtaactatgtatatacgacaataataataatgtcttgtgggtgggtcactcgtaattgcttgatggctgacgctggtggttgtctaaggtttgggttcattccattataatcaactttggagacatacttgg

SEQ ID NO: 793 - DNA, 1054 bp, Brassica rapa
atagatggagagaagcttgaagaaaatgaagaataataacatcaactcaacaagaagcaatatgatgaaagacaatgaattgtttcatgtgatacacaaagttccttgtggagatactccctatgtcaaagccaaacatgctcagttgatagagaagaacccggagatggcaatagtttggttttggaaagccattaacacaggagaccgagtagatagtgctctcaaagacatggctgttgtaatgaaacaactagaccgttccgaagaagccatcgaagctatcaaatcatttcgtcctcgttgttccaagaactctcaagattcactcgacaatgtccttatcgacttgtacaagaaatgcggtaggatggaggagcaagttgaattgttgaagaggaaactgagacagatctatcaaggagaagctttcaacggtaaacccaccaagaccgctagatcacacggcaagaagtttcaagtgaccgttcaacaagaaatctcaagattactggggaacttggggtgggcatatatgcaacaagccaagtacttgtcggcagaagctgtatacagaaaagcacagattgtggagccagacgctaacaaatcttgcaacctcgccatgtgccttatcaaacaaggcaggtttgaagaaggaagagcgattcttgacgatgttctcgagtctaaggtttcgggttcggatgattgtaaaacaaggcaacgagctgatgagcttctgagtgagctggaggcttcactgccacgtgggcgagatgctgagatggaggatgtcttgggaaatatgttggacgatgactttgttcttgggtttgaagagaggacagccactagttttaagtctaagagactgccaatttttgaacagatctcgccgtttagaaatcaattagtttgctaagtatgcatatagctttcccgttcgcaggtttgatggattggacaataagcactatgttctcttatgtaactatgtatatacgacaataataataatgtcttgtgggtggtcactcgtaatgctaaaacc

SEQ ID NO: 794 - DNA, 1041 bp, Brassica napus
gacatctgtatacttcaatatttagcgagagaaatagatggagagaagcttgaagaaaatgaagaataataatatcaactcaacatcaaacaatatgatgaaaggcaatgaattgtttcatgtgatacataaagttccttgtggagatactccctacgtcaaagccaaacatgctcagttgatagagaagaacccggagatggcaatagtttggttttggaaagccattaacacaggagaccgagtagacagtgctctcaaggacatggctgttgtaatgaaacaacttgaccgttccgaagaagccatcgaagctatcaaatcatttcgtcctcgttgttccaagaactctcaagattcactcgacaacgtcctcatcgacttgtacaagaaatgcgggaggatggaggagcaagttgaattgttgaagaggaaactaagacagatctatcaaggagaggctttcaacggtaaacccaccaagaccgctagatcacacggcaagaagtttcaagtgaccgttcaacaagaaatctcaagattattggggaacttgggggggcatatatgcaacaggccaagtacttgtcggcagaagctgtatacagaaaagcccaaattgtggagccagacgctaacaaatcttgcaacctcgccatgtgccttatcaaacaaggcaggtttgaagagggaagagcgattcttgacgatgttctcgagtctagggtttcgggttcggatgattgtaaaacaaggcaacgagctgttgagcttctgagtgagctagagacttcactgccacgtgggcgagatgctgagatggaggatgtcttgggaaatatgttggacgatgactttgttcttgggtttgaagagaggacagccactagttttaagtctaagagactgccaatttttgaacagatctcgccgtttatagatcaattagtttgctaagtatgcatatagctttcccgttcgcatgtttgatggattggacaataagcactatgttctcttatgtaactatgtatatacgac

SEQ ID NO: 795 - DNA, 1196 bp, Brassica napus
ggaagaaaatgaagaataataacatcaactcaacaagaagcaatatgatgaaagacaatgaattgtttcatgtgatacacaaagttccttgtggagatactccctatgtcaaagccaaacatgctcagttgatagagaagaacccggagatggcaatagtttggttttggaaagccattaacacaggagaccgagtagatagtgctctcaaagacatggctgttgtaatgaaacaactagaccgttccgaagaagccatcgaagctatcaaatcatttcgtcctcgttgttccaagaactctcaagattcactcgacaatgtccttatcgacttgtacaagaaatgcggtaggatggaggagcaagttgaattgttgaagaggaaactgagacagatctatcaaggagaagctttcaacggtaaacccaccaagaccgctagatcacacggcaagaagtttcaagtgaccgttcaacaagaaatctcaagattactggggaacttggggtgggcatatatgcaacaagccaagtacttgtcggcagaagctgtatacagaaaagcacagattgtggagccagacgctaacaaatcttgcaacctcgccatgtgccttatcaaacaaggcaggttgaagaaggaagagcgattcttgacgatgttctcgagtctaaggttcgggttcggatgattgtaaaacaaggcaacgagctgatgagcttctgagtgagctggaggcttcactgccacgtgggcgagatgctgagatggaggatgtcttgggaaatatgttggacgatgactttgttcttgggttcgaagagaggacagccactagttttaagtctaagagactgccaatttttgaacagatctcgccgtttagaaatcaattagtttgctaagtatgcatatagctttcccgttcgcaggtttgatggattggacaataagcactatgttctcttatgtaactatgtatatacgacaataataataatgtcttgtgggtgggtcactcgtaattgcttgatggctgacgctggtggttgtctaaggtttgggttcattccattataatcaactttggagacatacttggatataagttcgaacccatatccgtaaatcgaaagtcaaatatggttgcattgaactagaataattgaatatcaaaagtagtttactcgaaaaa

SEQ ID NO: 796 - DNA, 1199 bp, Eutrema parvulum
catcctgtctaattaaaagacatctctgtttacttaattattcagagagaaagcgagagggaaagagatgagcttgaagaagatgaagaataataacaataattacaccaactcaaaaaggagcaatctgatgaaagataatgaactgtttcatgtcgttcacaaagttccttgtggagatactccttatgtcaaagccaaacatgctcagttgatagagaagaacccggagatggcgatagtgtggttttggaaagcaattaactcaggggacagagtagacagtgctttaaaggacatggctgttgtaatgaaacaacttgaccgttccgaagaagccatcgaagccatcaaatcttttcgtcctcgttgctccaagaactcccaagattccctcgacaatgtcctcatcgacttatacaagaaatgtgggagaatggaggagcaagttgagctgttgaagaggaaactaaggcagatctatcaaggagaggctttcaacggtaagcccaccaagaccgcccgatcccacggcaagaagtttcaagtgaccgttcagcaagaaatctcaagattactggggaacttggggtgggcatatatgcaacaagccaagtacttgtcagcagaagcggtatacagaaaagcccagatcgtggagccagacgcaaacaaatcgtgcaacctcgcgatgtgccttatcaagcaaggcaggtttgaagaggcaagatcggttcttgaggatgtgtttgagtctagggtattcggtgcagatgattgtagaacaaggcaacgagcggatgagcttctgaatgagttagaggcttcgctgccacttggacgagattctgagatggaggatgtattgggaaatatcttagacgatgactttgttcttggacttgaacatatgacgaccactaactttaaatccaagagactcccaatcttcgaacagatctcttcttttagaaatcaattagtttgttagcgatctgattttgtgtttcttatatagtttctgtttcatagttttgatggattataaaatatgtgttatatatatgttttgtttttcttatgtgtacatatacaacaataataatgtcttggtgatgacttttatacggctgacgtcagtggttgagtgttaggttctggtcgattaaggttcggttcattcggtttaaatcaattgg

SEQ ID NO: 797 - DNA, 895 bp, Brassica rapa
  misc_feature (18)..(18): n is a, c, g, or t
  misc_feature (31)..(31): n is a, c, g, or t
  misc_feature (49)..(49): n is a, c, g, or t
  misc_feature (59)..(59): n is a, c, g, or t
  misc_feature (87)..(87): n is a, c, g, or t
  misc_feature (90)..(90): n is a, c, g, or t
ttgaagaagatgaagaanaataataccaacncaacaagaagcaatctgntgaaagatantgaactgtttcatgtgattcacaaagtnccntgtggggatactccctatgtcaaagccaaacatgctcagttgatagagaagaacccggagatggcaatagtgtggttttggaaagccattaacacaggagacagagtagacagtgctctcaaggacatggctgttgtaatgaaacaacttgaccgttctgaagaagccatcgaagccatcaaatcttttcgtcctcgttgttccaagaactcccaagattccctcgacaatgtcctcatcgacttatacaagaaatgcgggagaatggaggagcaagttgagttgttgaagaggaaactaaggcagatctatcaaggagagactttcaacggtaaacccacaaagaccgctcgatcccacggcaaaaagtttcaagtgaccgttcaacaagaaatcgcaagactactggggaacttgggatgggcatacatgcaacaagccaagtacttgtcagcagaagcggtatacagaaaagcacagatggtggagccagacgctaacaaatcttgcaacctcgcgatgtgtcttatcaaacaaggcaggtttgaggaaggaagatcggttcttgacgatgttctcgagtctagggttttgggtgcggatgattgtaaaacaaggcaacgagctgatgagctcctgagtgagctagaggcttccctgccacttcggcgagatgctgagatggagaatgtattggggaatatcttagacgatgattttgttcttgggcttgaacagattacgaccactagtttcagatctaagagattgccaatcttcgaacagatctcttctttaagaaatc

SEQ ID NO: 798 - DNA, 1108 bp, Eutrema halophilum
gacatctgtatacattaattattcagagagagaaaacgatggagagaaacttgaagaagatgaagaataataataccaattcaccaagaagcaatcagatgaacgataaagagatgtttcacgtaatccacaaagttcccagtggagatactccttatgttaaagccaaacatgctcagctaatcgacaagaacccagagatggcgatagtgtggttttggaaagccattaacacaggagacagagtagacagtgctctcaaggacatggctgttgtaatgaaacaacttgaccgttccgaagaagccatcgaagccatcaaatcatttcgtcctcgttgttccaagaactctcaagattccctcgacaatgtcctcatcgacttatacaagaaatgtgggagaatggaggagcaagttgagttgttgaagaggaaactaaggcagatctatcaaggagaggctttcaacggaaaacccacaaagaccgctcgatcacacggcaaaaagtttcaagtgaccgttcaacaagaaatctcaagattactagggaacttggggtgggcatatatgcaacaagccaagtacttgtcagcagaagcggtatacagaaaagcccagattgtggagccagacgctaacaaatcgtgcaacctcgcgatgtgccttatcaaacaaggaaggtttgaagagggaagatcggttcttgacgatgtatttgagtctagggttttgggtgcagatgattgtagaacaaggcaacgagctgatgagctattgagtgagctagaggcttcactgccacgtcgtcgagatgctgagatggaggatgtgtttggaaagatcttagacgatgactttgttcttgggcttgaacaaatgacgaccaccactagttttagatctaagagactcccaatcttcgaacaaatctcttcttttagaaatcaattagtttgctaatggtttgattttgtgtattatgtcctgtttcatagttgtgatgggttagaaatatagaacagatgtcttctgttttcttatctaaatttgtatatacaaacaacaataaatcgataatgtcctgtctcggtgacaccttattgctt

SEQ ID NO: 799 - DNA, 1183 bp, Brassica juncea
gagagaaatagaaagagataaagataattaagcttttgaggaagatgaagagtaataataccaactcaacaagaagcaatctggtgaaagataatgaactgtttcatgtgattcacaaagtcccttgtggagatactccgtatgtcagagccaaacatgctcagttaatagagaagaacccggagatggcaatagtgtggttttggaaagccataaacaccggagacagagtagacagtgccctcaaggatatggctgttgtaatgaaacaacttgatcgttccgaagaagccatcgaagccatcaaatcctttcgtcctcgttgttccaagaactctcaagattccctcgataatgtcctcatcgacctatacaagaaatgcgggagaatggaggagcaagttgagctgttgaagaggaagctaaggcagatctatcaaggagaggctttcaacggtaaacccaccaagaccgctagatcccatggcaaaaagtttcaagtgaccgttcaacaagaaatcgcaagattactggggaacttggggtgggcatatatgcaacaagccaagtacttatccgcagaagcagtatacaggaaagctcagatcgtggagccagacgccaacaaatcgtgcaacctagcgatgtgccttatcaaacaaggaaggttcgaagaggcaagagcacttcttgacgatgtatttacctctagggttttgggtgcagatgattgtagaacaaggcaacgagcggatgagcttctgagtgagctagaggcttcgttacctcgtcggctagatgctgagatggaggatgtcttgggaagtatcttagacgatgactttgttatggggctcgaagagatgacgaccagtaattatagaactaagagactcccaatcttcgaacagatctcttcttttagaaatcaattagtttgctaataatttgtgtttcgtgtgtatcttatagttcatgtgtccatagttttgatgggttataagacatatgtgttatgttttcttatgtaaatttgtatatacatacaacaacaataataatgtcatgttggtgacttttagactactagttgctttacggctgacgttaggtggtgatgtgttacgttctgatcgattaaggttctgttcggtttggttctaatcaagtttgattcggttaa

SEQ ID NO: 800 - DNA, 1200 bp, Brassica napus
tctgtataggcttttattattcagagaggaaagagatggagagaagcttcaagatgaagaataataataccaactcaacaaggagcaatctgatgaaagataatgaactgtttcatgtgattcacaaagttccatgtggagatactccctatgtcaaagccaaacatgctcagttgttagagaagaacccggagatggcaatagtgtggttttggaaagccattaacacaggagacagagtagacagtgctctcaaggacatggctgttgtaatgaaacaacttgaccgttctgaagaagccatcgaagccatcaaatcttttcgtcctcgttgttccaagaactcccaagattccctcgacaatgtcctcatcgacttatacaagaaatgcgggagaatggaggagcaagttgagttgttaaagaggaaactaaggcagatctatcaaggagagactttcaacggtaaacccacaaagaccgctcgatcccacggcaaaaagtttcaagtgaccgttcaacaagaaatcgcaagactactggggaacttggggtgggcatatatgcaacaagccaagtacttgtcagcagaagcggtatacagaaaagcacagatggtggagccagacgctaacaaatcttgcaacctcgcgatgtgtcttatcaaacagggcaggtttgaggaaggaagatcggttcttgacgatgttctcgagtctagggttttgggtgcggatgatcgtaaaacaaggcaacgagctgatgagctcctgggtgagctagaggtttcgctgccacttcggcgagatgctgagatggaggatgtattggagaatatcttagacgatgactttgttcttgggcttgaacagataacgaccagtagttttagatctaagagattgccaatcttcgaacagatctcttcttttagatcttcttttagaaatcagctagtttgctaatagtttgattttatgtttcctaaatgtatcatatatttcgtgtttcatagtttaatgtgttagaacatataatgtgttcttgcgtaaattctgtaatatacaacaataatggtgtcaccttgaggacttctagttgctttaattacttacggttgatatcagtggttgagttttaagactccagtggatcatcggttagatacgattacagatgaatagtgataagtaagtacta

SEQ ID NO: 801 - DNA, 1131 bp, Brassica rapa
acagcctgtctataaagacatttgcatacttaattattcaaagagagagagagagatagaaagatagaaagagataaagataagcttttgaagaagatgaagaataataataccaacacaacaagaagcaatctggtgaaagataatgaactgtttcatgtgattcacaaagtcccttgtggggatactccctatgtcaaagccaaacatgctcagttgatagagaagaacccggagatggcaatagtgtggttttggaaagccataaacacaggagacagagtagatagtgctctaaaggacatggctgtcgttatgaaacaacttgaccgtcccgaagaggccatcgaagccatcaaatcctttcgtcctcgttgttccaagaactcccaagattccctagacaatgtcctcatcgacctatacaagaagtgcgggagaatggaggagcaagttgagctgttgaagaggaagctaaggcagatctatcaaggagaggctttcaatggtaaacctaccaagaccgctagatcccatggaaaaaagtttcaagtgaccgttcaacaagaaatcgcaagactactggggaacttggggtgggcatatatgcaacaagccaagtacttatccgcagaagcggtgtacagaaaagctcagatggttgagccagacgctaacaaatcatgcaacctggcgatgtgccttatcaaacaaggaaggtttgaagaggcaagagcccttcttgacgatgtatttacctatagggttttaggtgcagatgattgtagaacaaggcaacgagcggatgagcttctgggtgagctagaggcttcgttacctcgtcggctagatgctgagatggaggatgtcttgggaaatatcttagacgatgactttgttattgccatcgggcttgaagagatgacagccagtaattatagatctaagagactcccaatcttcgagcagatctcttcttttagaaatcagttagtttgctaatgatttgcattttatgtttcttatgtatcatagttcatgtttaatagtcttgatgggttagaaaatacatgtgttatgtttccttatgtaaatttgtatatacaaacaacaataataatgtcattttac

SEQ ID NO: 802 - DNA, 1132 bp, Brassica napus
gcctgtctataaagacatttgcacttaattattcacagagagagagatagaaagagataaagataagcttttgaagaagatgaagaataataataccaacacaacaagaagcaatctggtgaaagataatgaactgtttcatgtgattcacaaagtcccttgtggagatactccctatgtcaaagccaaacatgctcagttgatagagaagaacccggagatggcaatagtgtggttttggaaagccataaacacaggagacagagtagatagtgctctcaaggacatggctgttgtaatgaaacaacttgaccgtcccgaagaggccatcgaagccatcaaatcctttcgtcctcgttgttccaagaactcccaagattccctagacaatgtcctcatcgacctatacaagaagtgcgggagaatggaggagcaagttgagctgttaaagaggaagctaaggcagatctatcaaggagaggctttcaatggtaaacctaccaagaccgctagatcccatggcaaaaagtttcaagtgaccgttcaacaagaaatcgcaagactactggggaacttggggtgggcatatatgcaacaagccaagtacttatccgcagaagcggtatacagaaaagctcagatggttgagccagacgctagcaaatcatgcaacctggcgatgtgccttatcaaacaaggaaggtttgaagaggcaagagcacttcttgacgatgtatttacctctagggttttaggtgcagatgattgtagaacaaggcaacgagcggatgagcttctgagtgagctagaggcttcgttacctcgtcggctagatgctgagatggaggatgtattgggaaatatcttagacgatgactttgttattgccattgggcttgaagagatgacagccagtaattatagatctaagagactcccaatctttgaacagatctcctcttttagaaatcagttagtttgctaatgatttgcatttcatgtttcttatgtatcatacagttcatgtttaatagtattgatgggttagaaaatacatgtgttatgttttttatgtaaatttgtatatacaaaaacaacaacaattaataatgtcattttactttttttttta

SEQ ID NO: 803 - DNA, 1056 bp, Brassica napus
agagagagagatagaaagagataaagataagcttttgaagaagatgaagaataataataccaacacaacaagaagcaatctggtgaaagataatgaactgtttcatgtgattcacaaagtcccttgtggagatactccctatgtcaaagccaaacatgctcagttgatagagaagaacccggagatggcaatagtgtggttttggaaagccataaacacaggagacagagtagatagtgctctcaaggacatggctgttgtaatgaaacaacttgaccgtcccgaagaggccatcgaagccatcaaatcctttcgtcctcgttgttccaagaactcccaagattccctagacaatgtcctcatcgacctatacaagaagtgcgggagaatggaggagcaagttgagctgttaaagaggaagctaaggcagatctatcaaggagaggctttcaatggtaaacctaccaagaccgctagatcccatggcaaaaagtttcaagtgaccgttcaacaagaaatcgcaagactactggggaacttggggtgggcatatatgcaacaagccaagtacttatccgcagaagcggtatacagaaaagctcagatggttgagccagacgctagcaaatcatgcaacctggcgatgtgccttatcaaacaaggaaggtttgaagaggcaagagcacttcttgacgatgtatttacctctagggttttgggtgcagatgattgtaaaacaaggcaacgagcgggtgagcttctgagtgagctagaggcttcgttacctcgtcggctagatgctgagatggaggatgtctttggaaatatcttagacgatgactttgttattgccatcgggcttgaagagatgacagccagtaattatagatctaagagactcccaatctttgaacagatctcctcttttagaaatcagttagtttgctaatgatttgcatttcatgtttcttatgtatcatacagttcatgtttaatagtcttgatgggttagaaaatacatgtgttatgttttttatgtaaatttgtatatacaaa

SEQ ID NO: 804 - DNA, 946 bp, Brassica juncea
tgcacaaacaacacatctgcatacttcaaataatcagagagagagagagagagaacggaaaagatggagagaaacttgaataagatgaagaataataatactaactcaacaaggagcaatctggcgaaagataatgaactgtttcatgtgattcacaaagttccatgtggagatactccgtatgtcagagccaaacatgctcagttaatagagaagaacccggagatggcaatagtgtggttttggaaagccatcaacacaggagacagagtagacagtgctctcaaggacatggccgttgtaatgaaacaacttgaccgttccgaagaagccatcgaagccatcaaatcctttcgtcctcgttgttccaagaactcccaagattccctcgacaatgtcctcatcgacttatacaagaaatgtgggagaatggaggaacaagttgagttgttgaagaggaaactaagacagatttatcagggagaggctttcaacggtaaacccaccaagaccgctagatcccatggcaaaaagtttcaagtgaccgttcaacaagaaatctcaagattactggggaacttggggtgggcatatatgcaacaagccaagtacttgtcggcagaagctgtatacagaaaagcacagattgtggagccagacgctaacaaatcttgcaacctcgccatgtgccttatcaaacaaggcaggtttgaagaaggaagagcgattcttgacgatgttctcgagtctaaggtttcgggttcggatgattgtaaaacaaggcaacgagctgatgagcttctgagtgagctggaggcttcactgccacgtgggcgagatgctgagatggaggatgtcttgggaaatatgttggacgatgactttgttcttgggtttgaagagaggacagccactagttttaagtctaagagactgccaatttttg

SEQ ID NO: 805 - DNA, 3253 bp, Secale cereale
ggagcctcctccgaccccgcggatggatgactcggagaacaacgcgccgtcgaccccgggctcgccgggcttcagcaccgaccggctgccgcccaacaccaccaccagccgcggcgccaccgacccgtcctcctactcggacgacgatggcgaggcggaggtcgaccccaatgtgctccccgaggacgacggcgccaccgttatccgcgacgaggaggaagacgacggggaggacctcttcaacgacgactacctcaatgattaccgaagaatggatgagcaggatcagtatgagtcggttgggttagatgactcgatagaggatgagaggaacctggatgagatcatggctgatcgaagggctgcagaagcggaacttcatgcaagggatgtgaggactggtgcaacagcggatcgaaaattgcctcgtatgcttcatgatcaggatacagatgaggatatgaacttcaggcgtcctaaaaggcacaggactaattttagacaaccaagtggaggaccaagaacacccagaagtgatgacgatggtgatggtctcactcctagttcacctggaagatctcagccatattccggcggtgatgtgcctatgactgatcagactgatgatgatggatatgaggatgaatttgatgaagaagatgagatgaacatgtatcgtgtgcaaggaacacttagagagtgggtcacaagagatgaagtccggcgcttcatcgcaaagaaatttaaagaatttcttcttacatatgtaaaccctaagaatgaacaaggagactttgaatatgtcagactaattaatgagatggttttagctaacaagtgtagtttggagatagactacaagcaatttatttatatacacccaaacattgccatctggttggctgatgcacctcaatcggtgctggaagttatggaggaagtgggcaaaaatgttgtttttgatctccacaagaattacagaaacatccatcaaaaaatatatgtgcgaataaccaaccttcctgtctatgatcaaatacgcaatatcaggcaaattcatctgaacacaatgattcgaattggggtgttgttactcgaaggtcaggtgtgttccctcagctgcagcaggtcaagtatgactgtagcaaatgtggaactgtcctgggtcctttcttccagaactcttacactgaagtaagggttgggtcttgccctgaatgccaatccaaaggtccatttactgtcaacattgagcaaactatatacaggaactatcagaaactcactcttcaggaaagccctgggattgttcctgctggcaggcttcccaggtacaaggaagtaatacttctgaatgatctgatcgactgtgcccgtccaggagaggaaattgaggttacggggatatacacaaacaactttgacttgtctttaaatacaaagaatggtttcccagttttcgccacagtggtggaggcaaactatgtatcaaagaagcaggatctgttctctgcatacaaattaacagatgaggacaaggctgagattgagaagttgtcaaaggatcctcgtatcagtgaaaggattgttaaatcaattgcaccatccatttatggtcatgaagatatcaagactgccattgcactagctatgtttgggggccaagaaaagaacgtgaagggaaagcatcgcctaagaggtgatattaattgtctcctcttgggtgacccaggcactgcgaaatcccaatttctcaagtatgttgagaaaacagggcacagggctgtatacacaactgggaaaggagcttctgctgttggactgacagcagcagttcacaaggatccagtaacacgggagtggacccttgagggaggcgcactggttcttgctgatagaggcatatgccttattgatgaatttgataagatgaatgatcaagatagggtaagtattcatgaagccatggagcaacaaagtatcagcatatcaaaggcaggaattgtcacatcccttcaagctcgatgcagtgttattgctgcagcaaacccagttggaggaagatatgattcttcgaagacattcactcaaaacgttgaactaacagatccaatcatttcacgttttgatgtcctctgtgttgttaaggatattgttgacccatttacggatgaaatgcttgcaaggtttgttgtagacagccatgccagatctcagcccaagggtggtaatcttgaagatagagttgtagctgatgaggaggatgatccactgactgttgcccgaaatgctgacccagatatcctttctcaagacatgctgaagaagtatatcacatatgctaagttgaatgtattccccaaaatacatgatgctgacctagacaagattagccatgtctatgctgaacttcggcgcgaatcatctcacggtcaaggagtccccattgcagtaaggcatattgaatcaatcattcgaatgtctgaggcacatgcaaagatgcatctgagaagctatgtgtctcaggaagatgtcgacatggccattcgtgtgctgcttgactcgttcatctcaacccagaaatttggtgtccagaaagcacttcagaagaatttccggaagtacatgacgtacaagaaggattacaatgaactgcttctgcttcttctgcgcacccttgtcaaggaggcgctgcactttgaagaaattgtgtctggatcaaccacacgcctgactcacgtcgaggttaaagtggatgacctgaagaacaaggcccaagagtatgagatctacgacctgaggccgttcttctccagctctcacttcagcgacaacagcttcgtcctggacgaagggcgtgggatcatcaggcatccagttgcagcataactactcaataaacctcagccgatgacccccgtgtgatgaacagctacctcttcgtggttcaagagctagtgatggagctagaaatgtccacttgtagtttaagttggcaaaatgactgcttttgtctgttttatgggaattctgataattggtgtactatttgctatctgaaacccttgtgcctccagcggcatttagagatgtctgtaccttcttgatatcataattcagtgtgatgcaactgatgccatcctcctacttgataccataattcagtgttatgcaactgacgcaattctcctacgaattggtgaattatgatttgttcttttgggacaatgtattagttggtggcaaaaaagtc

SEQ ID NO: 806 - DNA, 2970 bp, Triticum aestivum
cccaccattccccccttcccgccgaaaccctagcctcggcgcacagccacacgcgtcctccacaggagcctcctccgaccccgcggatggacgactcggagaacaacgcgccgtcgaccccgggctcgccgggcttcagcaccgaccggctgccgcccaacaccaccaccagccgcggcgccaccgacccgtcctcctactcggacgacgatggcgaggcggaggtcgaccccaatgtgctccccgaggacgacggcgccaccgttatccgcgacgaggaggaagacgatggggaggacctcttcaacgacgactacctcaatgattaccgaagaatggatgagcaggatcagtatgagtcggttgggttagacgactcgatagaggatgagaggaacctggatgagatcatggctgatcgaagggctgcagaagcggaacttcatgcaagggatgtgaggactggtgcaacagctgatcgaaaattacctcgtatgcttcatgatcaggatacagatgaggatatgaacttcaggcgtcctaaaaggcacagggctaattttagacaaccaagtggaggaccaagaacacccagaagtgatgatgatggtgatggtctcactcctagttcacctggaagatctcagccatattctggcggtgatgtgcctatgactgatcagaccgatgatgatggatatgaggatgaatttgatgaagaagatgagatgaacatgtatcgtgtgcaaggaacacttcgagagtgggtcacaagagatgaagtccggcgcttcatcgcaaagaaatttaaagaatttcttcttacatatgtaaaccctaagaatgaacaaggagagtttgaatatgtcagactcattaatgagatggttttagctaacaagtgtagtttggagatagactacaagcaatttatttatatacacccaaacattgccatctggttggctgatgcacctcaatcagtgctggaggttatggaggaagtgggcaaaaatgttgtttttgatctccacaagaattacagaaacatccatcagaaaatatatgtgcgaatcaccaaccttcctgtctatgatcaaatacgcaatatcaggcaaattcatctgaacacaatgattcgaattgggggtgttgttactcgaaggtcaggtgtgttccctcagctgcagcaggtcaagtatgactgtagcaaatgtggaactgtcctgggtcctttcttccagaactcttacactgaagtaaaggttgggtcctgccctgaatgccaatccaaaggtccatttactgtcaacattgagcaaactatatacaggaactatcagaaactcactcttcaggaaagcccagggattgttcctgctggcaggcttcccaggtacaaggaagtgatacttctgaatgatctgatcgactgcgctcgtccaggagaagaaattgaggttacagggatatacacaaacaattttgacctgtctttaaatacaaagaatggtttcccagtttttgccacagtggtggaggcaaactatgtatcaaagaagcaggatctgttctctgcatacaaattaacagatgaggacaaggctgagattgagaagttgtcgaaggatcctcgtatcagtgaaaggattgtcaaatcaattgcaccatccatttatggtcatgaagatatcaagactgccattgcactagctatgtttggcgggcaagaaaagaacgtgaagggaaagcatcgcctaagaggtgatattaactgtctcctcttgggtgacccaggcactgcgaaatcccaatttctcaagtatgttgagaaaacaggacacagggctgtatacacaactgggaaaggagcttctgctgttggactcacagcagcagttcacaaggatccagtaacacgggagtggacccttgagggaggtgcactggttcttgctgatagaggcatatgccttattgatgaatttgataagatgaatgatcaagatagggtaagtattcatgaagccatggagcaacaaagtatcagcatatcaaaggcagggattgtcacatcccttcaagctcgatgcagtgttattgctgcagcaaacccagttggaggaagatatgattcttcaaagacattcacccaaaatgttgagctaacagatccaattatttcacgttttgatgtcctctgtgttgtgaaggatattgttgacccatttacagatgaaatgcttgcaaggtttgttgttgatagccatgccagatctcagcccaagggtggtaaccttgaagatagagttgtagctgacgaggaggatgatccattgactgttgcccgaaatgctgacccagatatcctttctcaagacatgctgaagaagtatatcacatatgctaagttgaatgtattccccaaaatacatgatgctgacctggacaagattagccatgtctatgctgaacttcgacgtgaatcatctcacggtcaaggagtccccattgcagtaaggcatatcgaatcaatcattcgaatgtctgaggcacatgcaaagatgcatctgcgaagctatgtgtctcaggaagatgtggacatggccattcgtgtgctgcttgactcgttcatctcaacccagaaatttggtgtccagaaagcacttcagaagaatttccggaagtacatgacgtacaagaaggattacaatgaactgcttctgctccttctgcgcaccctggtcaaggaggcgctgcactttgaagaaatcgtgtctggatcaaccacacgcctgactcacgttgaggttaaagtggatgacctgaagaacaaggcccaagaatatgagatctacgacctgaggccgttcttctccagctctcacttcagtgacaacagctttgtcctcgatgaagggcgtgggatcatcaggcatccagttgcggcataacaactcaatcgacctc

SEQ ID NO: 807 - DNA, 3198 bp, Triticum aestivum
accattccccccttcccgccgaaaccctagcctcggcgcacagccacacgcgtcctcctcaggagcctcctcagaccccgcggatggacgactcggagaacaacgcgccgtcgaccccgggctcgccgggcttcagcaccgaccggctgccgcccaacaccaccaccagccgcggcgccaccgacccgtcctcctactcggacgacgatggcgaggcggaggtcgaccccaatgtgctccccgaggacgacggcgccaccgttatccgcgacgaggaggaagacgatggggaggacctcttcaacgacgactacctcaatgattaccgaagaatggatgagcaggatcagtatgagtcggttgggttagatgactcgatagaggatgagaggaacctggatgagatcatggctgatcgaagggctgcagaagcggaacttcatgcaagggatgtgaggactggtgcaacagctgatcgaaaattacctcgtatgcttcatgatcaggatacagatgaggacatgaacttcaggcgtcctaaaaggcacagggctaattttagacaaccaagtggaggaccaagaacacccagaagtgatgatgatggtgatggtctcactcctagttcacctggaagatcgcagccatattctggcggtgatgtgcctatgactgatcagaccgatgatgatggatatgaggatgaatttgatgaagaagatgagatgaacatgtatcgtgtgcaaggaacacttcgagagtgggtcacaagagatgaagtccggcgcttcatcgcaaagaaatttaaagaatttcttcttacatatgtaaaccctaagaatgaacaaggagagtttgaatatgtcagactaattaatgagatggttttagctaacaagtgtagtttggagatagactacaagcaatttatttatatacacccaaacattgccatctggttggccgatgcacctcaatcggtgctggaagttatggaggaagtgggcaaaaatgttgtttttgatctccacaagaattacagaaacattcatcaaaaaatatatgtgcgaataaccaaccttcctgtctatgatcaaatacgcaatatcaggcaaattcatctgaacacaatgattcgaattgggggtgtcgttactcgaaggtcaggtgtgttccctcagctgcagcaggtcaagtatgactgtagcaaatgtggaactgtcctgggtcctttcttccagaactcgtacactgaagtaagggttgggtcttgccctgaatgccaatcgaaaggtccatttactgtcaacattgagcaaactatatacaggaactatcagaaactcactcttcaggaaagcccagggattgttcctgctggcaggcttcccaggtacaaggaagtgatacttctgaatgatctgattgactgcgctcgtccaggagaggaaattgaggttacggggatatacacaaacaattttgacctgtctttaaatacaaagaatggtttcccagtttttgccacagtggtggaggcaaactatgtatcaaagaagcaggacctgttctctgcatacaaattaacagatgaggacaaggcagagattgagaagttgtcaaaggatcctcgtatcagtgaaaggattgtcaaatcaattgcaccatccatttatggtcatgaagatatcaagactgccattgcactagctatgtttggggggcaagaaaagaacgtgaagggaaaacatcgcctaagaggtgatattaattgtctcctcttaggtgacccaggcactgcaaaatcccaatttctcaagtatgtcgagaaaacaggacacagggctgtatacacaactgggaaaggagcttctgctgttggactcaccgcagcagttcacaaggatccagtaacacgggagtggacacttgagggaggtgcactggttcttgctgatagaggcatatgccttattgatgaatttgataagatgaatgatcaagacagggtaagtattcatgaagctatggagcaacaaagtatcagcatatcaaaggcaggaattgtaacatcacttcaagctcgatgcagtgttattgctgcagcaaacccagttggcggaagatatgattcttcgaagacattcacgcaaaatgttgagctaacagatcctattatttcacgttttgatgtcctctgtgttgtgaaggatattgttgacccatttacagatgaaatgcttgcaaggtttgttgttgatagccatgccagatctcagcccaagggtggtaaccttgaagatagagttgtagctgacgaggaggatgatccattgactgttgcccgaaatgctgacccagatatcctttctcaagacatgctgaagaagtatatcacatatgctaagttgaatgtattccccaaaatacatgatgctgacctggacaagattagccatgtctatgctgaacttcgacgtgaatcatctcacggtcaaggagtccccattgcagtaaggcatattgaatcaatcattcgaatgtctgaggcacatgcaaagatgcatctgagaagctatgtgtctcaagaagatgtcgacatggccattcgtgtgctgcttgactccttcatctcaacccagaaatttggtgtccagaaggcacttcagaagaatttccggaaatacatgacgtacaagaaggattacaatgaactgcttctgctccttctgcgcaccctggtcaaggaggcgctgcactttgaagaaatcgtgtcgggatcaaccgcacgcctgactcatgtggaggttaaagtggatgacctgaagaacaaggcccaagagtatgagatctacgacctgaggccgttcttctccagctcgcacttcagcgacaacagttttgtcctggacgaaggacgtgggatcatcaggcatccagttgcagcataacaactcaatcgacctcagctgatgacccatgtgtgatgaacagctacctctttgttcaagagctagtgatggagctagaaatgtccacttgtagtgtaagttggcaaaatgactgcttgtgcctgttttatgagagtactgatattggtgtactgtttgctatttgaaacccttgtgcctcctgtggcatttagagatgtctgtaccttcttgatatcataattcagtgttatggaactaaaaactc

SEQ ID NO: 808 - DNA, 3186 bp, Triticum aestivum
gaccattccccccttcccgccgaaaccctagcctcggcgcacagccacacgcgtcctccacaggagcctcctcagaccccgcggatggacgactcggagaacaacgcgccgtcgaccccgggctcgccgggcttcagcaccgaccggctgccgcccaacaccaccaccagccgcggcgccaccgacccgtcctcctactcggacgacgatggcgaggcggaggtcgaccccaatgtgctccccgaggacgacggcgccaccgttatccgcgacgaggaggaagacgatggggaggacctcttcaacgacgactacctcaatgattaccgaagaatggatgagcaggatcagtatgagtcggttgggttagacgactcgatagaggatgagaggaacctggatgagatcatggctgatcgaagggctgcagaagcggaacttcatgcaagggatgtgaggactggtgcaacagctgatcgaaaattacctcgtatgcttcatgatcaggatacagatgaggatatgaacttcaggcgtcctaaaaggcacagggctaattttagacaaccaagtggaggaccaagaacacccagaagtgatgatgatggtgatggtctcactcctagttcacctggaagatcgcagccatattctggcggtgatgtgcctatgactgatcagaccgatgatgatggatatgaggatgaatttgatgaagaagatgagatgaacatgtatcgtgtgcaaggaacacttcgagagtgggtcacaagagatgaagtccggcgcttcatcgcaaagaaatttaaagaatttcttcttacatatgtaaaccctaagaatgaacaaggagagtttgaatatgtcagactaattaatgagatggttttagctaacaagtgtagtttggagatagactacaagcaatttatttatatacacccaaacattgccatctggttggccgatgcacctcaatcggtgctggaagttatggaggaagtgggcaaaaatgttgtttttgatctccacaagaattacagaaacattcatcaaaaaatatatgtgcgaataaccaaccttcctgtctatgatcaaatacgcaatatcaggcaaattcatctgaacacaatgattcgaattgggggtgttgttactcgaaggtcaggtgtgttccctcagctgcagcaggtcaagtatgactgtagcaaatgtggaactgtcctgggtcctttcttccagaactcttacactgaagtaagggttgggtcttgccctgaatgccaatccaaaggtccatttactgtcaacattgagcaaactatatacaggaactatcagaaactcactcttcaggaaagcccagggattgttcctgctggcaggcttcccaggtacaaggaagtgatacttctgaatgatctgattgactgcgctcgtccaggagaggaaattgaggttacggggatatacacaaacaattttgacctgtctttaaatacaaagaatggtttcccagtttttgccacagtggtggaggcaaactatgtatcaaagaagcaggacctgttctctgcatacaaattaacagatgaggacaaggcagagattgagaagttgtcaaaggatcctcgtatcagtgaaaggattgtcaaatcaattgcaccatccatttatggtcatgaagatatcaagactgccattgcactagctatgtttggggggcaagaaaagaacgtgaagggaaaacatcgcctaagaggtgatattaattgtctcctcttaggtgacccaggcactgcaaaatcccaatttctcaagtatgtcgagaaaacaggacacagggctgtatacacaactgggaaaggagcttctgctgttggactcaccgcagcagttcacaaggatccagtaacacgggagtggacacttgagggaggtgcactggttcttgctgatagaggcatatgccttattgatgaatttgataagatgaatgatcaagacagggtaagtattcatgaagctatggagcaacaaagtatcagcatatcaaaggcaggaattgtaacatcacttcaagctcgatgcagtgttattgctgcagcaaacccagttggcggaagatatgattcttcgaagacattcacgcaaaatgttgagctaacagatcctattatttcacgttttgatgtcctctgtgttgtgaaggatattgttgacccatttacagatgaaatgcttgcaaggtttgttgttgatagccatgccagatctcagcccaagggtggtaaccttgaagatagagttgtagctgacgaggaggatgatccattgactgttgcccgaaatgctgacccagatatcctttctcaagacatgctgaagaagtatatcacatatgctaagttgaatgtattccccaaaatacatgatgctgacctggacaagattagccatgtctatgctgaacttcgacgtgaatcatctcacggtcaaggagtccccattgcagtaaggcatattgaatcaatcattcgaatgtctgaggcacatgcaaagatgcatctgagaagctatgtgtctcaagaagatgtcgacatggccattcgtgtgctgcttgactccttcatctcaacccagaaatttggtgtccagaaggcacttcagaagaatttccggaaatacatgacgtacaagaaggattacaatgaactgcttctgctccttctgcgcaccctggtcaaggaggcgctgcactttgaagaaatcgtgtcgggatcaaccgcacgcctgactcatgtggaggttaaagtggatgacctgaagaacaaggcccaagagtatgagatctacgacctgaggccgttcttctccagctcgcacttcagcgacaacagttttgtcctggacgaaggacgtgggatcatcaggcatccagttgcagcataacaactcaatcgacctcagctgatgacccatgtgtgatgaacagctacctctttgttcaagagctagtgatggagctagaaatgtccacttgtagtgtaagttggcaaaatgactgcttgtgcctgttttatgagagtactgatattggtgtactgtttgctatttgaaacccttgtgcctcctgtggcatttagagatgtctgtaccttcttgatatcataattcagtgttatg

SEQ ID NO: 809 - DNA, 3162 bp, Triticum aestivum
gccgaaaccctagccttggcgcacagccgcacgcgtcctccaccggagcctcctccgaccccgcggatggacgactcggagaacaacgcgccgtcgaccccgggctcgccgggcttcagcaccgaccggctgccgcccaacaccaccaccagccgcggcgccaccgacccgtcctcctactcggacgacgatggcgaggcggaggtcgaccccaacgtgctccccgaggacgacggcgccaccgttatccgcgacgaggaggaagacgacggggaggacctcttcaacgacgactacctcaatgattaccgaagaatggatgagcaggaccagtatgagtcagttgggttagatgactcaatagaggatgagaggaacctggatgagatcatggctgatcgaagggctgcagaagcggaacttcatgcaagggatgtgaggactggtgcaacagctgatcgaaaattgcctcgtatgcttcatgatcaggatacagatgaggatattaactttaggcgtcctaaaaggcacagggctaattttagacaaccaagtggaggaccaagaacacccagaagtgatgatgatggtgatggtctcactcctagttcacctggaagatctcagccatattctggtggtgatgtgcctatgactgatcagactgatgatgatggatatgaggatgaatttgatgaagaagatgagatgaacatgtatcgtgtgcaaggaacacttcgagagtgggtcacaagagatgaagtccggcgcttcatcgcaaagaaatttaaagaatttcttcttacatatgtaaaccctaagaatgaacaaggagagtttgaatatgtcagactcattaatgagatggttttagctaacaagtgtagtttggagatagactacaagcaatttatttatatacacccaaacattgccatctggttggccgatgcacctcaatcggtgctggaagttatggaggaagtgggcaaaaatgttgtttttgatctccacaagaattacagaaacattcatcaaaaaatatatgtgcgaataaccaaccttcctgtctatgatcaaatacgcaatatcaggcaaattcatctgaacacaatgattcgaattgggggtgttgttactcgaaggtcaggtgtgttccctcagctgcagcaggtcaagtatgactgtagcaaatgtggaactgtcctgggtcctttcttccagaactcttacactgaagtaagggttgggtcttgccctgaatgccaatccaaaggtccatttactgtcaacattgagcaaactatatacaggaactatcagaaactcactcttcaggaaagcccagggattgttcctgctggcaggcttcccaggtacaaggaagtgatacttctgaatgatctgatcgactgtgctcgtccaggagaggaaattgaggttacagggatatacacaaacaattttgacctgtctttaaatacaaagaatggtttcccagtttttgccacagtggtggaggcaaactatgtatcaaagaagcaggacctgttctctgcatacaaattaacagatgaggacaaggcagagattgagaagttgtcaaaggatcctcgtatcagtgaaaggattgtcaaatcaattgcaccatccatttatggtcatgaagatatcaagactgccattgcactagctatgtttggggggcaagaaaagaacgtgaagggaaaacatcgcctaagaggtgatattaattgtctcctcttaggtgacccaggcactgcaaaatcccaatttctcaagtatgtcgagaaaacaggacacagggctgtatacacaactgggaaaggagcttctgctgttggactcaccgcagcagttcacaaggatccagtaacacgggagtggacacttgagggaggtgcactggttcttgctgatagaggcatatgccttattgatgaatttgataagatgaatgatcaagacagggtaagtattcatgaagccatggagcaacaaagtatcagcatatcaaaggcaggaattgtcacatcccttcaagctcgatgcagtgttattgctgcagcaaacccagttggaggaagatatgattcttcaaagacattcacccaaaatgttgagctaacagatccaattatttcacgttttgatgtcctctgtgttgtgaaggatattgttgacccatttacagatgaaatgcttgcaaggtttgttgttgatagccatgccagatctcagcccaagggtggtaaccttgaagatagagttgtagctgacgaggaggatgatccattgactgttgcccgaaatgctgacccagatatcctttctcaagacatgctgaagaagtatatcacatatgctaagttgaatgtattccccaaaatacatgatgctgacctggacaagattagccatgtctatgctgaacttcgacgtgaatcatctcacggtcaaggagtccccattgcagtaaggcatatcgaatcaatcattcgaatgtctgaggcacatgcaaagatgcatctgagaagctatgtgtctcaagaagatgttgacatggccattcgtgtgctgcttgactcattcatctcaacccagaaatttggtgtccagaaggcacttcagaagaatttccggaaatacatgacttacaagaaggattacaatgaactgcttctgctccttctgcgcaccctggtcaaggaggcgctgcactttgaagaaatcgtgttgggatcaaccgcacgcctgactcatgtcgaggttaaagtggatgacctgaagaacaaggcccaagagtacgagatctacgacctgaggccgttcttctccagctctcacttcagcgacaacagcttcgtcctggacgaagggcgtgggatcatcaggcatccagttgcagcataacaactcaatcaacatcagccgatgacccctgtgtgatgaacagctacctctttgttcaagagctagaaatgtccacttgtagtgtaagtcggcaaaatgactgcttgtgtctgttttgtgagagttctgatattggtgtactgtttgctatctgaaacccttgtgcctacagcggcatttcgagatgtctgtaccttcttgatatcataattcagtgtttatggaact

SEQ ID NO: 810 - DNA, 2878 bp, Triticum aestivum
gatgactcaatagaggatgagaggaacctggatgagatcatggctgatcgaagggctgcagaagcggaacttcatgcaagggatgtgaggactggtgcaacagctgatcgaaaattgcctcgtatgcttcatgatcaggatacagatgaggatattaactttaggcgtcctaaaaggcacagggctaattttagacaaccaagtggaggaccaagaacacccagaagtgatgatgatggtgatggtctcactcctagttcacctggaagatctcagccatattctggtggtgatgtgcctatgactgatcagactgatgatgatggatatgaggatgaatttgatgaagaagatgagatgaacatgtatcgtgtgcaaggaacacttagagagtgggtcacaagagatgaagtcaggcgcttcattgcaaagaaatttaaagaatttcttcttacatatgtaaaccctaagaatgaacaaggagagtttgaatatgtcagactaattaatgagatggttttagctaacaagtgtagtttggagatagactacaagcaatttatttatatacacccaaacattgccatctggttggctgatgcacctcaatcagtgctggaggttatggaggaagtgggcaaaaatgttgtttttgatctccacaagaattacagaaacatccatcagaaaatatatgtgcgaatcaccaaccttcctgtctatgatcaaatacgcaatatcaggcaaattcatctgaacacaatgattcgaatcgggggtgttgttactcgaaggtcaggtgtgttccctcagctgcagcaggtcaagtatgactgtagcaaatgtggaactgtcctgggtcctttcttccagaactcttacactgaagtaagggttgggtcttgccctgaatgccaatccaaaggtccatttactgtcaacgttgagcaaactatatacaggaactatcagaaactcactcttcaggaaagcccagggattgttcctgctggcaggcttcccaggtacaaggaagtaatacttctgaatgatctgattgactgtgctcgtccaggagaggaaattgaggttacagggatatacacaaacaatttcgacctgtctttaaatacaaagaatggtttcccagtttttgccacagtggtggaggcaaactatgtatcaaagaagcaggatctgttctctgcatacaaattaacagatgaggacaaggctgagattgagaagttgtcgaaggatcctcgtatcagtgaaaggattgtcaaatcaattgcaccatccatttatggtcatgaagatatcaagactgccattgcactagctatgtttggcgggcaagaaaagaacgtgaagggaaagcatcgcctaagaggtgatattaactgtctcctcttgggtgacccaggcactgcgaaatcccaatttctcaagtatgttgagaaaacaggacacagggctgtatacacaactgggaaaggagcttctgctgttggactcacagcagcagttcacaaggatccagtaacacgggagtggacccttgagggaggtgcactggttcttgctgatagaggcatatgccttattgatgaatttgataagatgaatgatcaagatagggtaagtattcatgaagccatggagcaacaaagtatcagcatatcaaaggcagggatcgtcacatcccttcaagctcgatgcagtgttattgctgcagcaaacccagttggaggaagatatgattcttcgaagacattcactcaaaatgttgaactaacagatccaatcatttcacgttttgatgtcctctgtgttgttaaggatattgttgacccatttacggatgaaatgcttgcaaggtttgttgtagatagccatgccagatctcagcccaagggtggtaatcttgaagatagagttgtagctgatgaggaggatgatccattgactgttgcccggaatgctgacccagatatcctttctcaagacatgctgaagaagtatatcacatatgctaagttgaatgtattccccaaaatacatgatgctgaccttgacaagatcagccatgtctatgctgaacttcgacgtgaatcatctcacggtcaaggagtccccattgcagtaaggcatatcgaatcaatcattcgaatgtctgaggcacatgcaaagatgcatctgcgaagctatgtgtctcaggaagatgtggacatggccattcgtgtgctgcttgactcgttcatctcaacccagaaatttggtgtccagaaagcacttcagaagaatttccggaagtacatgacgtacaagaaggattacaatgaactgcttctgctccttctgcgcaccctggtcaaggaggcgctgcactttgaagaaatcgtgtctggatcaaccacacgcctgactcacgttgaggttaaagtggatgacctgaagaacaaggcccaagaatatgagatctacgacctgaggccgttcttctccagctctcacttcagtgacaacagctttgtcctcgatgaagggcgtgggatcatcaggcatccagttgcggcataacaactcaatcgacctcagccgatgacccttgtgtgatgaacagctacctctttgttcaagagctagtgatggagctagaaatgtccacatgtagtgtaagttggcaaaatgactgcttttgtctgttttatgggaattctgatattggtgtactgtttgctatctgaaacccttgtgcctccagtggcatttagagtgtctgtaccttcttgataccataattcagtgttatgcgactgatgccatcctcctacttgatattataattcagtgttatgcaactgacgcctttttt

SEQ ID NO: 811 - DNA, 3392 bp, Brachypodium distachyon
atggtgagcaaggcgaggccccctcctctcgcacaaccgcgtcgctctccggatctgacgtttccatcgggtgatttgctctttttccaggatgactcggagaacaacgcgccgtcgacgcccggctcgcccgggttcagcaccgaccggctcccgcccaacaccaccagccgcggcgcctccgacccgtcctcctactcggacgacgacggcgaggcggaggtcgaccccaacgtgatcccagatgacgatggcgccgccgtcgtcgccgacgaggaggaggaggacggggaggatctcttcaacgacaactacctcgatgactaccgaagaatggatgagcaggaccagtatgagtcggtcgggttagatgactcgatagaggatgagaggaaccttgatgagatcatggctgatcgaagggctgcggaagcagaacttcatgcaagggatgtgaggactggtgcgacagctgacagaaagttacctcgtatgcttcatgatcaagatacagatgatgatgatatgaacttcaggcgccccaaaaggcacagggctagttttagaccaccaggtggaccaagaacaccaagaagtgatgatgatggtgatggtgccacacctagttcacctggaagatctcagccttattctggtggtgatgtgcctacgactgatcagactgacgatgatggatatgaggatgaatttgatgaagaagatgagatgaacatgtaccgtgtgcaaggaacacttagagaatgggtcacaagagatgaagtccggcgcttcattgcaaagaaatttaaagaatttcttcttacatatgaaaaccctaagaatgaacaaggagagtttgagtatgttcgactaattaatgagatggttttagctaacaagtgtagtttggagatagactacaagcagtttatttatatacatccaaatattgccatctggctggctgatgcacctcagtcggtgctagaagttatggaggaagttggtaaaaatgttgttttcgatctccacaagaactataggaatatccatcaaaaaatatatgttagaataaccaaccttcctgtatatgatcaaatacgaaatatcagacaaattcatctgaacacaatgatacgaatcgggggcgttgttactcgacgatcaggcgtgtttcctcagctgcagcaggtcaagtatgactgcagcaaatgtggaactatcctgggccctttcttccagaactcttatactgaagtgagggttggatcttgtcctgaatgccagtcgaaaggaccatttactgtcaatattgagcaaactatatacaggaactaccagaaactcaccctccaggaaagccctggaattgtacctgctggcagactccccagatacaaggaagtaatacttctgaatgatcttatcgactgtgctcgtccaggagaagaaattgaggttacagggatctacacaaacaattttgacttgtcgttaaatacaaagaatggtttcccagtttttgccacggtggtggaggcaaactatgtggcaaaaaagcaggacctgttctctgcatacaaattaacggacgaggacaaggcagagattgagaagttatcaaaagatccacatatcagtgaaaggattatcaaatcaattgcaccatccatttacggtcatgaagatatcaagactgccattgcactagctatgtttgggggacaagaaaagaatgtgaagggaaagcatcgcctaaggggtgacataaatgtcctcctcttaggcgatccaggcactgcgaaatcccaatttctcaagtatgttgagaaaacaggacacagagctgtatacacaactgggaaaggagcttcagctgttggactcactgccgcagttcacaaggatcctgtaacacgggaatggacacttgagggaggtgcgctggttcttgctgatagaggcatatgtcttattgatgaatttgataagatgaatgatcaggatagggtaagtattcatgaagccatggagcagcaaagtatcagtatttcaaaggcaggaattgtcacatcccttcaagctcgatgcagtgttattgctgcagcaaacccagttgggggaagatatgattcttcgaagactttcactcagaatgttgaattgacggatccaattatttcacgttttgatgtcctttgtgttgtgaaggacatcgttgatccatttacggatgaaatgcttgcaaggtttgttgtggatagccatgccagatctcaacccaagggtgctaatcttgaagatagggtagtagctgatgaggaggatgatccattgactgttgctagacaagctgacccagatatcctttctcaagatatgctgaagaagtacattacatatgccaagctaaatgtatttcccaaaatacatgatgctgacctggacaagattagccatgtgtacgctgaacttcgacgtgaatcatctcacggtcaaggagtccctattgctgtaaggcatattgaatcaatcattcgaatgtctgaggcacatgcaaagatgcatttgagaagctatgtttctcaggaagatgttgacatggccatacgtgtgctacttgactcatttatttcaacccagaaatttggtgtccagaaagcacttcaaaagaatttccgcaaatacatgacttacaagaaggattacaatgagctgcttctgctcctcctgcgcacactggtgaaggacgcgttgcactttgaggaaatcgtgtcaggatcaacaacctgcttgactcacattgaggttaaagtggatgacctgaagaacaaggcccaggagtacgaaatctatgacctgaagccgttcttctccagcactcacttcaaggacaacagctttgtcctggacgaagggcgtggcatcatcaggcatcctattgcagcttaataactatctagactctgttgatgatgaactcatacctctttctggattaagagtgagggatgagtacctagtgacgtccacttgcagcgcaggcgatgaaatgacagctgctgcacacccgactggaattctgacatttgtgtattgtttctgttatctgaacctctagttttttgttggaaacatctattacatttagagatttgtgtaccctcttgacatggtacaatcttgaagtgttgtaaagagttgagtatttcctcttatcgtgtcggtcaagtatgatcctttcagggaatgcatgaaatgcagtataagatcgggtatccaacaaatcacatttcattcggtggtaaaaatgcgtagcgttgctgcatttgagtaatatatttacttgtaactaaagactgggagattgtaaaccgaaagaactgtaagtt

SEQ ID NO: 812 - DNA, 3596 bp, Brachypodium distachyon
atggatgagagggacaagcactggagaatgatcacgcatggagatgatggcatcaagcgtgtaaggattgaagatgatgccaccataaggagagatgaagacgtgggcgacatatggagtcttccaattcgtatttccgaccacgtgaagatatggcgagaggacctcactgatgtaatagactgggcgctgaacaccgtgggtcttgccatcttcggctcgctcgactccaatcgctgtgctgaccacctgggtggtggctgcgatgatgactcggagaacaacgcgccgtcgacgcccggctcgcccgggttcagcaccgaccggctcccgcccaacaccaccagccgcggcgcctccgacccgtcctcctactcggacgacgacggcgaggcggaggtcgaccccaacgtgatcccagatgacgatggcgccgccgtcgtcgccgacgaggaggaggaggacggggaggatctcttcaacgacaactacctcgatgactaccgaagaatggatgagcaggaccagtatgagtcggtcgggttagatgactcgatagaggatgagaggaaccttgatgagatcatggctgatcgaagggctgcggaagcagaacttcatgcaagggatgtgaggactggtgcgacagctgacagaaagttacctcgtatgcttcatgatcaagatacagatgatgatgatatgaacttcaggcgccccaaaaggcacagggctagttttagaccaccaggtggaccaagaacaccaagaagtgatgatgatggtgatggtgccacacctagttcacctggaagatctcagccttattctggtggtgatgtgcctacgactgatcagactgacgatgatggatatgaggatgaatttgatgaagaagatgagatgaacatgtaccgtgtgcaaggaacacttagagaatgggtcacaagagatgaagtccggcgcttcattgcaaagaaatttaaagaatttcttcttacatatgaaaaccctaagaatgaacaaggagagtttgagtatgttcgactaattaatgagatggttttagctaacaagtgtagtttggagatagactacaagcagtttatttatatacatccaaatattgccatctggctggctgatgcacctcagtcggtgctagaagttatggaggaagttggtaaaaatgttgttttcgatctccacaagaactataggaatatccatcaaaaaatatatgttagaataaccaaccttcctgtatatgatcaaatacgaaatatcagacaaattcatctgaacacaatgatacgaatcgggggcgttgttactcgacgatcaggcgtgtttcctcagctgcagcaggtcaagtatgactgcagcaaatgtggaactatcctgggccctttcttccagaactcttatactgaagtgagggttggatcttgtcctgaatgccagtcgaaaggaccatttactgtcaatattgagcaaactatatacaggaactaccagaaactcaccctccaggaaagccctggaattgtacctgctggcagactccccagatacaaggaagtaatacttctgaatgatcttatcgactgtgctcgtccaggagaagaaattgaggttacagggatctacacaaacaattttgacttgtcgttaaatacaaagaatggtttcccagtttttgccacggtggtggaggcaaactatgtggcaaaaaagcaggacctgttctctgcatacaaattaacggacgaggacaaggcagagattgagaagttatcaaaagatccacatatcagtgaaaggattatcaaatcaattgcaccatccatttacggtcatgaagatatcaagactgccattgcactagctatgtttgggggacaagaaaagaatgtgaagggaaagcatcgcctaaggggtgacataaatgtcctcctcttaggcgatccaggcactgcgaaatcccaatttctcaagtatgttgagaaaacaggacacagagctgtatacacaactgggaaaggagcttcagctgttggactcactgccgcagttcacaaggatcctgtaacacgggaatggacacttgagggaggtgcgctggttcttgctgatagaggcatatgtcttattgatgaatttgataagatgaatgatcaggatagggtaagtattcatgaagccatggagcagcaaagtatcagtatttcaaaggcaggaattgtcacatcccttcaagctcgatgcagtgttattgctgcagcaaacccagttgggggaagatatgattcttcgaagactttcactcagaatgttgaattgacggatccaattatttcacgttttgatgtcctttgtgttgtgaaggacatcgttgatccatttacggatgaaatgcttgcaaggtttgttgtggatagccatgccagatctcaacccaagggtgctaatcttgaagatagggtagtagctgatgaggaggatgatccattgactgttgctagacaagctgacccagatatcctttctcaagatatgctgaagaagtacattacatatgccaagctaaatgtatttcccaaaatacatgatgctgacctggacaagattagccatgtgtacgctgaacttcgacgtgaatcatctcacggtcaaggagtccctattgctgtaaggcatattgaatcaatcattcgaatgtctgaggcacatgcaaagatgcatttgagaagctatgtttctcaggaagatgttgacatggccatacgtgtgctacttgactcatttatttcaacccagaaatttggtgtccagaaagcacttcaaaagaatttccgcaaatacatgacttacaagaaggattacaatgagctgcttctgctcctcctgcgcacactggtgaaggacgcgttgcactttgaggaaatcgtgtcaggatcaacaacctgcttgactcacattgaggttaaagtggatgacctgaagaacaaggcccaggagtacgaaatctatgacctgaagccgttcttctccagcactcacttcaaggacaacagctttgtcctggacgaagggcgtggcatcatcaggcatcctattgcagcttaataactatctagactctgttgatgatgaactcatacctctttctggattaagagtgagggatgagtacctagtgacgtccacttgcagcgcaggcgatgaaatgacagctgctgcacacccgactggaattctgacatttgtgtattgtttctgttatctgaacctctagttttttgttggaaacatctattacatttagagatttgtgtaccctcttgacatggtacaatcttgaagtgttgtaaagagttgagtatttcctcttatcgtgtcggtcaagtatgatcctttcagggaatgcatgaaatgcagtataagatcgggtatccaacaaatcacatttcattcggtggtaaaaatgcgtagcgttgctgcatttgagtaatatatttacttgtaactaaagactgggagattgtaaaccgaaagaactgtaagttgtctttatcagtaagaaagatattgtt

SEQ ID NO: 813 - DNA, 2769 bp, Triticum aestivum
gaagcggaacttcatgcaagggatgtgaggactggtgcaacagctgatcgaaaattacctcgtatgcttcatgatcaggatacagatgaggatatgaacttcaggcgtcctaaaaggcacagggctaattttagacaaccaagtggaggaccaagaacacccagaagtgatgatgatggtgatggtctcactcctagttcacctggaagatctcagccatattctggcggtgatgtgcctatgactgatcagaccgatgatgatggatatgaggatgaatttgatgaagaagatgagatgaacatgtatcgtgtgcaaggaacacttcgagagtgggtcacaagagatgaagtccggcgcttcatcgcaaagaaatttaaagaatttcttcttacatatgtaaaccctaagaatgaacaaggagagtttgaatatgtcagactcattaatgagatggttttagctaacaagtgtagtttggagatagactacaagcaatttatttatatacacccaaacattgccatctggttggccgatgcacctcaatcggtgctggaagttatggaggaagtgggcaaaaatgttgtttttgatctccacaagaattacagaaacattcatcaaaaaatatatgtgcgaataaccaaccttcctgtctatgatcaaatacgcaatatcaggcaaattcatctgaacacaatgattcgaattgggggtgttgttactcgaaggtcaggtgtgttccctcagctgcagcaggtcaagtatgactgtagcaaatgtggaactgtcctgggtcctttcttccagaactcttacactgaagtaagggttgggtcttgccctgaatgccaatccaaaggtccatttactgtcaacattgagcaaactatatacaggaactatcagaaactcactcttcaggaaagcccagggattgttcctgctggcaggcttcccaggtacaaggaagtgatacttctgaatgatctgatcgactgtgctcgtccaggagaggaaattgaggttacagggatatacacaaacaattttgacctgtctttaaatacaaagaatggtttcccagtttttgccacagtggtggaggcaaactatgtatcaaagaagcaggacctgttctctgcatacaaattaacagatgaggacaaggcagagattgagaagttgtcaaaggatcctcgtatcagtgaaaggattgtcaaatcaattgcaccatccatttatggtcatgaagatatcaagactgccattgcactagctatgtttggggggcaagaaaagaacgtgaagggaaaacatcgcctaagaggtgatattaattgtctcctcttaggtgacccaggcactgcaaaatcccaatttctcaagtatgtcgagaaaacaggacacagggctgtatacacaactgggaaaggagcttctgctgttggactcaccgcagcagttcacaaggatccagtaacacgggagtggacacttgagggaggtgcactggttcttgctgatagaggcatatgccttattgatgaatttgataagatgaatgatcaagatagggtaagtattcatgaagccatggagcaacaaagtatcagcatatcaaaggcaggaattgtcacatcccttcaagctcgatgcagtgttattgctgcagcaaacccagttggaggaagatatgattcttcaaagacattcacccaaaatgttgagctaacagatccaattatttcacgttttgatgtcctctgtgttgtgaaggatattgttgacccatttacagatgaaatgcttgcaaggtttgttgttgatagccatgccagatctcagcccaagggtggtaaccttgaagatagagttgtagctgacgaggaggatgatccattgactgttgcccgaaatgctgacccagatatcctttctcaagacatgctgaagaagtatatcacatatgctaagttgaatgtattccccaaaatacatgatgctgacctggacaagattagccatgtctatgctgaacttcgacgtgaatcatctcacggtcaaggagtccccattgcagtaaggcatatcgaatcaatcattcgaatgtctgaggcacatgcaaagatgcatctgagaagctatgtgtctcaagaagatgttgacatggccattcgtgtgctgcttgactcattcatctcaacccagaaatttggtgtccagaaggcacttcagaagaatttccggaaatacatgacttacaagaaggattacaatgaactgcttctgctccttctgcgcaccctggtcaaggaggcgctgcactttgaagaaatcgtgttgggatcaaccgcacgcctgactcatgtcgaggttaaagtggatgacctgaagaacaaggcccaagagtacgagatctacgacctgaggccgttcttctccagctctcacttcagcgacaacagcttcgtcctggacgaagggcgtgggatcatcaggcatccagttgcagcataacaactcaatcaacatcagccgatgacccctgtgtgatgaacagctacctctttgttcaagagctagaaatgtccacttgtagtgtaagtcggcaaaatgactgcttgtgtctgttttgtgagagttctgatattggtgtactgtttgctatctgaaacccttgtgcctacagcggcatttcgagatgtctgtaccttcttgatatcataattcagtgtttatggaaaaagaaaagtaccgactgcg

SEQ ID NO: 814 - DNA, 4027 bp, Oryza sativa
cgccgacacaaatttctcactgtgctcctaccttttttgcctctgtaacagcggggagaatgggcaaaagtgggagcggcagcgatggcatcggcatgcggtgggagcagcggcggtcgtggcggcgcgtggtgggagcggcggccctgggggggggaggggaacggcggccgtggcaacgtgcggtcggagcagcagtggcctcggcgacgacggggaacatgggtgacggtaggagcggggaggagtcggcccgcggcgggagcagcggtggccgtggcagcgcgtggcgggccgcgacggcgggagcggcagaggcgtcgactcgaggtgggagcggcggtgacggcatcagcgcgcggtgggagcaggggaggccgcggcggcgtgcggcaacgtaactgacatgtgggccccacctaccagtcatcaatactgccttgggacctaaattagacagttttgtatagtttaggggtaaagatttctggttttatggttaagttgagggatctccggtgaacttattccaaaccactcccaaccacaacgcgagtccattgaactgggccagactaacgtaaatgggccgggccgaggcccaaagacatttccatccagttttgggcttcccccccgaactcaccagggcccacctcgcctgccacccccacctcctctgcgcgggaaaccgttgctcgttggcgccaatttttcccgccatttcgccccccgcgccgcctccctcttaaccccacctcctcctcctcccccaaccctagcagccactcctccccaccttactcccccccgcttccactcccccgaaccttccagaaccttctcccgctcccccgccgagatggatgactcggagaacaacgcgccgtcgacgccggggtcgccggggttcagcacagacaggctgccgccgaacaccaccaccagccgcggcgccaccgacccgtcctcctactcggacgacgacgacgacgacgtggttggcgcggaggaggcggaggtcgaccccaacgtgctccccgaggacgacggcgtcgtcgccgccgaggaggaggaggacggggaggacctcttcaacgacaactacctcgatgattaccggaggatggatgagcaggaccagtatgaatcggttgggttagatgactcgatagaggatgaaaggaacctggatgagatcatggcagatagaagggctgctgaagcagaacttgatgcaagggatgtgaggactggtgcagcacctgataggaaattgccacggatgctacatgatcaagacacagatgaggatatgagcttcaggcgtcctaaaaggcacagagctaattttagaccaccaagggaaccaagaacaccaagaagtgatgatgacggtgatggtgccacgcctagttcacctggaagatctcagcgtggaatgtattctggaggggatgtacctatgactgaccagactgatgatgatccatatgaggatgaatttgatgaagaagatgagatgaacatgtaccgtgtacaaggaactcttagagagtgggtcacaagagatgaagtccgccgctttatcgcaaagaagttcaaagaattccttctaacatatgtaaacccaaagaatgaacaaggagagtttgagtatgttcgactaatcaatgagatggttctagctaacaaatgcagcttagagatagattacaagcaatttatttatatacatccaaacattgctatatggttggctgatgcacctcaatcggtgctagaagttatggaggaagttgccaaaaatgttgtttttgatctccataagaactataggaacattcatcaaaaaatctatgtccgaataaccaatcttcctgtctacgaccaaatacgcaatatcaggcaaatccatctgaacacaatgattcgaattggtggtgttgttactcggagatcaggtgtttttcctcagctacaacaggtcaagtttgactgcagcaaatgtgggactgtcctgggccccttcttccagaactcttacactgaagtcaaggttggatcctgccctgagtgccaatccaaagggccattcaccatcaatgttgagcaaaccatatataggaactaccagaaactcactcttcaggaaagcccaggaattgttcctgctggcaggcttccaagatacaaggaagtgatacttctgaatgatttgattgactgtgctcgaccaggagaggaaattgaggtcactgggatatacaccaacaattttgacttgtctttgaatacaaagaatggtttcccagtttttgccacagtagtggaggcaaactatgtggcaaaaaaacaggatctgttctctgcttacaaattaactgatgaggacaaggcggagattgagaagttggcaaaagatccacggatcggtgaaaggattgtcaaatcaattgcaccatccatatatggtcatgaagatatcaagactgccattgcactagctatgtttggggggcaagagaagaatgtcaagggaaagcatcgcttgagaggagatatcaatgtactcctcttaggtgatccaggcactgcaaaatcccaatttctcaagtatgttgagaaaactggacacagagcagtgtacacaactggaaaaggagcttctgctgttggactcaccgcagcagttcacaaggatccagtaacacgggaatggacacttgagggtggtgcactagtgcttgctgatagaggcatatgccttattgatgaatttgataagatgaacgatcaagatagggtgagtattcatgaggccatggagcaacaaagtatcagtatatcaaaggccggaattgtcacatcccttcaagctcggtgcagtgttattgctgcagcaaacccaataggaggaagatatgattcatcgaagacattcacccagaatgttgaactgacggatccaattatttcacgttttgatgtcctttgtgttgtgaaggacattgttgacccatttacagatgaaatgcttgcaaggtttgttgtagatagtcatgcaagatctcaacccaagggtgctaaccttgaagatagggttccaactgatgttgaggatgatccattggctgctgccagacaagctgacccagatatcctttctcaagacatgctgaagaagtacataacttatgccaagttgaacgtgtttcccaaaattcatgatgctgacctggacaagattagccatgtttacgcagaacttcgtcgtgagtcatctcatggtcaaggagtccctattgccgtaaggcatatcgaatccattattcggatgtcagaggcacatgcaaggatgcatttgaggagctacgtgtctcaggaagatgtcgacatggctatccgcgtcctgcttgactcatttatttcaactcagaagtttggtgtacagaaagcacttcaaaagaatttcaggaaatacatgacctataagaaggattacaatgagctgctcttgcttcttctgcgcaccctggtcaaggatgtgctgcacttcgaagaaatcgtttcaggaccaacgacgcgcctgactcacatcgaggttaaagtagaggacctgaagaacaaggcccaggagtacgaaatctatgacctgagaccgttcttctccagcgcccacttcagggacaacaacttcgtcctcgacgaagggcgggggatcatcaggcaccctcttgctgcctaactacagaagatcatctgtgacccatctgacaatgaacaatttgagctacctcatgggattatcagacatagtgtaatcatcaaatggcaactcctttgtgctttttagagactgttgcatgttatccagctgcatttggatagggtgtaccgtgtgtactttcttaacattgtaattctgcaagtatggtagaaaatgataaatctgtgtcaatcaatgtatcattgttttgcattattgttttcatttttttcctcatccgatgaagctataattttg

SEQ ID NO: 815 - DNA, 3216 bp, Oryza sativa
ctagcagccactcctccccaccttactcccccccgcttccactcccccgaaccttccagaaccttctcccgctcccccgccgagatggatgactcggagaacaacgcgccgtcgacgccggggtcgccggggttcagcacagacaggctgccgccgaacaccaccaccagccgcggcgccaccgacccgtcctcctactcggacgacgacgacgacgacgtggttggcgcggaggaggcggaggtcgaccccaacgtgctccccgaggacgacggcgtcgtcgccgccgaggaggaggaggacggggaggacctcttcaacgacaactacctcgatgattaccggaggatggatgagcaggaccagtatgaatcggttgggttagatgactcgatagaggatgaaaggaacctggatgagatcatggcagatagaagggctgctgaagcagaacttgatgcaagggatgtgaggactggtgcagcacctgataggaaattgccacggatgctacatgatcaagacacagatgaggatatgagcttcaggcgtcctaaaaggcacagagctaattttagaccaccaagggaaccaagaacaccaagaagtgatgatgacggtgatggtgccacgcctagttcacctggaagatctcagcgtggaatgtattctggaggggatgtacctatgactgaccagactgatgatgatccatatgaggatgaatttgatgaagaagatgagatgaacatgtaccgtgtacaaggaactcttagagagtgggtcacaagagatgaagtccgccgctttatcgcaaagaagttcaaagaattccttctaacatatgtaaacccaaagaatgaacaaggagagtttgagtatgttcgactaatcaatgagatggttctagctaacaaatgcagcttagagatagattacaagcaatttatttatatacatccaaacattgctatatggttggctgatgcacctcaatcggtgctagaagttatggaggaagttgccaaaaatgttgtttttgatctccataagaactataggaacattcatcaaaaaatctatgtccgaataaccaatcttcctgtctacgaccaaatacgcaatatcaggcaaatccatctgaacacaatgattcgaattggtggtgttgttactcggagatcaggtgtttttcctcagctacaacaggtcaagtttgactgcagcaaatgtgggactgtcctgggccccttcttccagaactcttacactgaagtcaaggttggatcctgccctgagtgccaatccaaagggccattcaccatcaatgttgagcaaaccatatataggaactaccagaaactcactcttcaggaaagcccaggaattgttcctgctggcaggcttccaagatacaaggaagtgatacttctgaatgatttgattgactgtgctcgaccaggagaggaaattgaggtcactgggatatacaccaacaattttgacttgtctttgaatacaaagaatggtttcccagtttttgccacagtagtggaggcaaactatgtggcaaaaaaacaggatctgttctctgcttacaaattaactgatgaggacaaggcggagattgagaagttggcaaaagatccacggatcggtgaaaggattgtcaaatcaattgcaccatccatatatggtcatgaagatatcaagactgccattgcactagctatgtttggggggcaagagaagaatgtcaagggaaagcatcgcttgagaggagatatcaatgtactcctcttaggtgatccaggcactgcaaaatcccaatttctcaagtatgttgagaaaactggacacagagcagtgtacacaactggaaaaggagcttctgctgttggactcaccgcagcagttcacaaggatccagtaacacgggaatggacacttgagggtggtgcactagtgcttgctgatagaggcatatgccttattgatgaatttgataagatgaacgatcaagatagggtgagtattcatgaggccatggagcaacaaagtatcagtatatcaaaggccggaattgtcacatcccttcaagctcggtgcagtgttattgctgcagcaaacccaataggaggaagatatgattcatcgaagacattcacccagaatgttgaactgacggatccaattatttcacgttttgatgtcctttgtgttgtgaaggacattgttgacccatttacagatgaaatgcttgcaaggtttgttgtagatagtcatgcaagatctcaacccaagggtgctaaccttgaagatagggttccaactgatgttgaggatgatccattggctgctgccagacaagctgacccagatatcctttctcaagacatgctgaagaagtacataacttatgccaagttgaacgtgtttcccaaaattcatgatgctgacctggacaagattagccatgtttacgcagaacttcgtcgtgagtcatctcatggtcaaggagtccctattgccgtaaggcatatcgaatccattattcggatgtcagaggcacatgcaaggatgcatttgaggagctacgtgtctcaggaagatgtcgacatggctatccgcgtcctgcttgactcatttatttcaactcagaagtttggtgtacagaaagcacttcaaaagaatttcaggaaatacatgacctataagaaggattacaatgagctgctcttgcttcttctgcgcaccctggtcaaggatgtgctgcacttcgaagaaatcgtttcaggaccaacgacgcgcctgactcacatcgaggttaaagtagaggacctgaagaacaaggcccaggagtacgaaatctatgacctgagaccgttcttctccagcgcccacttcagggacaacaacttcgtcctcgacgaagggcgggggatcatcaggcaccctcttgctgcctaactacagaagatcatctgtgacccatctgacaatgaacaatttgagctacctcatgggattatcagacatagtgtaatcatcaaatggcaactcctttgtgctttttagagactgttgcatgttatccagctgcatttggatagggtgtaccgtgtgtactttcttaacattgtaattctgcaagtatggtagaaaatgataaatctgtgtcaatcaatgtatcattgttttgcattattgttttca

SEQ ID NO: 816 - DNA, 3300 bp, Setaria italica
tggcggtgtctcgtgcaggatgactcggagaacaacgccccctcgacgccggggtcccccgggttcagcaccgaccggctgccgcccaacaccaccaccagccgcggcgccaccgacccgtcgtcctactccgacgacgacggcgaggcggaggtcgacccccacgtgctccccgaggacgacgaccccgccgccgccgcgccggccgacgaggaggacgaggagggcgaggacctcttcaacgacaactacctcgatgattaccgaaggatggatgagcatgatcagtatgagtcagttggtttagatgactcgttggaggatgagaggaatcttgatgaaattatggctgatcgaagggctgcagaagtggagcttgatgcaagggatgtgaggactggtccagcagctgaccggaaattgccaaggatgctccatgatcaggatacagatgaggatatgaattttaggcgtcctaaaaggcacaggactagttttagaccacctagtggaccaagaacaccaagaagtgatgatgatggtgatggtgccactcctagttcaccaggaaggtctcagcgtggctattctggtggtgatgtgcctatgactgaccagactgatgatgacccatatgaggatgaatttgatgaagaagatgagatgaacatgtaccgtgtccaaggtacactaagagagtgggtcacaagagacgaagtccggcgcttcattgcaaagaaatttaaagagttcctccttacatatgtaaacccaaagaatgagcaaggagagtttgagtatgttcggcttattaacgagatggttttagctaacaagtgtagcttggagatagactacaagcagtttatttatatacatccaaacattgccatctggttggctgatgcacctcaatcagtgctggaagttatggaggaagtagccaaaaatgttatttttgatctccacaagaattacaggaacatccaccaaaagatctatgtccgaataaccaaccttcctgtctatgatcaaatacgcaatattaggcaaatccatctcaacacaatgattcgaattggtggtgttgttactcgacgatctggtgtcttccctcagttgcagcaggtgaagtatgactgtagcaaatgtggaactatcctgggccctttcttccagaactcctacactgaagtgaaagttggatcatgccctgaatgccagtccaaaggaccattcacagtcaatgttgagcagactatatataggaactaccagaaactcactcttcaggagagcccgggaattgttcctgctggcaggcttcccagatacaaggaagtcattcttttgaatgatctgattgattgtgctcgtccaggagaggaaattgaggtcactgggatatacacaaacaattttgacttgtctttgaatacaaagaatggtttccctgtttttgctacagtggtagaggccaactatgtggcaaaaaagcaggatctcttttctgcatacaaattaaccgacgaggataaggcagagattgagaagttgtccaaggatccaaggattggggaaaggattgtcaaatcaattgcaccatccatttatggccatgaagatattaagactgccattgcactagctatgtttggcggacaagagaagaatatcaagggaaaacatcgcctaagaggcgatatcaacgtcctcctcatgggtgatccaggcactgcaaaatctcagtttctaaagtatgtggagaaaacaggacacagagcggtatatacaactggaaaaggagcctctgctgttggtctcactgcagcggttcacaaggatccagtaacacgagaatggacactcgagggaggtgcactagttcttgctgataggggcatatgccttattgatgaatttgacaagatgaatgatcaagatagggtgagtatacatgaagccatggagcaacaaagtatcagtatatcgaaggcaggaatcgtcacatctcttcaggctcgatgcagtgttattgcagcagcaaacccaataggaggaagatatgattcatcaaagacattcactcaaaatgttgaattgacggatcccattatttcacgttttgacatcctttgcgtggttaaggatattgttgatccattcacggatgaaatgcttgcaaggtttgttgtagatagtcatgccaggtcccaacccaagggagctaaccttgaagacagggttccaaccgatgtgaatgatgatccattagctgctgcaagacaagctgatccagatgtcctttctcaagacatgctgaagaagtacataacttatgctaagctgaatgtatttcccaaaatacatgatgccgacctggacaagattagccatgtttatgctgaactccgacgcgagtcctctcatggtcaaggggttccgattgcagtcaggcatatagaatcaatcatccgaatgtcagaggcacatgcgaggatgcatttgaggagctacgtgtctcaggaagatgttgacatggccatccgtgtcttgcttgactcttttatttccactcagaaattcggtgtgcagaaagcacttcagaagaatttcaggaaatacatgacatataagaaggattacaatgagttgcttctgctcctcctgcgcacactggtcaaggatgctctgcactttgaagaaatcgtgtcaggagcaacctcacgcctcactcacgtcgaggtcaaagtggaagacctgaagaacaaggcccaagagtacgagatctacgacctgaagccgttcttctccagtgcacacttcagagacaacagcttcatcctggatgaagggcgcggcatcatcaggcatccagtggcagcatgacaactcacttacctcctgtctacgattagcgtagcttgacaccctggatgaacagctgcagccgccacttgcaggctaatcaaactactgagagtgtccgactgccttaccaggagatagattgttgtgcgtttatttcaacttctgtatggcttgactgggttcagagtgtgtcatgtaaagtgtccaaacattgtgttgtcttaatgggatcattggtgctcaatggtattatttagacaatttccttggtgtaatgagttaatgaccttgtcttcatacacagaacaatgtagttagcatcaattgccagtacttgggtagttgggttgttttttcatttgagcttgtagttgtattgtatgaggtgcccctggaattttactgacctgggcaagataaggccatgtc

SEQ ID NO: 817 - DNA, 3193 bp, Saccharum officinarum
ccttcccgccgctccctaaaccctagccgcgcccattgccgccgctcgcctcagcctcctctgcccagtgccttcttgttcgccggcggaatggatgactcggagaacaacgcgccctcgacgccggggtcccccgggttcagcaccgaccgtttgccgcccaacaccaccagccgcggcgccaccgacccgtcctcctactccgacgacgatggcgaggcggaggtcgaccctcacgtgctccccgatgatgacgaccccgccgccgcagtggcccctgacgaggacgaggagggggaggatctcttcaacgacaactacctcgatgattaccgaaggatggatgagcatgatcagtatgaatcaggtggtttagacgattcactcgaggatgagaggaatcttgatgaaatcatggctgatcgaagggccgcggaagcggagcttgatgcaagggatgtgaggactggtgcagcagctgacaggaagttgccacggatgctccatgatcaggatacagatgaggatatgaatttcaggcgtcctaaaaggcatagggctagttttagaccaccaagtggaccaagaacaccaagaagtgatgatgatggtgatggtgccactcctagttcacctggaagatctcagcgtggaatgtactccggtggtgatgtgcctatgactgatcagactgatgatgacccatatgaggatgaatttgatgaagaagatgagatgaacatgtaccgtgtccaaggtacattgagagagtgggtcacaagagatgaagtccgtcgctttattgcaaagaaattcaaagagttccttcttacatatgttaacccaaagaacgatcaaggagagattgagtatgttcggcttattaacgagatggttttagctaacaagtgtagcttggaaatagactacaaacagtttatttatatacatccaaacattgccatctggctggcggatgcacctcaatcagtgcttgaagttatggaggaagttgccaaaaatgttgtttttgatctccacaagaattataggaacatccaccaaaagatctatgtccgaataacgaaccttcctgtctatgatcaaatacgcaatatcaggcaaatccatctgaacacaatgattcgaattggtggtgttgttacccgacgatctggtgtattccctcagttgcagcaggtgaagtatgactgtagcaaatgtggaactatcctgggccctttcttccagaactcctacactgaggtgaaagtcggatcatgccctgaatgccaatcgaaagggccattcacagtcaatgttgagcagactatatataggaactaccagaaactcactcttcaggaaagcccaggaattgttcctgctgggcggcttcccagatacaaggaagtaatacttctgaatgatctgattgactgtgctcgtccaggagaggagattgaggtcactgggatatacacaaataattttgacttgtctttgaatacaaagaatggtttccctgttttcgccacagtggttgaggcaaactatgtggcaaaaaagcaggatctgttttctgcatacaaattaactgacgaggataaggcagagattgagaagctgtcgaaagatccaaggattggagaaaggattgtcaagtcaattgcaccatccatttacggccatgaagatatcaagactgccattgcactcgctatgtttggtggacaagagaagaatgtgaagggaaaacatcgcctaagaggcgatatcaatgtcctcctcctgggtgatccaggcactgcaaaatcacagtttctcaagtatgtggagaaaacaggacacagagcagtatatacaactggaaaaggagcctctgctgttggtcttactgctgcggttcacaaggatccagtaacacgagaatggacacttgagggaggcgcactagttcttgctgataggggcatttgcctcattgacgagtttgacaagatgaatgatcaagatagggtaagtattcatgaagctatggagcaacaaagtatcagtatatcaaaagcaggaatcgtcacatctcttcaagctagatgcagtgttattgctgcagcaaacccaataggtggaaggtatgattcatcaaagacattcactcagaatgttgaattgacagatcccattatttcacgttttgacgtcctctgcgtggttaaggatattgttgatccatttacagatgaaatgcttgcaaggtttgttgtagacagtcatgccagatcccaacccaagggggctaaccttgaagacagggtttcaaccgatgtggatgatgatccactggccgctgcaagacaagctgacccagatgtcctttcccaagacatgctgaagaaatacataacttatgctaagctgaatgtatttcccaagatacatgatgccgatctagataagattagccatgtttatgctgaactccgtcgtgaatcatctcatggccaaggggttcctattgcagtaaggcatatagaatcaatcattcgaatgtcggaggcacatgcaaggatgcatctgaggagctacgtgtctcaggaagatgttgacatggccatccgtgtcttgcttgactcttttatttcaactcagaaattcggtgtgcagaaagcacttcaaaagaatttccggaaatacatgacattcaagaaggattacaacgaactgcttctgctccttctgcggacactggtcaaggatgccctgcactttgaagagatcatgtcaggatcaacctcgcgccttactcacgtcgaggtcaaagtggaggacctgaggaacaaggcccaagaatatgagatctacgatctgaagccgttcttctccagcgcacacttcagggacaacagcttcgttctggatgaagggcgtgggatcattaggcatccactggcggagtgacaactgactcgactcctgtctagaacggtagaaccggcctcgttacggccctgggatgaagtgaacagccacagtggcctcctggatgaagagcgatgatcagattcagatctgacctcatttcttttaagcatacaaatgacactgggacaatcgccttttcaggactgatttagtatctgttgtgtaattgtgttattatattcaagagcttcatatttagacgtctata

SEQ ID NO: 818 - DNA, 3198 bp, Sorghum bicolor
cggtcgcgtcgcgtttccgtcgtgcaggatgactcggagaacaacgcgccctcgacgccggggtcccccgggttcagcaccgaccggttgccgcccaacaccaccagccgcggcgccaccgacccgtcctcctactccgacgacgatgacgaggcggaggtcgaccctcacgtcctccccgatgacgacgaacccgcggctgtggcccccgacgaggacgaggagggggaggacctcttcaacgacaactacctcgatgattaccgaaggatggacgagcatgatcagtacgagtcagttggtttagatgattcactcgaggatgagaggaatcttgatgaaatcatggctgatcgaagggctgctgaagtggagcttgatgcaagggatgtgaggtctggtacagcagctgacaggaagttgccacggatgcttcatgatcaggatacagatgaggatatgaatttcaggcgtcctaaaaggcacagggctagttttagaccaccaagtggaccaagaacaccaagaagtgatgatgatggtgatggtgccactcctagttcacctggaaggtctcagcgtggaatgtactctggtggtgatgtgcctatgactgatcagactgatgatgacccatatgaggatgaatttgatgaagaagatgagatgaacatgtaccgtgtccaaggtacattgagagagtgggtcacaagagatgaagtccgtcgctttattgcaaagaaattcaaagaattccttcttacatatgttaacccaaagaacgatcaaggagacattgagtatgttcggcttattaacgagatggttttagctaacaagtgtagcttggaaatagactacaagcagtttatttatatacatccaaacattgccatctggttggctgatgcacctcaatcggtgcttgaagttatggaggaagttgccaaaaatgttatttttgatctccacaagaattataggaacatccaccaaaagatctatgtccgaataacgaaccttcctgtctatgatcaaatacgcaatatcaggcaaatccatctgaacacaatgattcgaattggtggtgttgttacccgacgatctggtgtattccctcagttgcagcaggtgaagtatgactgtagcaaatgtggaactatcctgggccctttcttccagaactcctacactgaggtgaaagttggatcatgccctgaatgccaatccaaagggccattcacagtcaatgttgagcagactatatataggaactaccagaaactcactcttcaggaaagcccaggaattgttcctgctgggcggcttcccagatacaaggaagtaatacttctgaatgatctgattgactgtgctcgtccaggagaggaaattgaggtcactgggatatacacaaataattttgacttgtctttgaatacaaagaatggtttccctgtttttgccacagtggttgaggcaaactatgtggcaaaaaagcaggatctgttttctgcatacaaattaactgatgaggataagacagagattgagaagttgtcgaaggatccaaggattggagaaaggattgtcaagtcaattgcaccatccatttacggccatgaagatatcaagactgccattgcacttgctatgtttggtggacaagagaagaatgtgaggggaaagcatcgcctaagaggcgatatcaatgtcctcctcctgggtgatccaggcactgcaaaatcacagtttctcaagtatgtggagaaaacaggacacagagcagtatatacaactggaaaaggagcctctgctgttggtcttactgctgcggttcacaaggatccagtaacacgagaatggacacttgagggaggtgcactagttcttgctgataggggcatttgcctcattgacgagtttgacaagatgaatgatcaagatagggtaagtattcatgaagctatggagcaacaaagtatcagtatatcaaaagcaggaatcgtcacatctcttcaagctagatgcagtgttattgctgcagcaaacccaatagggggaaggtatgattcgtcaaagacattcactcagaatgttgaattgacggatcccattatttcacgttttgacgtcctctgcgtggttaaggatattgttgatccatttacagatgaaatgcttgcaaggtttgttgtagacagtcatgctagatcccagcccaagggggctaaccttgaagacagggtttcaactgatgtggatgatgatccactggccgctgcaagacaagctgacccagatgtcctttcgcaagacatgctgaagaagtacataacttatgctaagctgaatgtatttcccaaaatacatgatgctgatctagataagattagccatgtttatgctgaactccgtcgtgaatcctctcatggccaaggggttcctattgcagtaaggcatatagaatcaatcatccgaatgtcggaggcacatgcaaggatgcatctgaggagctatgtgtctcaggaagatgttgacatggccatccgtgtcttgcttgattcttttatttcaactcagaaattcggtgtgcagaaagcacttcaaaagaatttccggaaatacatgacattcaagaaggattacaacgagctgcttctgctccttctgcgtacactggtcaaggatgccctgcactttgaagaaatcatggcaggatcaacctcgcgccttactcacgtcgaggtcaaagtggaggacctgaagaacaaggcccaagagtatgagatctatgatctgaagccgttcttctccagcgcgcacttcagggacaacagcttccttctggatgaagggcgtgggatcatcaggcatccactggcagaataataactgactttcctcctgtttagaaccggcctttgtcgttgtggccctgggatgaagtgaacagccacagaggcctcctggatgaagagcgatgatcagatctgacatcatttcttataagctagcatacaaatgacgctggcagtcggcttctcaggatttagtgtctgttgtgttatattgaagagatcctatatttgaacgtctatgcactttgctgccatttaggtgtaactatacggtatgtcaaatcatttgttagataaatgatatgggtgtgactgcgtgcaacaataaaaacaaaag

SEQ ID NO: 819 - DNA, 3385 bp, Sorghum bicolor
cctcgcccccgtctgccctccgcccctctaaaccctaaccgtgccccaccgccgctcgccccgagcagcctcctctgagccgcccagagcctcccctttcgccggcggaatggatgactcggagaacaacgcgccctcgacgccggggtcccccgggttcagcaccgaccggttgccgcccaacaccaccagccgcggcgccaccgacccgtcctcctactccgacgacgatgacgaggcggaggtcgaccctcacgtcctccccgatgacgacgaacccgcggctgtggcccccgacgaggacgaggagggggaggacctcttcaacgacaactacctcgatgattaccgaaggatggacgagcatgatcagtacgagtcagttggtttagatgattcactcgaggatgagaggaatcttgatgaaatcatggctgatcgaagggctgctgaagtggagcttgatgcaagggatgtgaggtctggtacagcagctgacaggaagttgccacggatgcttcatgatcaggatacagatgaggatatgaatttcaggcgtcctaaaaggcacagggctagttttagaccaccaagtggaccaagaacaccaagaagtgatgatgatggtgatggtgccactcctagttcacctggaaggtctcagcgtggaatgtactctggtggtgatgtgcctatgactgatcagactgatgatgacccatatgaggatgaatttgatgaagaagatgagatgaacatgtaccgtgtccaaggtacattgagagagtgggtcacaagagatgaagtccgtcgctttattgcaaagaaattcaaagaattccttcttacatatgttaacccaaagaacgatcaaggagacattgagtatgttcggcttattaacgagatggttttagctaacaagtgtagcttggaaatagactacaagcagtttatttatatacatccaaacattgccatctggttggctgatgcacctcaatcggtgcttgaagttatggaggaagttgccaaaaatgttatttttgatctccacaagaattataggaacatccaccaaaagatctatgtccgaataacgaaccttcctgtctatgatcaaatacgcaatatcaggcaaatccatctgaacacaatgattcgaattggtggtgttgttacccgacgatctggtgtattccctcagttgcagcaggtgaagtatgactgtagcaaatgtggaactatcctgggccctttcttccagaactcctacactgaggtgaaagttggatcatgccctgaatgccaatccaaagggccattcacagtcaatgttgagcagactatatataggaactaccagaaactcactcttcaggaaagcccaggaattgttcctgctgggcggcttcccagatacaaggaagtaatacttctgaatgatctgattgactgtgctcgtccaggagaggaaattgaggtcactgggatatacacaaataattttgacttgtctttgaatacaaagaatggtttccctgtttttgccacagtggttgaggcaaactatgtggcaaaaaagcaggatctgttttctgcatacaaattaactgatgaggataagacagagattgagaagttgtcgaaggatccaaggattggagaaaggattgtcaagtcaattgcaccatccatttacggccatgaagatatcaagactgccattgcacttgctatgtttggtggacaagagaagaatgtgaggggaaagcatcgcctaagaggcgatatcaatgtcctcctcctgggtgatccaggcactgcaaaatcacagtttctcaagtatgtggagaaaacaggacacagagcagtatatacaactggaaaaggagcctctgctgttggtcttactgctgcggttcacaaggatccagtaacacgagaatggacacttgagggaggtgcactagttcttgctgataggggcatttgcctcattgacgagtttgacaagatgaatgatcaagatagggtaagtattcatgaagctatggagcaacaaagtatcagtatatcaaaagcaggaatcgtcacatctcttcaagctagatgcagtgttattgctgcagcaaacccaatagggggaaggtatgattcgtcaaagacattcactcagaatgttgaattgacggatcccattatttcacgttttgacgtcctctgcgtggttaaggatattgttgatccatttacagatgaaatgcttgcaaggtttgttgtagacagtcatgctagatcccagcccaagggggctaaccttgaagacagggtttcaactgatgtggatgatgatccactggccgctgcaagacaagctgacccagatgtcctttcgcaagacatgctgaagaagtacataacttatgctaagctgaatgtatttcccaaaatacatgatgctgatctagataagattagccatgtttatgctgaactccgtcgtgaatcctctcatggccaaggggttcctattgcagtaaggcatatagaatcaatcatccgaatgtcggaggcacatgcaaggatgcatctgaggagctatgtgtctcaggaagatgttgacatggccatccgtgtcttgcttgattcttttatttcaactcagaaattcggtgtgcagaaagcacttcaaaagaatttccggaaatacatgacattcaagaaggattacaacgagctgcttctgctccttctgcgtacactggtcaaggatgccctgcactttgaagaaatcatggcaggatcaacctcgcgccttactcacgtcgaggtcaaagtggaggacctgaagaacaaggcccaagagtatgagatctatgatctgaagccgttcttctccagcgcgcacttcagggacaacagcttccttctggatgaagggcgtgggatcatcaggcatccactggcagaataataactgactttcctcctgtttagaaccggcctttgtcgttgtggccctgggatgaagttaacagccacagaggcctcctggatgaagagcgatgatcagatctgacatcatttcttataagctagcatacaaatgacgctggcagtcggcttctcaggatttagtgtctgttgtgttatattgaagagatcctatatttgaacgtctatgcactttgctgccatttaggtgtaactatacggtatgtcaaatcatttgttagataaatgatatgggtgtgactgcgtgcaacaataaaaacaaaagaaaagaaaacaaaaatacagtcgaataataactataaatgcagcaacggatagattttgtttttagattttggtagcagtatcatatattctgatttaaaat

SEQ ID NO: 820 - DNA, 3463 bp, Zea mays
ctgccctccgccccctaaaccctagccgtttcccatagccgctcgccccagcctcctctgcccagagacttttctttgcggccgaaatggatgactcggagaacaacgcaccctcgacgccggggtcccccgggttcagcaccgaccggctgccacccaacaccaccaccagccgcggcgccaccgacccgtcatcttactccgacgacgatggcgaagctgaggtcgatcctcacgtgctacccgatgacgacgaccccgccgctgtagcggctcccgacgaggacgaggagggggaggacctcttcaacgacaactacctcgatgattaccgaaggatggatgagcatgatcaatatgagtcagttggtttagatgattcactcgaggatgagaggaatcttgatgaaatcatggctgatcgaagggccgcggaagcggagcttgatgcaagggaagtgaggactggtgcaacagctgataggaagctgccacgaatgctccacgatcaggatacagatgatgatacgaatttcaggcgtcctaaaaggcacagggctagttttagacaaccaagtggaccaagaacaccaagaagtgatgatgatggtgatggtgccactcctagttcacctggaagatctcatcgtggaatgtcatctggtggtgatgtgcctatgactgatcagactgatgatgacccatatgaggatgaatttgatgaagaagatgagatgaacatgtaccgtgtccaaggtacattgagagagtgggtcacaagagatgaagtccgtcgctttattgcaaagaaatttaaagaatttcttctgacatatgttcatccgaagaacgatcaaggagagtttgagtatgttcggcttattaatgagatggttttagctaacaagtgtagcctggaaatagactacaagcagtttatttatatacatccaaacattgccatctggttggctgatgcgcctcaatcggtgcttgaagttatggaagaagttgccaaaaatgttgtttttgatcttcacaagaattataggaacatccaccaaaagatctatgttcgaatatcgaaccttcctgtctatgatcaaatacgcaatatcaggcaaatccatctgaacacaatgattcgaattggtggtgttgttacccgacgatctggtgtattccctcagctgcagcaggtgaagtatgactgtaacaaatgtggaactatcctgggccctttcttccaaaactcctacactgaggtgaaagttggatcatgccctgaatgtcaatccaaagggccattcacagtcaatgtcgagcaggcatgttaccttaaacacactatatataggaactaccagaaactcactcttcaggaaagcccaggaattgttcctgctggaaggcttcccagatacaaggaagtcatacttctgaatgatctgattgactgtgctcgtccaggagaggagattgaggtcactgggatatacacaaataattttgacctgtctttgaatacaaagaatggtttccctgtttttgccacagtggttgaggcaaactatgtggcaaaaaaacaggatttgttttctgcatacaaattaacggacgaggacaaagcagagattgagaagttgtcaaaggatccaaggattggagaaaggattatcaaatcaattgcaccatccatttacgggcatgaagatatcaagactgccattgcacttgctatgtttggtggacaagagaagaatgtgaagggaaaacatcgcctgagaggcgacatcaatgtcctcctcctgggtgatccaggcactgcaaaatcacagtttcttaagtatgtggagaaaacaggacacagagcagtatatacaactggaaaaggagcctctgctgttggtcttactgctgcagttcacaaagatccagtaacacgagaatggacacttgagggaggtgcactagttcttgctgataggggcatttgcctcattgatgagtttgacaagatgaatgatcaagatagggtaagtattcatgaagctatggagcaacagagtatcagtatatcaaaagcaggaatcgtcacatctcttcaagctagatgcagtgttattgctgcggcaaacccagtagggggaaggtatgattcatcaaagacattcactcagaatgtcgaattgacggatcccattatttcacgtttcgacgtcctctgtgtggttaaggatattgtcgatccatttacagatgaaatgctcgcaaggtttgttgtagatagtcacgccagatcccagcccaagggggctaaccttgaagacagggtttcaactgatgtggatgatgatccactggctgctgcaaggcaagctgacccagatgtcctttcccaagacatgctgaagaaatacataacctatgctaagctgaatgtgtttcccaaaatacatgatgccgatctagacaagattagccatgtttatgctgaactccgccgtgaatcctctcatggccaaggggttcctattgcagtaaggcatatagagtcaatcatccggatgtcggaggcacatgcaaggatgcatctgaggagctacgtgtctcaggaagatgttgacatggccatccgtgtcttgcttgactcttttatttcgactcagaagttcggtgtgcagaaagcacttcaaaagaatttccggaagtacatgacattcaagaaggactacaacgagctgctcctgctgctcctgcgcacactggtcaaggacgccgtgcacttcgaagaaatcatggcaggatcagcctcacgtcttactcacgtcgaggtcaaattggaggacctgaggaacaaggcccaagaatacgagatctacgatctgaagccgttcttctccagcgcgtgcttcagggacaacggcttccttctggatgaagggcgtgggatcatcaggcatccactggcggagtaacaactgagaactgatcttcctcatgtctagaaccggcctttgtctgttacggccctgagatgaagagtgatgatatctgacctcatttgttataggcatacaattgacacttggctggtcgccttttggatttagtatctgttgtgtcttgtttgagagtttcgtactatatgcacttgctgccatttaggcgtgactgtatggtgtgtgaaatcattcgttagatagaatgatcggtgtggctgcaagcaacaaatagttagaaaaagaaacaaaaacgaactgcagccaaaagaccctgagggttattgaagatgatgaatgcatcagttgccatgccttagaagaagagtatgctaagcttttccatcaacccttgtctgacgaatatgtggctgccttagctgccctctttggctgttctgttcagttacaaccttttgtagatagaattgtagatcaactctccggatggaaatcatatt

SEQ ID NO: 821 - DNA, 3177 bp, Musa acuminata
atgcaacttcttctcctggaaatttcaagagcaacctactggatggataattcggataacccaccgtcgacccccggatcgccggcctcggcggggttcagcactgatcggctgcctcataacacgagccgcacaaccgattcctactctgacgatgacgaggccgccgtcgaccctcatgtctttgtggacgacgacggtggcgacggcgatggtaacaaggaggacgaggaaggcgaggatctgtacaatgacaactacatggaagattaccgtcggatggatgatcaagaccggtacgagacggtggggatggacgactccatggaggatgagagggatctggaccaaatcatggccgacagaagggcggcagaggtggaacttgatgtgagggatggccgcaatggtggcatccttgaccggaaattaccccagatgctttacgatcaagacatggatgatgatatcaactttagacgtccaaaaagattcagggctgattttaggccaccagctggtggacgaagtgaagatgacactgagggttcaacacaaagctcaccaggaaggttccaacgaggacactcaagagacgatgtgccagtcactgatcaaacggatgatgaccaatatgaggatgagtatgatggtgaagatgatattatgtgtcatgtccaaggaactctaagggaatgggtcacaagagatgaagttcgtcggtttatcgcaaagaaatttaaagattttcttcttacttacgtgaatcctaagaatgaacatggagacattgaatatgttcgactgattaatgagatggttttagctaacaagtgcagtctggagatagattacaagcaattcatctacactgaggcaaatattgctatatggttggctgatgcaccacagtcagtgcttgaagttatggaagaagttgccaagaatgttgtctttgatatgcacaagaactacaaaaacattcatcagaaaatttttgtccgtataactaatctgccagtatatgatcagatacgtaacattaggcagattcatctgaacacaatgattcgtataggaggtgttgttactcggcgatctggagtttttcctcagttacaacaggtaaaatatgattgcaacaaatgcggggctattcttggccctttctttcagaactcatattcagaagttaaagtgggctcatgtcctgaatgccaatcaaaaggaccattcactatcaatgttgaacagacaatatacaggaattatcagaaacttacccttcaggaaagtcctggaattgtgcctgctggtagacttccaagatacaaggaagtgatacttttaaatgatttgattgactgtgctcgtcctggagaagaaattgaggttacaggcatatatacaaacaattttgacttatctttgaatactaagaatgggtttcctgtatttgccaccgtggttgaagcaaactatgttaccaaaaagcaagaccttttctctgcctacaaacttacagatgaggacaaagcagagattgagaagctggccaaggatccaaggattggagaaaggatcgtcaaatctattgcaccatcgatttatggtcatgaagatattaagatggctattgcacttgcgatgtttggaggacaagaaaagattgtccaaggaaaacatcggttaaggggtgatataaatgtactcctactgggtgatccaggaactgcaaaatcccaattccttaagtatgttgaaaagacaggccatagagctgtttacacaacaggtaaaggagcttctgcagttggacttactgcagcagttcacaaagacccagtaacaagggaatggacccttgaaggaggtgctcttgtcctggctgatagaggagtttgcttaatagatgagtttgacaaaatgaatgatcaggacagagtgagtatccatgaggccatggaacaacagagcattagtatatcaaaggctggaattgttacgtcactccaggccaggtgcagcgtcatcgctgcagcaaatccagtaggaggaagatatgactcatcgaagacttttacccaaaatgtagagctgactgatcctatcatatcacgatttgatatcctttgcgttgttaaggatattgttgatcctgtcactgatgaaatgcttgcaagatttgtcgtggacagccatgccaaatcacagccaaagggtgctactcttgaagatcagcctgcaagcaatactcaagatgaacttgcctcttccagaccagttgacccggagattctttctcaagacatgctcaagaagtatataacatatgctaaactgaatgtcttccctaagttgcatgatgctgatttagacaaattcaaacatgtctatgctgacatacgtcgagaatcatctcatggtcaaggaattcgaatagcagtgaggcacattgagtcgatgattcgaatgtcagaagcacatgcaagaatgcacttgcgtaactatgtttgccaagaagatgaggacatggcaatacgcgtcctgcttgattcttttatctccagccagaaatttggtgtgcaaaaggctttacaaaagagttataggaaatacatgacattcaagaaggatttcaatgaattgctcttgcatcttctgcgtatacttgtgaaggatgcattgcactttgaagaaattgtatctgggacaactgctcgtctcacacacatcgaggtgaaggtggaagagctaagaaacaaggcccaggaatacgaaatctatgatctgaagccattcttctccagtgcacatttcacaagtagcaatttcattttggacgaaagtcgtggggtgatcaagcatccattggcaagatgaagcatgaaaggtttcttttgtatctagttgagtgcagcatgcaactaattttactggtaatttcaagagcaacctcctggatggcttcttctaagggcagcttcccggccactgttagtagtgcttgaaagctgcatgagcagattatacagcaacatgttcgacacctgtgcgtgctcatggctactaaactcgggctatatttattactaagatctctgaccaaaactgcttgtgtttgttttcttttatgttgcaattgtaatctctagacaacgacccaatggcccttac

SEQ ID NO: 822 - DNA, 3324 bp, Quercus alba
ttgtagccctcctcctggctaaaagcctaaacgcacaaaacaaatcgccgctcttaaaaaaaactaacagcaaatatctgaggagaaatggctggaggagaagacggagggaactccggagagaatccggcgcctgtctcaacgccggaatcaccgacctccgccggattcaacaccgatcagatccctcgcacttccgagaacttcacagacgatgacgacatcgacatcgacatcgacgacgaggccgccgtggatcccgaaatcatccgagacgagccggaagaggtcgaggaagaggacgacggagaggaccttttccacgacactttcttggatgattatcggagaatggatgagcaaggaccagtacgagtcggtggactggatgactcgcttgaggacgagagagatttggatcagatcatgcaggaccgtagggctgccgacttggagctcgacgctcgcgaggttcgcgtcactggacgcaagcttcctgagcttctccatgaccaagacacagatgatgacaactacaggccttcaaagaggtctagagctgatttcaggcctcctcctgtgccaagaagctatgatgacaatgatggaatgcaaagttcacctggaagatcacagcggggacactcaagagaggatgtgcccatgactgatcagactgatgatgatcaatatgaggatgaagatgatgatgaaggcgagtttgagatgtatcgtgtccagggaacactaagagagtgggttactagggatgaagtgcgtcgctttatagcaaagaagttcaaggattttctactcacatatgtcaatccaaagaatgagcatggtgacttcgaatatgttaggctaataaatgagatggtgtcagctaataagtgtagcttggagattgattacaaacagtttatttatatccatcccaatattgccatctggctggctgatgccccccaatccgtcttagaagtcatggaagatgttgccaagaatgtcgtctttaatttacatccaaactacaaaaatatccatcaaaagatctatgtccgcattaccaacttacctgtttacgatcagattcgtaatattaggcaaatccatttgaataccatgattcgtattgggggagttgtgactcgacgctctggggttttcccccagttgcaacaggtaaagtatgattgcaacaaatgtggggcagttttggggccattctttcagaattcatattcagaagtgaaggttggttcctgcccagaatgccaatcaaaaggaccatttactgtcaatattgagcagacagtatacaggaattaccaaaagcttacactccaagaaagccctggaattgtgcctgcaggtcggcttcctagatacaaggaagtgatactgttgaacgatttgattgattgtgctcgccctggggaagagattgaggtcacaggtatttatacaaataattttgacttatccttgaatacaaagaatgggtttcctgtatttgccactgtggtcgaagcaaactacgtcacaaagaagcaggacctcttttctgcttacaaacttacccaggaagacaaagaagagatagaaaagttggctaaagaccccagaataggagaaaggattgtcaagtccattgccccgtctatctatggccatgaagatataaaaacagcaattgccctggccatgtttggagggcaagagaaaaatgtcgaggggaaacacagattgcgaggggacataaatgtgcttctcctaggtgatccaggcacagcaaagtctcaatttctaaagtatgttgaaaagactgggcagagggctgtatatactactggtaaaggagcttctgctgtgggtctcacagcagcagtgcacaaggacccggtcacaagggagtggacccttgaaggaggggcccttgttcttgctgataaaggaatttgccttattgatgagtttgacaagatgaatgatcaggacagggtgagtattcatgaggcaatggagcagcagagtattagcatatcaaaggctggaattgtcacttctcttcaggcacgatgctctgtgattgcggcagcaaatcctattgggggaagatatgattcctcaaaaacattttcacagaatgttgagttgacagatcccattgtttctcgatttgatatcctctgtgttgtaaaggatatcgttgatcctgtgacagatgagatgcttgcaaagtttgtagttgatagccattttaagtcgcaacctaagggtgctaacatggatgataggtctgtaagtgaatcccatgaagataatcaagcaactgccaggccagttgatactgagatacttcctcaagatctgctaaagaagtacttaacttatgccaagttgaatgtattcccaaggttgcatgatgctgatttggataagctaacacatgtttatgctgaactgcgaagagaatcttcgcatggacaaggagtgcccatagcagtgaggcacatagaatccatgatacgaatgtctgaagcacatgccagaatgcacctcagacagcatgtcacacaggaagatgtagacatggccattcgtgtcctgcttgattcattcatttcaacccaaaagtttggggtacagaaagcactgcaaaagagtttcagaaagtacatgactttcaagaaggattacaatgaactgctattatatcttcttcgtgagcttgtcaagaatgcactgcacttcgaagaaattgttagtgggtctacttcaaggcttacccagattgatgtgaaagtagaggatttgcagagcaaggcacaggaacatgaaatctatgatctgaaacccttctttaccagcccccacttttctagagctgattttgtgttggatgaacagaggggagtgattaggcatcgccttgcaagaatatgaaaaatatattgtgtatgagctttccctagttaggttcattaatcagtagccttggaagaaactatttaagaaatgatttctcgagagcaattgaagtaattaattacgttgttttaattttttaaatgacttaaagatgtgtctgataggatcctagatatgattaatagcatgtcaatacattataatgaacgaaataccttgactaatggttaatggagaactatttctagcaatcagataaccgtctgtatcattgaatatatttagtaccaattgttctcagttttgggcatgtacttaccatacagctgagtaccagattgaaatttccttcaggctggcttttgaacactttttttttttaggttcaaa

SEQ ID NO: 823 - DNA, 3149 bp, Aquilegia formosa
tcgaaactctcatctctgcaatagacaagaagaagacgaagaagaagaagaatctcagaaagaacagagattttcttctttaatggataattccgacaatccatcaacacctggatctccaacatctgctggatttagcacagatcgacttccaccaaacactagtgggacaaatgagtcctactctgatgaggacgaagctgcagtagatcccgagattatacgcgacgaacctgaggaagttgaggaagaagaagatggagaggatctctttaacgacaattacatggatgattatcggcgaatggaagagcatgatcaatatgagtctgttggtcttgatgattcaatggaagatgagagagatttggatcagattatggcagatcgaagagctgctgaagtagaacttgatacgaaagaagggcgtaatagtaatcggaagcttcctcggcttttgcacgaccaagacacagatgaggatattaactacaggcgtccgaaaagatctagagccgatttcaggcctccggcagatgcaagaagctatgatgatgctgatgcaatgcaaagttcacccggtagatcccagcgtggacattctagagatgatgtacctatgaccgatcaaacagatgatgagccctatgaggatgatgatgatgatgaaggagagttcgagatgtaccgtgttcaaggaacgctaagggaatgggttaccagagatgaagtccgtcgcttcattgcaaagaaatttaaggagtttttgctcacatatgttaatccaaagaatgaacaaggagaatttgaatacatccggctgataaatgagatgatgagagttaacaagtgcagtttggagattgactataagcagttcatctatatacatcctaacattgccatctggcttgctgatgcaccccaatctgttcttgaggttatggaggaagtcgccaagaatgtagtgtttaacttacacccaaattacaaagaaattcatcaaaagatctatgtaaggatcactaatcttccagtctatgaccagatacgcaacattaggcagatacatctgaataccatgattcgtattggaggagttgtaacacgacgaactggggtttttccccaattgcagcaggtcaagtatgattgcaataaatgtggaacaattctggggccattttttcagaattcatattcagaagtcaaggtgggatcttgccctgaatgtcaatcaaaaggaccattcactgtcaatattgagcagacaatttacagaaactatcagaagctcactcttcaggaaagcccaggaattgtacctgctggccgacttcctagatacaaggaagtaatacttttgaatgatctaattgactgcgcgcgtccaggagaagaaattgaggtcacaggcatatacacaaataactttgatttatctttaaatacgaaaaatggttttcctgtatttgccacggtggttgaagcaaactatgtcacaaagaagaaagatcttttctctgcgtacaagcttactgtggaagacactaacgaaatcgagaatttgggcagggatcccagaattggagaaaggataatcaagtccatagccccttcaatatatggacatgaagacattaaaactgcgctagctcttgcaatgtttggcgggcaagaaaagaatgttcaagggaaacatcgcttgagaggagatattaatgtgcttctcttgggagatcctggcacagccaaatcacagttcctcaagtatgtcgaaaaaacggggcaaagggctgtgtatactactggcaaaggggcttctgctgttggtcttactgcagcagtacacaaggaccctgttacaagggagtggacccttgaaggaggagctcttgtcctagcagatagaggtatctgtcttattgatgaattcgacaagatgaatgatcaggacagagtgagtattcacgaagccatggagcaacaaagcattagcatctcaaaggcagggattgtcacatctcttcaggctcgctgctctgtaattgctgctgcgaatcctattggaggaagatacgattcttcgaagaacttttcacaaaatgttgagctgacggatccaattgtttctcgttttgatgttctttgcgttgtgaaggatgtggttgatccagttgtagatgaaatgcttgcaagttttgttgtgaatagccacttcaaatcacaacctaagggtgctaacttggatgatacatctatgaacaactcccaagaagaagatccatcatcaactaggctagtagatcccgagatactctctcaagacatgctaaagaagtacattacctatgcaaaattgaatatacaaccaagattgaatgaggctgatctgaataagcttacacatgtttacgctgaactgcgcagagaatcttcgcatggacaaggagttcctatagctgttagacacatagagtcgatgataaggatgtctgaagcacacgctagaatgcacctcaggaaggatgtggcgcaagaagatgtggacatggccatacgagttttacttgattcatttatttctactcaaaagtttggggtccagaaggctcttcaaaagagcttcagaaagtacatgacattcaagaaggaatttaatgacctcctcttgtatcttcttcgcgggcttgtgagggatgccatgcactttgaagaacttgtgaatggatcggctgcaggtcttacacatattgacgtgaaggttaaagatctggagaacaaggcccaggagtatgaaatttacgacttgaagcctttcttcaccagcaccctgttctcgggagccaactttgacttagatgaagagcgaggaataataaagcatcggttagcaggatgaggataaatatctataccaggattgctgcattagagctctaatgtggattgaaccaagatccagttttgcttgaccatctaccatctttggtttattttcatgtcatgggattggacagagagtggttcataagaatattgtatacaaagttattaactgctagataccatatttatgaacttgcagtaagcgaatgagtgttctctttattgaaaagatgatataatatactatcttgtatttgctc

SEQ ID NO: 824 - DNA, 1248 bp, Triticum aestivum
gctcagctcccgtctctcctcgagatctcccacgggccaaggccaggagccaacaaacgcaaggccaccgccgcctctgcgcctccgcagtcgccgttctgcgatcttgcccgccgccgcccggagagatggcgaaggcgttttacgcggtgggtttctggatccgggagaccggtcaggccctcgaccgcctcggctgtcgcctccaggggaactacttcttccacgagcagatttcaaggcatcgcacacttatgaacatctttgacaaagcccctcatgttcacaaagaggcatttgtcgctccaagtgcatcccttattggcgatgttgaagttgggcaagggtcttcaatttggtacggatgcgtcttaagaggtgatgcaaataacgttcaagttggatctgggaccaatatacaggacaattctgttgtgcatgtggcaaaatctaatctaagtggaaaagtctttccaactatcattggagacaatgtcacagtagggcatagtgctgtattacaaggatgcactgttgaggatgaagcttttgttggtatgggagctaccctgttagatggtgttgttgtggaaaagcatgggatggttgctgctggagcccttgtaagacagaacacgaggatcccttgtggagaggtatggggtggaaaccctgcaaaatttctgaggaagctcacagacgaggagatcgcttttattgcggaatcagctgccaactattccaacttagccaaggcacatgctgttgagaatgctaaacccttggaaaagattgattttgagaaagtgctgcgcaagaaatttgctcaccaggacgatgaacacgattccatgcttagtgtcactcgagaggtccctccagagctggcgccccccagtcctactcctgcccaataagcttttcttatcaccaccttcagtttggattcttatatctctatctgtccagtgagtttggcagtttacttttacttcagtaattttgggtcgagcaatgttctaaagctgaccatgtacttcagtttctgtattccatatgttcaagatccatggaacaaatagatccatttcgcacaaatttaccagtagcatgcgctgcgtgcatagtttactctggctgaaattgcgagatgcactggaggcagcacatgaactgttggcctgtagttaaatgcttaattgaataaatattttgataacaaaaagtactgaaggacaaattttattg

SEQ ID NO: 825 - DNA, 1237 bp, Triticum aestivum
cccctcagctcagctcccctctctcctcgagatctcccacgggccaaggccaggagccaacaaacgcaaggccaccgccgcctctgcgcctccgcagtcgccgttctgcgatcttgcccgccgccgcccggagagatggcgaaggcgttttacgcggtgggtttctggatccgggagaccggtcaggccctcgaccgcctcggctgtcgcctccaggggaactacttcttccacgagcagatttcaaggcatcgcacacttatgaacatctttgacaaagcccctcatgttcacaaagaggcatttgtcgctccaagtgcatcccttattggcgatgttgaagttgggcaagggtcttcaatttggtacggatgcgtcttaagaggtgatgcaaataacgttcaagttggatctgggaccaatatacaggacaattctgttgtgcatgtggcaaaatctaatctaagtggaaaagtctttccaactatcattggagacaatgtcacagtagggcatagtgctgtattacaaggatgcactgttgaggatgaagcttttgttggtatgggagctaccctgttagatggtgttgttgtggaaaagcatgggatggttgctgctggagcccttgtaagacagaacacgaggatcccttgtggagaggtatggggtggaaaccctgcaaaatttctgaggaagctcacagacgaggagatcgcttttattgcggaatcagctgccaactattccaacttagccaaggcacatgctgttgagaatgctaaacccttggaaaagattgattttgagaaagtgctgcgcaagaaatttgctcaccaggacgatgaacacgattccatgcttagtgtcactcgagaggtccctccagagctggcgccccccagtcctactcctgcccaataagcttttcttatcaccaccttcagtttggattcttatatctctatctgtccagtgagtttggcagtttacttttacttcagtaattttgggtcgagcaatgttctaaagctgaccatgtacttcagtttctgtattccatatgttcaagatccatggaacaaatagatccatttcgcacaaatttaccagtagcatgcgctgcgtgcatagtttactctggctgaaattgcgagatgcactggaggcagcacatgaactgttggcctgtagttaaatgcttaattgaataaatattttgataacaaaaagtact

SEQ ID NO: 826 - DNA, 1083 bp, Triticum aestivum
ccgccgccgctgccgccccgagagatggcaaaggcattttacgcggtggggttctggatccgggagaccggtcaggccctcgaccgcctcggctgccgcctccaggggaactacttcttccacgagcagatttcaaggcatcgcacacttatgaacatctttgacaaagcccctcatgttcacaaagaggcatttgtcgctccaagtgcatcccttattggtgatgttgaagttggacaagggtcttcaatttggtacggctgcgtcttaagaggggatgcaaataacgttcaagttggatctgggacgaatatacaggacaattctgttgtgcatgtggcaaaatctaatctaactgggaaagtctttccaaccatcattggagacaatgtcacagtaggacatagtgctgtattacaaggatgcactgttgaggatgaagcttttgttggtatgggagcaaccctgttagatggtgttgttgtggaaaagcatgggatggttgctgctggagcccttgtaagacagaacacaaggatcccttgtggagaggtatggggcggaaaccctgcgaaatttctgaggaagctcacagatgaggagattgcttttattgcggaatcagctgccaactactccaacttagccaaggcacacgctgttgagaatgccaaacccttggaaaagattgattttgagaaagtgttgcgcaagaaagttgctcaccaggacgaggaacacgattccatgcttagtggcactcgagaggtccctccagagctggcgccacccagccctacccctgctcaataagctttggttatctgtttttttttcctttctttggtgccttcaccgtcttcagtttgaattcttattatatctctatctgtgcagtgagtttggcagtttacgtttatttcaataattttgggtcgagcaatgttctaaagctgaccatgtagttcagtttttgtattccataagttttaagatctatggaacaaacagaaccatttcacacaaatttaccagtagcgttcactgcgtgcatagtttactctggctgaaattgtgagatgc

SEQ ID NO: 827 - DNA, 1302 bp, Leymus cinereus x Leymus triticoides
  misc_feature (613)..(613): n is a, c, g, or t
  misc_feature (617)..(617): n is a, c, g, or t
  misc_feature (674)..(674): n is a, c, g, or t
  misc_feature (680)..(680): n is a, c, g, or t
  misc_feature (710)..(710): n is a, c, g, or t
  misc_feature (722)..(722): n is a, c, g, or t
  misc_feature (728)..(728): n is a, c, g, or t
  misc_feature (810)..(810): n is a, c, g, or t
  misc_feature (848)..(848): n is a, c, g, or t
  misc_feature (866)..(866): n is a, c, g, or t
  misc_feature (875)..(875): n is a, c, g, or t
  misc_feature (967)..(967): n is a, c, g, or t
  misc_feature (1050)..(1050): n is a, c, g, or t
  misc_feature (1138)..(1138): n is a, c, g, or t
  misc_feature (1143)..(1143): n is a, c, g, or t
  misc_feature (1147)..(1147): n is a, c, g, or t
  misc_feature (1151)..(1151): n is a, c, g, or t
  misc_feature (1161)..(1161): n is a, c, g, or t
  misc_feature (1166)..(1166): n is a, c, g, or t
  misc_feature (1181)..(1181): n is a, c, g, or t
  misc_feature (1228)..(1228): n is a, c, g, or t
  misc_feature (1255)..(1255): n is a, c, g, or t
  misc_feature (1257)..(1259): n is a, c, g, or t
  misc_feature (1264)..(1266): n is a, c, g, or t
gcacgaggctcccctctcctcgagatctcccaagggccaaggccaggagccaacaaacgcaaggccacggccgcctctgcgcctccgcagtcgccgttctgtgatcttgcccgccgccgccctgagagatggcgaaggcgttttacgcggtggggttctggatccgggagaccggtcaggccctcgaccgcctcggctgtcgcctccaggggaactacttcttccacgagcagatttcaaggcatcgcacacttatgaacatctttgacaaagcccctcatgttcacaaagaggcatttgtcgctccaagtgcatcccttattggtgatgttgaagttgggcaagggtcttcaatttggtacggatgcgtcttaagaggtgatgcaaataacgttcaagttggatctgggaccaatatacaggacaattctgttgtgcatgtggcaaaatctaatctaagtgggaaagtctttccaaccatcattggagacaatgtcacagtaggacatagtgctgtattacaaggatgcactgttgaggatgaagcttttgttggtatgggagctaccctgttagatggtgttgttgtggaaaagcatgggatggttgctgntggngcccttgtaagacagaacacaaggatccctcgtggagaggtatggggtggaaacccngcaaantttctgaggaagctcacagatgaggagatngcttttattgcngaatcngctgccaactattccaacttagccaaggcacacgctgttgagaatgctaagcccttggaaaagattgattttgagaaagtgntgcgcaagaaatttgctcaccaggacgaggaacacgantccatgcttagtgtcacncgagaggtncctccagagctggcgccccccagtcctactcctgtccaataagcttttcttatcaccatcttcccccagtccaactcctgcccaataagctnttcttatcaccatcttcagtttggattcttatatctctatctgtccagtgagtttggcagtttacgtttacttcagtaatttngggtcgagcaatgttctaaagctgaccatgtacttcagtttctgtattccatatgtttaagatccatggaacaaacagaaccatttcncacanattnaccngtagcatgcnctgcntgcatagtttactcnggctgaaattgcgagatgcactggaggcagcacatgaactgttggcntgtagttaaatgcttaattgaataaanannntgatnnnataagtactgaaggataaattttattgatgaattga

SEQ ID NO: 828 - DNA, 1044 bp, Secale cereale
ccgccgccgccgtgagagatggcgaaggcgttttacgcggtggggttctggatccgggagaccggtcaggccctcgaccgcctcggctgccgcctccaggggaactacttcttccacgagcagatttcaaggcatcgcacacttatgaacattattgacaaagcccctcatgttcacaaagaggcatttgtcgctccaagtgcatcccttattggtgatgttgaagttggacaagggtcttcaatttggtacggctgcgtcttaagaggtgatgcaaataacgttcaagttggatctgggacgaatatacaggacaattctgttgtgcatgtggcaaaatctaatctgagcgggaaagtctttccaaccatcattggagacaatgtcacagtaggacatagtgctgtattacaaggatgcactgttgaggatgaagctttcgttggtatgggagcgaccctgttagatggtgttgttgtggaaaagcatgggatggttgctgctggagcccttgtaagacagaacacaaggatcccttgtggagaggtatggggcggaaaccctgcgaaatttctgaggaagctcacagatgaggagattgcttttattgcggaatcggctgccaactattccaacttagccaaggcacacgctgttgagaatgccaagcccttggaaaagattgattttgagaaagtgttgcgcaaggaagttgctcaccaggacgaggaacacggttccatgcttagtggcactcgagaggtccctccagagctggcaccacccagccctacccctgctcaataagctttggttatctgtttcccaccctttctttggtgccttcaccgtctctatctgagcactgtgtttggcggtttacgattatttcaataattttgggtcgagcaatgttctaaagctgaccatgtagttcagtttttgactttttgtattccataagttttaagatctatggaacaaactgaaccatttcacacaaatttaccagtagcgtgcactgcgtgcatacctgactctggc

SEQ ID NO: 829 - DNA, 1313 bp, Secale cereale
cgaaacgcgagaaggtaccaatggggggaggaactactctacccaagggacaagggccacggagccaacaaaccgcaacggccgacccgccggccctctgccggcctcccgcagtcgcccgttctgcgatcttgcccgccgccgccctgagagatggcgaaggcgttttacgcggtgggtttctggatccgggagaccggtcaggccctcgaccgcctcggctgtcgcctccaggggaactacttcttccacgagcagctttcaaggcaccgcacacttatgaacatctttgacaaagcccctcatgttcacaaagaggcatttgtcgctccaagtgcatctcttattggcgatgttgaagttgggcaagggtcttcaatttggtacgggtgcgtcttaagaggtgatgcaaataacgttcaagttggatctgggaccaatatacaggacaattctgttgtgcatgtggcaaaatctaatctaagtggaaaagtctttccaaccatcattggagacaatgtcacagtaggacatagtgctgtattacaaggatgcactgttgaggatgaagcatttgttggtatgggagctaccctgttagatggtgttgttgtggaaaagcatgggatgattgctgctggagcccttgtaagacagaacacaaggatcccttgtggagaggtatggggtggaaaccctgcaaaatttctgaggaagctcacagacgaggagatcgcttttattgcagaatcagctgccaactattcgaacttagccaaggcacacgctgttgagaatgctaaacccttggaaaagattgattttgaggaagtgctgcacaagaaatttgctcaccaggacgaggaccacgattccatgcttagtgtcactcgagaggtccctccagagctggcgccccctagtcctacccctgcccaataagctttccttatcaccatctttagtttggattcttatatctctctgtccagtgagtttggcagtttatgtttacttcagtaattttgggtcaagcaatgtaagctgaccatatacttcagtttctgtattccatatgtttaagatccatggaacaaacagaaccatttcgcacaaatttaccagtagcatgcgctgcgtgcatagtttactctggctgaaattgcgagatgcactggagtctggaggcagcacataaactgttgtcctgtagttaaatgcttaattgaataaatattttgataacataaagtactcaaaaaaaaaaaaaaagaaaaaaaaataaatactgtgtgtatactactgtctctgta

SEQ ID NO: 830 - DNA, 1228 bp, Secale cereale
ttcccagtctctccctcctcgagatctctcccaagggcaaggccaggagccaacaaacgcaaggccaccgccgcctctgcgcctccgcagtcgccgttctgcgatcttgcccgccgccgccctgagagatggcgaaggcgttttacgcggtgggtttctggatccgggagaccggtcaggccctcgaccgcctcggctgtcgcctccaggggaactacttcttccacgagcagctttcaaggcaccgcacggacttatgaacatctttgacaaagcccctcatgttcacaaagaggcatttgtcgctccaagtgcatctcttattggcgatgttgaagttgggcaagggtcttcaatttggtacgggtgcgtcttaagaggtgatgcaaataacgttcaagttggatctgggaccaatatacaggacaattctgttgtgcatgtggcaaaatctaatctaagtggaaaagtctttccaaccatcattggagacaatgtcacagtaggacatagtgctgtattacaaggatgcactgttgaggatgaagcatttgttggtatgggagctaccctgttagatggtgttgttgtggaaaagcatgggatgattgctgctggagcccttgtaagacagaacacaaggatcccttgtggagaggtatggggtggaaaccctgcaaaatttctgaggaagctcacagacgaggagatcgcttttattgcagaatcagctgccaactattcgaacttagccaaggcacacgctgttgagaatgctaaacccttggaaaagattgattttgaggaagtgctgcacaagaaatttgctcaccaggacgaggaccacgattccatgcttagtgtcactcgagaggtccctccagagctggcgccccctagtcctacccctgcccaataagctttccttatcaccatctttagtttggattcttatatctctctgtccagtgagtttggcagtttatgtttacttcagtaattttgggtcaagcaatgtaagctgaccatatacttcagtttctgtattccatatgtttaagatccatggaacaaacagaaccatttcgcacaaatttaccagtagcatgcgctgcgtgcatagtttactctggctgaaattgcgagatgcactggagtctggaggcagcacataaactgttgtcctgtagttaaatgcttaattgaataaatattttgataacataaa

SEQ ID NO: 831 - DNA, 1165 bp, Secale cereale
accatttttactatccgttcggagatgctctcggctcatttcccctctctcccctagatctcccgacgcaacaaacgcaaggcaaccggcgcctctgcgcatccgaagtcgccgcctctgcgatcttgcccgccgccgccgccgccgccgccgccgccgtgagagatggcgaaggcgttttacgcggtggggttctggatccgggagaccggtcaggccctcgaccgcctcggctgccgcctccaggggaactacttcttccacgagcagatttcaaggcatcgcacacttatgaacatcattgacaaagcccctcatgttcacaaagaggcatttgtcgctccaagtgcatcccttattggtgatgttgaagttggacaagggtcttcaatttggtacggctgcgtcttaagaggtgatgcaaatacgttcaagttggatctgggacgaatatacaggacaattctgttgtgcatgtggcaaaatctaatctaagcgggaaagtctttccaaccatcattggagacaatgtcacagtaggacatagtgctgtattgcaaggatgcactgttgaggatgaagctttcgttggtatgggagcgaccctgttagatggtgttgttgtggaaaagcatgggatggttgctgctggagcccttgtaagacagaacacaaggatcccttgtggagaggtatggggcggaaaccctgcaaaatttctgaggaagctcacagatgaggagattgcttttattgcggaatcggctgccaactattccaacttagccaaggcacacgctgttgagaatgccaagcccttggaaaagattgattttgagaaagtgttgcgcaaggaagttgctcaccaggacgaggaacacggttccatgcttagtggcactcgagaggtccctccagagctggcaccacccagccctacccctgctcaataagctttggttatctgtttcccaccctttctttggtgccttcaccgtctctatctgagcactgtgtttggcggtttacgtttatttcaataattttgggtcaagcaatgttctaaagctaaccatgtagttcagtttttgtattgcataagttttaagatctatggaacaagccgaaccatttcacacaaatttaccagtagcgtgcactgcgt

SEQ ID NO: 832 - DNA, 1115 bp, Pseudoroegneria spicata
  misc_feature (9)..(10): n is a, c, g, or t
gcgttctanncggtggggttctggatccgggagaccggtcaggccctcgaccgcctcggctgtcgcctccaggggaactacttcttccacgagcagatttcaaggcatcgcacacttatgaacatctttgacaaagcccctcatgttcacaaagaggcatttgtcgctccaagtgcatcccttattggcgatgttgaaattgggcaagggtcttcaatttggtacggatgcgtcttaagaggtgatgcaaataatgttcaagttggatctgggaccaatatacaggacaattctgttgtgcatgttgcaaaatctaatctaagtggaaaagtctttccaaccatcattggagacaatgtcacagtaggacatagtgctgtattacaaggatgcactgttgaggatgaagcttttgttggtatgggagctaccctgttagatggtgttgttgtggaaaagcatgggatggttgctgctggagcccttgtaagacagaacacaaggatcccttgtggagaggtatggggtggaaaccctgcaaaatttctgaggaagctcacagacgaggagatcacttttattgcagaatcagctgccaactattccaacttagccaaggcacacgctgttgagaatgctaaacccttggaaaagattgattttgagaaagtgctgcgcaagaaatttgctcaccaggatgaggaacacgattccatgcttagtgtcactcgagaggtccctccagagctggcgccccccagtcctactcctgcccaataagctttccttatcaccatcttcagtttggattcttgtatctctatctgtccagtgagtttggcagtttacgtttacttcagtaattttgggtcgagcaatgttctaaagctgaccatgtacttcagtttctgtattccatatgtttaagatccatggaacaaacagaaccatttcgcacaaatttaccagtagcatgcgctgcgtgcatagtttactctggctgaaattgcgaggtgcactggaggcagcacatgaactgttggcctgtagttaaatgcttaattgaataaacattttgataacaaaaagtactgaaggataatttttattgatga

SEQ ID NO: 833 - DNA, 1448 bp, Triticum aestivum
attgcataccacgttttacatccgttgggagatgctcccggctcagctcccctctctcctctagatctcccggcgcaacaaacgcaaggccaccggcgcctccgcgcatccgcagtcgccgcctctgcgatcttgcccgccgccgccgccgctgccgccccgagagatggcaaaggcattttacgcggtggggttctggatccgggagaccggtcaggccctcgaccgcctcggctgccgcctccaggggaactacttcttccacgagcagatttcagggcatcgcacacttatgaacatctttgacaaagcccctcatgttcacaaagaggcatttgtcgctccaagtgcatcccttattggtgatgttgaagttggacaagggtcttcaatttggtacggctgcgtcttaagaggggatgcaaataacgttcaagttggatctgggacgaatatacaggacaattctgttgtgcatgtggcaaaatctaatctaactgggaaagtctttccaaccatcattggagacaatgtcacagtaggacatagtgctgtattacaaggatgcactgttgaggatgaagcttttgttggtatgggagcaaccctgttagatggtgttgttgtggaaaagcatgggatggttgctgctggagcccttgtaagacagaacacaaggatcccttgtggagaggtatggggcggaaaccctgcgaaatttctgaggaagctcacagatgaggagattgctttcattgcggaatcagctgccaactattccaacttagccaaggcacacgctgttgagaatgccaagcccttggaaaagattgattttgagaaagtgctgcgcaagaaattcactcaccatgacgaggaacacgattccatgcttagtggcactcgagaggtccctccagagctggcgccacccagccctacccctgctcaataagctttggttatctgtttttttttcctttctttggtgccttcaccgtcttcagtttgaattcttattatatctttatctgtgcggtgagtttggcagtttacctttctttcaataattttgggtcgagcaatgctctaaagctgaccatgtagttcagtttttgtattccataagttttaagacctatggaacaaacagaaccatttcacacaaatttaccagtagcgttcactgcatgcatagtttactctggctgaaattgtgagatgcactggaggagataaacctacgtgaggggaaaacaacatgcgtcttgaggtgttctgtaggcatgcatgatcttgaggccgtggtttggatttataggtattattgcttttaaaatttctggatttgttagtccctcttgtattttgatttttgagtgaaacttggatcgtaaatttgaccagtgaaatataagttatatgacaaaaatcataatattggattc

SEQ ID NO: 834 - DNA, 1168 bp, Hordeum vulgare
acatccatttgacaggctctcggctcagctcccctctctcctccagatctcacaaggcgacggaccaacagacgcaaggccaccggcgccgcagccgccgcatctgcgatcttgcccgccgccgctgccgccctgagagatggcgaaggcgtcttacgcggtggggttctggatccgggagaccggtcaggccctcgaccgcctcggctgccgcctccaagggaactacttcttccacgagcagatttcaaggcatcgcacacttatgaacatctttgacaaagcccctcatgttcacaaagaggcatttgtcgctccaagtgcatcccttattggtgatgttgaagttggaaaagggtcttcaatttggtacggatgcgtcttaagaggtgatgcaaataacgttcgagttggatctgggaccaatatacaggacaattctgttgtgcatgtggcaaaatctaatctaagtgggaaagtctttccaaccatcattggagacaatgtcacagtaggacatagtgctgtattacaaggatgcactgttgaggatgaagcttttgttggtatgggagcaaccctgttagatggtgttgttgtagaaaagcatgggatggttgctgccggagcccttgtaagacagaatacaaggatcccttgtggagaggtatggggtggaaacccagcgaaatttctgaggaagctcacagatgaggagattgcttttatagcggagtcggctgccaactattccaacttagccaaggcacacgctgttgagaatgccaagcccgtggaaaagattgattttgagaaagtgttgcgcaagaaagttgctcaccaggacgaggaacacggttccatgcttggtgccactcgggaagtccctccagagctggcgccgcccagtcctactcctgcggcccaataagctttgcttatctgtgttcctctccttctttggtgccttcaccatcttcagtttgaattcttatatactatctgttcatttagtttggcagtttaagattatttcaataattttgggtcgagcaatgttctaaagctgaccatgcacttcagtttctgtattccatatgttgtaagatctatggaacaaacagaataaatttaccagtattgtgcgctgcgtgcatagtttactctg

SEQ ID NO: 835 - DNA, 1005 bp, Secale cereale
tttacgcggtggggttctggatccgggagaccggtcaggccctcgaccgcctcggctgccgcctccaggggaactacttcttccacgagcagatttcaaggcatcgcacacttatgaacatcattgacaaagcccctcatgttcacaaagaggcatttgtcgctccaagtgcatcccttattggtgatgttgaagttggacaagggtcttcaatttggtacggctgcgtcttaagaggtgatgcaaataacgttcaagttggatctgggacgaatatacaggacaattctgttgtgcatgtggcaaaatctaatctaagcgggaaagtctttccaaccatcattggagacaatgtcacagtaggacatagtgctgtattgcaaggatgcactgttgaggatgaagctttcattggtatgggagcgaccctgttagatggtgttgttgtggaaaagcatgggatggttgctgctggagcccttgtaagacagaacacaaggatcccttgtggagaggtatggggcggaaaccctgcaaaatttctgaggaagctcacagatgaggagattgcttttattgcggaatcggctgccaactattccaacttagccaaggcacacgctgttgagaatgctaagcccttggaaaagattgattttgagaaagtgttgcgcaaggaagttgctcaccaggacgaggaacacggttccatgcttagtggcactcgagaggtccctccagagctagcaccatccagccctacccctgctcaataagctttggttatctatttcccaccctttctttggtgccttcaccgtctctatctgagcactgtgtttggcggtttacgtttatttcaataattttgggtcgagcaatgttctaaagctgaccatgtagttcagtttttgactttttgtattccataagttttaagatttatggaacaaactgaaccatttcacacaaatttaccagtagcgtgcactgcgtgcatacctg

SEQ ID NO: 836 - DNA, 971 bp, Secale cereale
tctcggctcatttcccctctctccactagatctcccgacgcaacaaacgcaaggccaccggcgcctctgcgcatccgcagccgccgcctctgcgatcttgcccgcagccgccaccgccgccgccgtgagagatggcgaaggcgttttacgcggtggggttctggatccgggagaccggtcaggccctcgaccgcctcggctgccgcctccaggggaactacttcttccacgagcagatttcaaggcatcgcacacttatgaacattattgacaaagcccctcatgttcacaaagaggcatttgtcgctccaagtgcatcccttattggtgatgttgaagttggacaagggtcttcaatttggtacggctgcgtcttaagaggtgatgcaaataacgttcaagttggatctgggacgaatatacaggacaattctgttgtgcatgtggcaaaatctaatctgagcgggaaagtctttccaaccatcattggagacaatgtcacagtaggacatagtgctgtattacaaggatgcactgttgaggatgaagctttcgttggtatgggagcgaccctgttagatggtgttgttgtggaaaagcatgggatggttgctgctggagcccttgtaagacagaacacaaggatcccttgtggagaggtatggggcggaaaccctgcgaaatttctgaggaagctcacagatgaggagattgcttttattgcagaatcggctgccaactattccaacttagccaaggcacacgcgtgttgagatgccaagcccttaggaaaagattgattttgagaaagtgttgcgcaaggagttgctcaccaggacgaggaacacggttccatgcttagtggcactcgagacggtccctccgagagctggccaccacccagccctaccctgctacaatagctttggtatctcgtttcccaccttttcttggtcgccttcaccgtcccc

SEQ ID NO: 837 - DNA, 1179 bp, Brachypodium distachyon
gctacaggcccagtgcccagcctctctcccttccgatccccacaggcctcagctcagctcccctctctcctcgagatcccctaggccaggagccaacaaacgcaagcctccgcgcctccgcagtcgccgttctgctatttcggccgccgcccggtgagatggcgaaggcgttttacgcggtggggttctggatccgggagacaggccaggccctcgaccgcctcggctcccgcctccagggcaactacttcttccacgagcagatttcaaggcatcgcacactcatgaacatttttgacaaagccccttatgttcacagagaggcatttgttgctccaagtgcatcccttattggcgatgttcaagttggacaaggatcttccatttggtatgggtgtgtcttaagaggtgatgcaaataacgttcaaattggatctgggaccaatatacaggacaattctgttgtgcatgttgcaaaatctaatctaagtgggaaagtttttccaaccatcatcggggacaatgtcacagtaggtcatagtgctgtattacaaggatgcactgttgaggatgaagcttttgttggtatgggggctaccctgttagatggtgttgtcgtggaaaagcatgggatggttgctgctggagcccttgtaaggcagaacacaaggatcccttgcggagaggtatggggtggaaaccctgccaaatttctgaggaagctcactgatgaggagattgcttttatcgccgaatcggctgccaactattccaacttagccaaggcacatgctgtcgagaacgctaagcctttggaaaagattgagtttgagaaggtgttgcgcaagagatttgctcgccaagatgaagaatacgattccatgcttggtgtcactcgagaggcccatccggagctgacaccccccagccctgcccaataagcctttcgcttacatgttttttgtttttttgccgccttcaccatcttcgattggtcagtgcaggatcgttgaaaggtgacaccggtcgatgagtttggcagtttatgtttacttccttcctcaataatttttgggtcgagcaacgctctaaagctcgccatgtacttcttcagtttctgaattccatatgtttgagatgcgctctatggaacaaacagaatcagctgacacaaattta

SEQ ID NO: 838 - DNA, 1430 bp, Brachypodium distachyon
gcaggcgaagaagctcctgcgctacaggcccagtgcccagcctctctcccttccgatccccacaggcctcagctcagctcccctctctcctcgagatcccctaggccaggagccaacaaacgcaagcctccgcgcctccgcagtcgccgttctgctatttcggccgccgcccggtgagatggcgaaggcgttttacgcggtggggttctggatccgggagacaggccaggccctcgaccgcctcggctcccgcctccagggcaactacttcttccacgagcagatttcaaggcatcgcacactcatgaacatttttgacaaagccccttatgttcacagagaggcatttgttgctccaagtgcatcccttattggcgatgttcaagttggacaaggatcttccatttggtatgggtgtgtcttaagaggtgatgcaaataacgttcaaattggatctgggaccaatatacaggacaattctgttgtgcatgttgcaaaatctaatctaagtgggaaagtttttccaaccatcatcggggacaatgtcacagtaggtcatagtgctgtattacaaggatgcactgttgaggatgaagcttttgttggtatgggggctaccctgttagatggtgttgtcgtggaaaagcatgggatggttgctgctggagcccttgtaaggcagaacacaaggatcccttgcggagaggtatggggtggaaaccctgccaaatttctgaggaagctcactgatgaggagattgcttttatcgccgaatcggctgccaactattccaacttagccaaggcacatgctgtcgagaacgctaagcctttggaaaagattgagtttgagaaggtgttgcgcaagagatttgctcgccaagatgaagaatacgattccatgcttggtgtcactcgagaggcccatccggagctgacaccccccagccctgcccaataagcctttcgcttacatgttttttgtttttttgccgccttcaccatcttcgattggtcagtgcaggatcgttgaaaggtgacaccggtcgatgagtttggcagtttatgtttacttccttcctcaataatttttgggtcgagcaacgctctaaagctcgccatgtacttcttcagtttctgaattccatatgtttgagatgcgctctatggaacaaacagaatcagctgacacaaatttatgaatagcatgagttggagttcatgtggtttagccttgttgaaataggtagatgcattggaagcagcacatgaaccgtcaggcttgtggttcagcacttgccggattcatctttgatatcaaacataaataaaacagagtatacgttttaatattgtttaataatctctctgtctcgtattaagtgactttttattacatattaagtgactttttattacatggatctaga

SEQ ID NO: 839 - DNA, 1042 bp, Lolium multiflorum
ggccaggagccaacaaacgcaaggccaccgccgcctctgcagtcgccgttctgcgatctcctcctccgccgccgccctgagagatggcgaaggcgttttacgcggtggggttctggatccgggagaccggccaggccctcgaccgcctcggctgccgcctccagggcaactacttcttccatgagcagatttcaaggcatcgcacacttatgaacatcgttgataaaggccctcatgttcacagggaggcatttgttgctccaagtgcgtcccttaccggtgatgttcaagttggacaagggtcttcaatttggtatggatgcgttttaagaggtgatgcgaataatgtacaaattggatctgggaccaatatacaggacaattctgttgtgcatgtggcaaaatctaatttaagtgggaaagtctttccaaccatcatcggtgacaatgtcacagtacgacatagtgctgtattacaaggatgcactgttgaggatgaagcttttgttggcatgggggcaaccctgttagatggcgttgttgtggaaaagcacgggatggttgctgctggagcccttgtaagacagaacacaaggatcccttgcggagaggtatggggtggaaaccctgcaaaatttctgaggaaactcacagatgaggagatcgcttttattgcggaatcggctgccaagtattccaccttagctaaggaacatgctgctgagaacgctaagcctttggaatcgattgagtttatgaaggtgttgcgcaagaagtttgctcaccaggacgaggaagacgattcaatgcttggtgtcactcgagaggcttctccggagctggcgccgtccagtgctactcctgcccaataagcttattatctgttcctctccttttttttcctttggtgcttcaccctcttccgttagatggttgaagtggacactgttcaacgagtttggcagtttatgtttacttcccaataatcttggtcgagcaatgttccaaagctggccatgtacctgcccgggcggccgctcga

SEQ ID NO: 840 - DNA, 1196 bp, Avena sativa
aaggccaggagccaacaaacgcaaggctaccgccgcctctgcagtcgccgttctgcgatcttgtccgccgctgccgccaccctgagagatggcgaaggcgttttacgcggtggggttctggatccgggagaccggtcaggccctcgaccgcctcggcagccgcctccagggaaactatttcttccacgagcagatttcaaggcatcgcacacttatgaacatcgttgataaaaccccttatgttcataaagaggcatttgttgctccaagtgcatcccttatcggtgatgttcaagttggacaagggtcttcaatttggtatggatgcgttttaagaggtgatgcaaataacgtccagattggatctaggaccaatatacaggacaattctgttgtgcatgtggcaaagtctaatttaagtgggaaagtctttccaaccatcatcgggaacaatgtcacagtaggacatagtgctgtattacaaggatgcactgttgaggatgaagcttttgttggtatgggggcaaccctgttagatggcgttgttgtggaaaagcatgggatggttgctgctggagcccttgtaaggcagaacacaaggatcccttgcggagaggtatggggcggaaaccctgcgaaatttctgaggaaactgactgatgaggagatcgcttttatttcggaatcggctgccacctattccaccttagctaaggaacacgctgctgagaatgataagcctttggaacagattgattttgagaaggtgttgcgcaagaagtctgctcacgaggatgatgaacacgattccatgcttggtgtcactcgagaggtccctccggagctggcgccgtccagtgcttctcctgcccaataagcttttcttatctgttcctattttcctttggtgccttcaccatcttctgttagatcgttgaagtggacactgttcagtgagtttggcagtttatgtttacttcggcaataatttggggtcaagcaatgttccaaagctggccaagtactccttcagtttctgtattccatatgtttaagatgggctctatggaacaaatagaatcattgcacacctatttgcgagtaccatgcgttgctgagcatgtggtttactcgggttgaaatagtgaggtgcactggaggcagcatttgcactgccagactatagtacagcgctt

SEQ ID NO: 841 - DNA, 1211 bp, Avena sativa
aaggccaggagccaacaaacgcaaggctaccgccgcctctgcagtcgccgttctgcgatcttgtccgccgctgccgccaccctgagagatggcgaaggcgttttacgcggtggggttctggatccgggagaccggtcaggccctcgaccgcctcggcagccgcctccagggaaactatttcttccacgagcagatttcaaggcatcgcacacttatgaacatcgttgataaaaccccttatgttcataaagaggcatttgttgctccaagtgcatcccttatcggtgatgttcaagttggacaagggtcttcaatttggtatggatgcgttttaagaggtgatgcaaataacgtccagattggatctaggaccaatatacaggacaattctgttgtgcatgtggcaaagtctaatttaagtgggaaagtctttccaaccatcatcgggaacaatgtcacagtaggacatagtgctgtattacaaggatgcactgttgaggatgaagcttttgttggtatgggggcaaccctgttagatggcgttgttgtggaaaagcatgggatggttgctgctggagcccttgtaaggcagaacacaaggatcccttgcggagaggtatggggcggaaaccctgcgaaatttctgaggaaactgactgatgaggagatcgcttttatttcggaatcggctgccacctattccaccttagctaaggaacacgctgctgagaatgataagcctttggaacagattgattttgagaaggtgttgcgcaagaagtctgctcacgaggatgatgaacacgattccatgcttggtgtcactcgagaggtccctccggagctggcgccgtccagtgcttctcctgcccaataagcttttcttatctgttcctattttcctttggtgccttcaccatcttctgttagatcgttgaagtggacactgttcagtgagtttggcagtttatgtttacttcggcaataatttggggtcaagcaatgttccaaagctggccatgtactccttcagtttctgtattccatatgtttaagatgggctctatggaacaaatagaatcattgcacacctatttgcgagtaccatgcgttgctgagcatgtggtttactcgggttgaaatagtgaggtgcactggaggcagcatttgcactgccagactatagtacagcgcttacctgattcatattt

SEQ ID NO: 842 - DNA, 1252 bp, Saccharum officinarum
agatactcttaaacgaggccaaagttctccgaccaccgagcaaaccccagctcagcaggcccagtgcccagcctccgttcctctccatccccttccctcgccccggctcccctcctcctcttgagatctccaagggtacgagcgcattcgcatcgcttcgcctccgccgctcgcgttttcggccgccgccgccgccgcccggggagatggcgggtctgggaaaggcgatgtacgcggtggggttctggatccgggagaccggccaggccctcgaccgcctcggctgccgcctgcagggcaagtacttcttccacgagcagatttcaaggcatcgcaccatcatgaatatctttgacaaaacccctcatgttcataaagacgcatttgttgctccaagtgcatcccttattggtgatgttcaagttgggccaggagcttccatttggtatgggtgcgtcttaagaggggatgcaaacaacatacaaattggatctgggaccaatatacaagacaattctcttgtgcatgtggctaaatctaatctaagtgggaaagtctttccaacaatcattggcaataacgtcacagtaggtcatagtgctgtgttacaaggatgcacggttgaggatgaggcttttgttggcatgggggcaaccctattagatggtgtcgttgttgaaaagcacgggatggtagctgctggagccctcgtacgacagaatactaggatcccttgtggagaggtatggggagggaaccccgccaaatttctgaggaagctcacagatgacgagatcgcttttattgcggagtcagctgccaactattccagtctgtccaaggcgcatgctgatgagaatgccaagcctcttgaaaagattgagtttgagaaggtgttgcgcaagaagtttgctcaccaggatgaggagtatgattcttcgatcggtgtcactcgagaggccccaccggagctgacgtccccaaatccagcccaataaacctctgtttttgtttctgttttctctttggcgccttaatcattttctattggacagtgctggatcgttgatcagggcatagttccatgactttggtggtttatgtttacttttcctccccaataatcttgggtcgagcgatgttataaagctggccatgcacttcttccagattctgtattcggtatgtttaagatgtgctcccatgaaagacagacccactaaattgacagaaatgcattgttttgacaggt

SEQ ID NO: 843 - DNA, 1356 bp, Sorghum bicolor
cgaccgcagagcaaaccccagcacagcaggcccagtgcccagccagccagcctccgttcctctccttccccttcgccttggctcccctcctccttccttgagatctccaagggtacgagcgcattcgcatcgcttcgcctccgccgctcgcgatttcggccgcctccgccgccgcccggggagatggcgggtctgggaaaggcgatgtacgcggtggggttctggatccgggagaccggccaggccctcgaccgcctcggctgccgcctgcagggcaagtacttcttccacgagcagatttcaaggcatcgcaccatcatgaatatctttgacaaaacccctcatgttcataaagacgcatttgttgctccaagtgcatcccttattggtgatgttcaagttgggccaggagcttccatttggtatgggtgtgtcttaagaggggatgcaaacaacatacaaattggatctgggaccaatatacaagacaattctcttgtgcatgtggctaaatctaatctaagtgggaaagtctttccaacaatcattggcaataatgtcacagtaggtcatagtgctgtgttacaaggatgcacagttgaggatgaggcttttgttggcatgggggcaaccctattagatggtgtcgttgttgaaaagcacgggatggtagctgctggagcccttgtacggcagaatactaggatcccttgtggagaggtatggggagggaaccctgccaaatttctgaggaagctcacagatgacgagatagcttttattgcggaatcagctgccaactattccagtctgtccaaggtgcatgctattgagaacgccaagcctcttgaaaagattgagtttgagaaggtgttgcgcaagaagtttgctcaccaggatgaggagtatgattcctcgatcggcgtcactcgagaggccccaccggagctgacgtccccaaatccagcccaataaacctctgtttttgtttctgttttctctttggcgccttaatcattttctattggacagtgctggatcgttgatcggggcattgttccatgactttggtgtttatgtttacttttcctccccaataatcttgggtcgagcgatgttataaagctggccatgcacttcttccagattctgtattcggtatgcttaagatgtgctccctggaaagacagacccactaaattgacagaaatgcattgttttgacaggtaacatgcactgaattaaatatttcattacctttgaaggctagtttcagcaccattcactggtcatagctctgtatgctttctggcatgtatgaatcatctttataaaatttctgaagcacaaattcct

SEQ ID NO: 844 - DNA, 1515 bp, Sorghum bicolor
cactctctgccaagggggcaaaagggtaaaattcgtcgaccgcagagcaaaccccagcacagcaggcccagtgcccagccagccagcctccgttcctctccttccccttcgccttggctcccctcctccttccttgagatctccaagggtacgagcgcattcgcatcgcttcgcctccgccgctcgcgatttcggccgcctccgccgccgcccggggagatggcgggtctgggaaaggcgatgtacgcggtggggttctggatccgggagaccggccaggccctcgaccgcctcggctgccgcctgcagggcaagtacttcttccacgagcagatttcaaggcatcgcaccatcatgaatatctttgacaaaacccctcatgttcataaagacgcatttgttgctccaagtgcatcccttattggtgatgttcaagttgggccaggagcttccatttggtatgggtgtgtcttaagaggggatgcaaacaacatacaaattggatctgggaccaatatacaagacaattctcttgtgcatgtggctaaatctaatctaagtgggaaagtctttccaacaatcattggcaataatgtcacagtaggtcatagtgctgtgttacaaggatgcacagttgaggatgaggcttttgttggcatgggggcaaccctattagatggtgtcgttgttgaaaagcacgggatggtagctgctggagcccttgtacggcagaatactaggatcccttgtggagaggtatggggagggaaccctgccaaatttctgaggaagctcacagatgacgagatagcttttattgcggaatcagctgccaactattccagtctgtccaaggtgcatgctattgagaacgccaagcctcttgaaaagattgagtttgagaaggtgttgcgcaagaagtttgctcaccaggatgaggagtatgattcctcgatcggcgtcactcgagaggccccaccggagctgacgtccccaaatccagcccaataaacctctgtttttgtttctgttttctctttggcgccttaatcattttctattggacagtgctggatcgttgatcggggcattgttccatgactttggtgtttatgtttacttttcctccccaataatcttgggtcgagcgatgttataaagctggccatgcacttcttccagattctgtattcggtatgcttaagatgtgctccctggaaagacagacccactaaattgacagaaatgcattgttttgacaggtaacatgcactgaattaaatatttcattacctttgaaggctagtttcagcaccattcactggtcatagctctgtatgctttctggcatgtatgaatcatctttataaaatttctgaagcacaaattccttcatgaaatgattgatactgggttgacactgaatgtcttccctagtgtattcctgctaggctgctactcttgtggacatccttaaacagtagcgagaatggatgtttcagtgtgagaaaaaaa

SEQ ID NO: 845 - DNA, 1156 bp, Hordeum vulgare
ggctgccgcctccaagggaactacttcttccacgagcagatttcaaggcatcgcacacttatgaacatctttgacaaagcccctcatgttcacaaagaggcatttgtcgctccaagtgcatcccttattggtgatgttgaagttggaaaagggtcttcaatttggtacggatgcgtcttaagaggtgatgcaaataacgttcgagttggatctgggaccaatatacaggacaattctgttgtgcatgtggcaaaatctaatctaagtgggaaagtctttccaaccatcattggagacaatgtcacagtaggacatagtgctgtattacaaggatgcactgttgaggatgaagcttttgttggtatgggagcaaccctgttagatggtgttgttgtagaaaagcatgggatggttgctgccggagcccttgtaagacagaatacaaggatcccttgtggagaggtatggggtggaaaccctgcgaaatttctgaggaagctcacagatgaggagattgcttttatagcggagtcggctgccaactattccaacttagccaaggcacacgctgttgagaatgccaagcccgtggaaaagattgattttgagaaagtgttgcgcaagaaagttgctcaccaggacgaggaacacggttccatgcttggtgccactcgggaagtccctccagagctggcgccgcccagtcctactcctgcggcccaataagctttgcttatctgtgttcctctccttctttggtgccttcaccatcttcagtttgaattcttatatactatctgttcatttagtttggcagtttaagattatttcaataattttgggtcgagcaatgttctaaagctgaccatgcacttcagtttctgtattccatatgttgtaagatctatggaacaaacagaataaatttaccagtattgtgcgctgcgtgcatagtttactctggctaaaattgcgagatgcactggaggagataaacctacgtgacacgtcttgaggtgttcctaggcatacgtgattttggggccgtattgtggatttataggcatttttgctttctaaatttcttaattttataatccctcttgtattttgtgtcaaactttgatcgtaaatttgactatcaaaaattaagtta

SEQ ID NO: 846 - DNA, 1455 bp, Setaria italica
cactctcttcccaggggtaaaacggtcaattccgagcaccgaggaaaccccagcggagcaggccccagcctctgttctccgccccctcccgttcccctcacctcggctcgcccctactccgatcctcctcctcgagatctccaaggccacgagcgcttccgcaccgctccgcctccgccgcgcccgccgctagcgattttggccgccgccgggggagatggcaggcctgggaaaggcgatgtacgcggtggggttctggatccgggagaccggccaggccctcgaccgcctcggctgccgcctgcagggcaactacttcttccacgagcagatttcaaggcatcgcacactcatgaacatctttgacaaaacccctcatgttcatagagatgcatttgttgctccaagtgcatcacttattggtgatgttcaagttggaccaggagcttccatttggtacgggtgcgttctaagaggggatgcaaacaacattcagattggatctgggaccaatatacaagacaattctcttgtgcatgtggcgaagtctaatctaagtgggaaagtctttccaacaattatcggtgaaaatgtcacagtaggtcatagcgctgtcttacaaggatgcaccattgaggatgaagcttttgttggtatgggggcaaccctattggatggtgtcattgtggaaaagcatggaatggttgctgccggagccctcgtaagacagaatacaaggatcccttctggagaggtatggggaggaaaccctgccaaatttctgaggaagctcactgatgatgaaatagcttttattgctgaatcggctgccaactattttagtctgtccaaggagcatgctgctgagaatgccaagccacttgagaaggttgagttcgagaaggtgctgcccaagaagtttgctcaccaggacgaagaatatgattccacgatcggtgtcactcgagaggccccaccagagctgacgcctcccactccagcccaataaacctctgttttttttcctgttttctctttgctgccattatcgtcttctattgggacagtgctggatcgttgattgggacactgttccatgagtctggtggtttatgtctactttttcctccccaataatctttgggtcgagcaatgttataaagctggccatgcacttcttcaagtttctgtatccaagtatgtttaagatgtgctccctggaaagacagaccccactaaatagacagacatgcattgttttgacgtggatactgaattacattattctttcggtggttggccaggagtagtgcatttcctttgaaggctggtttcagcaatcagcaccattgattggacccataaagtttgcaactaagttttcatggtttctgtcacatatgaatcatcgttcataagccatagagcaggatttctttacgaactgattgatac

SEQ ID NO: 847 - DNA, 1351 bp, Setaria italica
gagcaccgaggaaaccccagcggagcaggccccagcctctgttctccgccccctcccgttcccctcacctcggctcgcccctactccgatcctcctcctcgagatctccaaggccacgagcgcttccgcaccgctccgcctccgccgcgcccgccgctagcgattttggccgccgccgggggagatggcaggcctgggaaaggcgatgtacgcggtggggttctggatccgggagaccggccaggccctcgaccgcctcggctgccgcctgcagggcaactacttcttccacgagcagatttcaaggcatcgcacactcatgaacatctttgacaaaacccctcatgttcatagagatgcatttgttgctccaagtgcatcacttattggtgatgttcaagttggaccaggagcttccatttggtacgggtgcgttctaagaggggatgcaaacaacattcagattggatctgggaccaatatacaagacaattctcttgtgcatgtggcgaagtctaatctaagtgggaaagtctttccaacaattatcggtgaaaatgtcacagtaggtcatagcgctgtcttacaaggatgcaccattgaggatgaagcttttgttggtatgggggcaaccctattggatggtgtcattgtggaaaagcatggaatggttgctgccggagccctcgtaagacagaatacaaggatcccttctggagaggtatggggaggaaaccctgccaaatttctgaggaagctcactgatgatgaaatagcttttattgctgaatcggctgccaactattttagtctgtccaaggagcatgctgctgagaatgccaagccacttgagaaggttgagttcgagaaggtgctgcccaagaagtttgctcaccaggacgaagaatatgattccacgatcggtgtcactcgagaggccccaccagagctgacgcctcccactccagcccaataaacctctgttttttttcctgttttctctttgctgccattatcgtcttctattgggacagtgctggatcgttgattgggacactgttccatgagtctggtggtttatgtctactttttcctccccaataatctttgggtcgagcaatgttataaagctggccatgcacttcttcaagtttctgtatccaagtatgtttaagatgtgctccctggaaagacagaccccactaaatagacagacatgcattgttttgacgtggatactgaattacattattctttcggtggttggccaggagtagtgcatttcctttgaaggctggtttcagcaatcagcaccattgattggacccataaagtttgcaactaagttttc

SEQ ID NO: 848 - DNA, 1457 bp, Pennisetum glaucum
cactctcttcgcaggggcaaaacggtcaattcttcgagcacggaggaaaccccagtggagcaggcccagttcccagcctctctgttctctgcctctgacctcagctctcccaactccggtcctcctcctcgagatctccaaggccacgaacccacaagcgcttccgcatcgctccgcctccgccgcgcccgcagctcgcgattttggtcgccgccggggggagatggcaggcctggggaaggcgatgtacgcggtggggttctggatccgggagaccggccaggccctcgaccgcctcggctgccgcctgcagggcaactacttcttccacgagcagatttcaaggcatcgcacactcatgaacgtctttgacaaaacccctcatgttcatagagatgcatttgttgctccaagtgcatcacttattggtgatattcaagttggaccaggagcttccatttggtatgggtgcgtcttaagaggggatgcaaataacattcagattggatctgggaccaatatacaagacaattctcttgtgcatgtggcgaagtctaatctaagtgggaaagtctttccaactatcatcggtgaaaatgtcacagtaggtcatagcgctgttttacaaggatgcaccgttgaggatgaagcttttgttggtatgggggcaaccctattggatggtgtcattgtggaaaagcatggaatggttgctgctagagcccttgtaagacagaatacaaggatcccttctggagaggtatggggaggaaaccctgccaaatttctgaggaagctcactgacgaggagatagcttttattgctgaatcggctgccaactatttgagtctgtccaaggcgcatgctgctgagaatgccaagccactggaaaaggttgagtttgagaaggtgttgcgcaagaagcttgctcatcaggacgaagaatatgattccaggatcggtgtcactcgtgaggccccaccggagctgacgcctcccactccagcccaataaacctctgtttttatttgtttctgtttcttccttgctgccattgtcgtcttctattggacagtgctggatcgttgattgggacactgttccatgagtttggcggtttatgtttactttttcctccccaataatctggggtcgagcaatgttataaagctggccatgcactccttccagttcgtgtatccaagtatgtttaagatgtgctccctggaaaggcagaccccactaaatagacagacatgcattgttttgacgtggataatgaattatacattatctttaggttgggcaggagtagtgtatttctttgctggtttcagaaatgagcaccattgattagacacttagagtttacaacaaagtttccatgtcttctgtcacatatgaatcatccttcatatgctataaagcagggttcctttattgaattgattgtaca

SEQ ID NO: 849 - DNA, 1256 bp, Panicum virgatum
cgagcaccgaggaaaccccagcggagcaggcccagttcgcagcctctgttctgttcctccccgtcccctcacctccgctcccctactcccggtcctcctcctcgagatctccaaggccacgagcgcttccgcgcagctccgcctccgccgctcgcgattttggccgccgccgggggagatggcaggcctgggaaaggcgatgtacgcggtggggttctggatccgggagaccggccaggcgctcgaccgcctcggctgccgcctgcagggcaaatacttcttccacgagcagatttcaaggcatcgcacactcatgaacatctttgacaaaacccctcatgttcatagagatgcatttgttgctccaagtgcatcgcttattggtgatgttcaagttggaccaggagcttccatttggtatgggtgcgtcctaagaggggatgcaaacaacatccagattggatctgggaccaatattcaagacaattctcttgtgcatgtggcgaagtcgaatctaagtgggaaagtctttccgacaattatcggtgaaaaagtcacagtaggtcatagcgctgtcttacaaggatgcaccatcgaggatgaagcttttgttggcatgggggcaaccctattggatggtgttgttgtggaaaagcatggaatggttgctgctggagccctcgtaagacagaatactaggatcccttctggagaggtatggggaggaaacccagccaaatttctgaggaagctcaccgctgatgagatagcttttattgctgaatcggctgccaactattgtagtctgtcccaggcgcatgctgttgagaatgccaaacctcttgagaaggttgagttcgagaaggtgttgcgcaagaagtttgctaaccaggatgaagaatatgattccactatcggtgtcactcaagaggccccaccggagctgacgccttccacaccagcccaataaacttcctttttttttgtttctgttttctctttgctgccatcatcttcttctattggacagtgctggattgttgattgggacactgttccatgagtctggcggtttatgtttacttttcctccccaataatcttgggtcgagcaatgttataaagctggccatgcacttcttcctgtttctgtatccaagtatgtttaagatgtgctccctggaaagacagtcccaactaaatagacagacatgcattgttttgacgtggatactgaattacattattctatacagg

SEQ ID NO: 850 - DNA, 2238 bp, Oryza sativa
ctctcacctgcgacaaaccgggggcgctgcagcgacgcgccgaacacgtaggggctgtagttctcgcggtcgtagtagtacgccatgaccagccgcttgaggaaccgatagtagagcggcgacacctcgaggtcgtcctcgacgacgaaggcgaactcgtcgtcggagccgggccaccacgcctcgatccactgcgcctggagccccgcgttggcggcgcggtagtgcacgcgcttctccccgtgcggccaccggagggcgtcggcctcggcgaggatctcgcgcgacgcatcgagggatgcgttggggcgcgggtggtcgacgaggacgtggagcgccacgcggtccccggcgtagtccgccgctgcgagcgagcggaggcagcggcggagcggccccgggcggtcgtaggcgaggaccttgatgaggagggagaagcggcgcgggtccggcccggggccggagaggagctccgccgcggggatcgaggagcggtggtggaggagaaggacgacgaagagggagaccgggaagacgaggaggaggagcggcagcggcagggagcgccgccgcggagacgccattgccggcggcggaggagagatcgacggagcactgaagtggagcagagcaaagttgcaggagagagaaagggaggagatgtgggcttcctggaccataccagtgggcctcgtttagatgggcctagatcctggcccatacattagtgcgggccgggatattgactgggccgcaaatgggccagtgggtcgctgtccagagtgggaggggcaaaacggtcaattgctcgagtggtagaggaaaccccagcgagaggccgtgtccccactccacagcctctctcctcgtcgtccccgatcccctcctcctctcctctcctctccactcctcgagatctcgcaaggtcagggagccagcaaattcacccgcgattccgcgcgccgccgccgtcgccgccgccgacgtcgccgcctgggtgggggaggagatggccggcctcgggaaggccttctacgcggtagggttctggatccgggagaccggccaggccctcgaccgcctcggctgccgcctccaggggaactactacttccacgagcagctctcaaggcatcgcacacttatgaacatctttgacaaaacccctcatgttcacagagatgcatttgttgccccaagtgcatctctcattggtgatattcaagttggacaaggagcttcaatttggtatggatgcgtcttaagaggggatgcaaacaacgttcaaattggatctgggaccaatatacaagacaattctcttgtccatgtggcaaaatctaatcttagtggaaaagtctttccaaccatcattggggataacgtcacagtaggtcatagtgctgtattacaaggatgtactgttgaggacgaagcatttgttggtatgggggcgaccctgttagatggtgttgtcgtggaaaagcatgggatggttgctgctggagcccttgtaagacagaacacaaggatcccctgtggagaggtatggggaggaaaccctgccaaattcctgaggaagctcactgatgacgagattacgtttatcaaagaatcagcttctaactattccactctggcaaaggcccatgctgctgagaatgccaagcctgttgaaaagactgaatttgagaagctgttccgcaagaagtctgctcaccaggatgaggaacacgattcaatgattggtgctactcgggaggttactccggagctgacgccctcgagttctgcccaataaaccttgtttctgtttttgcttctctctggtgcctttgcatcatcttatattggacagtgcaggattgttgaaggtgacactgttccatgagttcggcggtttatgtttactttcctccccaataattttgggtcgagcattgtgcaaaagctggccatgtacttcgttttctgtattccatatgtttaagatgcgctccatggaacaaagagaaccattacgcacaaaaatctagcatcgttttgacaagttaccattacgcacaaaaatctagcatcgttttgacaagttacttgcagcgcgttcttgtagtttctctacaaattattggataactaatggggatttgttggtgtgcgtgaaatttggtaaagtctgaaattttaactttggttgatgaatcaaccttacctgacctttactataacgaacttggc

SEQ ID NO: 851 - DNA, 1117 bp, Oryza sativa
agcgagaggccgtgtccccactccacagcctctctcctcgtcgtccccgatcccctcctcctctcctctcctctccactcctcgagatctcgcaaggtcagggagccagcaaattcacccgcgattccgcgcgccgccgccgtcgccgccgccgacgtcgccgcctgggtgggggaggagatggccggcctcgggaaggccttctacgcggtagggttctggatccgggagaccggccaggccctcgaccgcctcggctgccgcctccaggggaactactacttccacgagcagctctcaaggcatcgcacacttatgaacatctttgacaaaacccctcatgttcacagagatgcatttgttgccccaagtgcatctctcattggtgatattcaagttggacaaggagcttcaatttggtatggatgcgtcttaagaggggatgcaaacaacgttcaaattggatctgggaccaatatacaagacaattctcttgtccatgtggcaaaatctaatcttagtggaaaagtctttccaaccatcattggggataacgtcacagtaggtcatagtgctgtattacaaggatgtactgttgaggacgaagcatttgttggtatgggggcgaccctgttagatggtgttgtcgtggaaaagcatgggatggttgctgctggagcccttgtaagacagaacacaaggatcccctgtggagaggtatggggaggaaaccctgccaaattcctgaggaagctcactgatgacgagattacgtttatcaaagaatcagcttctaactattccactctggcaaaggcccatgctgctgagaatgccaagcctgttgaaaagactgaatttgagaagctgttccgcaagaagtctgctcaccaggatgaggaacacgattcaatgattggtgctactcgggaggttactccggagctgacgccctcgagttctgcccaataaaccttgtttctgtttttgcttctctctggtgcctttgcatcatcttatattggacagtgcaggattgttgaaggtgacactgttccatgagttcggcggtttatgtttactttcctccccaataattttgggtcgagcattgtgc

SEQ ID NO: 852 - DNA, 1268 bp, Panicum virgatum
cagcggagcaggcccagttcccagcctctgtttctgttcctcctcctcccctcacctccccgctcccctactccccggtcctcctcgagatctccaaggccacgagcgcttccgcaccgctccgcctccgccgcgtccgccgctcgcgattttggccgccgccgggggagatggcaggcctgggaaaggcgatgtacgcggtggggttctggatccgggagaccggccaggccctcgaccgcctcggctgccgcctgcagggcaaatacttcttccacgagcagatttcaaggcatcgcacgctcatgaacatctttgacaaaacccctcatgttcatagagatgcatttgttgctccaagtgcatcgcttattggtgatgttcaagttggaccaggagcttccatttggtatgggtgcgtcctaagaggggatgcaaacaacatccagattggatctgggaccaatatacaagacaattctcttgtacatgtggcgaagtcgaatctaagtgggaaagtctttccgacaattatcggtgaaaatgtcacagtaggtcatagtgctgtcttacaaggatgcaccatcgaggatgaagcttttgttggcatgggggcaaccctattggatggtgttgttgtggaaaagcatggaatggttgctgctggagccctcgtaagacagaatactaggatcccttctggagaggtatggggaggaaacccagcaaaatttctgaggaagctcaccgctgatgagatagcttttattgctgaatcggctgccaactattatagtctgtccaaggcgcatgcttttgagaatgccaagcctctagagaaggtcgagttcgagaaggtgttgcgcaagaagtttgctaaccaggatgaagaatatgattccacaatcggtgtcactcaagaggcaccaccgcagctgacgccttccacaccagcccaataaacctctgttttttgtttctgttttctctttgctgccatcatgtcttctattggacagtgctggatcgttgattgggacactgttccatgggttcggcgggttatgtttacttttcctccccaatgatcttgggtcgagcaatgttataaagctggccatgcacttcttccagtttctgtatccaagtatgtttaagatgtgctccctggaaagacggaccctactaaatagagacatgcattgttttgacgtggatactgaattacattattctatacaggagcaatgcatttgctttttcctttg

SEQ ID NO: 853 - DNA, 1234 bp, Zea mays
cactttctgcagagggggcaaaagggtaaagttcttctaccaccgagcgaaccccagcacaccggtccagtgcccagcctccgtccctctccttcccttacctcgcctcgtctcctctccttgagatctccagggtacgagcgcattcgcgattttggccgcctccgccgccgtccgggaagatggcgggtctgggaaaggcgatgtacgcggtggggttctggatccgggagactggccaggccctcgaccgcctgggctgccgcctgcagggcaagtacttcttccacgagcagatttcaaggcatcgcaccatcatgaatatctttgacaaaacccctcatgtgcataaagacgcatttgttgctccaagtgcatcccttattggtgatgttcaagtcgggtcaggagcttccatttggtatgggtgcgtcttaagaggggatgcaaacatcatacaaattggatctgggaccaatatacaagacaattctcttatacatgtggctaaatctaatctaagtgggaaggtctttccaacaaccattggtaataacgtcacagtaggtcatagtgctgtgttacaaggatgcacggttgaggatgaggcttttgttggcattggggcaaccctattagatggtgttgttgttgaaaagcacggaatggtggctgctggagccctcgtacgacagaatactaggatcccttgtggagaggtatggggagggaaccctgccaaatttctgaggaagctcacagatgacgagatcagtttcattgcggaatcagctgccaactattccaatctgtccaaggtccatgctgctgagaatgccaaacctcttgaaaagatcgagtttgagaaggtgttgggcaagaagtttgctcaccaggatgagtatgattcctcgattggcgtcgctgaaggggcaccaccagagctcacgtccccaaatccagcccaatgaacctctgtttctgttttctctttggcgccttaatcattttctgttggacagtgctggatcgttgatcggggtactgttccatgacactggtggtttatgtttacttttcctccccaataatcttgggtcgagcgatgttataaagctggccatgcacttcttccagattctgtattcggcatgtttaagatgtgctcccttgaaagacagaccccaaatagacagaaatgcattgtttttacaggtaacatgcactgaactac

SEQ ID NO: 854 - DNA, 1151 bp, Zea mays
ataaaaagaggttatcaaactagcccttcaaatggggcaaaaaggcaatgttctttgaccaccgagcaaaccccagcctccgttactctccttcctcttggctcgcctcggctcccgtcgtccccttccttgagatctctaggatacgagcgcattcgcatcgcttcgcctccgccgcggcctggggagatggcgggtttgggaaaggcgatgtacgcggtgggattctggatccgggagaccggtcaggccctcgatcgcctcggctgccgcctgcagggcaagtacttcttccacgagcagatttcaaggcatcgcaccatcatgaatatctttgacaaaaccccacatgttcatagggatgcatttgttgctccaagtgcatcccttattggtgatgttcaagtcgggcaaggagcttccatttggtatgggtgcgtcttaagaggggacgcaaacaacatacaaattggatctgggaccaatatacaagacaattctcttgtgcatgtggctaaatctaatctaagtgggaaagtctttccaacaatcattggtaataacgtcacaataggtcacagtgctgtgttacaaggatgcacggttgaggatgaggcttttgttggcatgggggcaaccctattagatggtgtcgttgttgaaaagcatgggatggtagctgcaggatcccttgtaagacagaatactaggatcccttgtggagaggtatggggagggaaccctgccaaatttctgaggaagctcacagatgacgagatcgcatttatcacggaatcagcttccaactattccaatctgtccaaggtgcatgctgccgagaatgccaagcctcttgaaaagattgagtttgagaaggtgttgcgcaagaagtttgctcaccaggatgaggagtatgattcctccatcggcatcactcgagggtccccaccggagctgacatccccaaatccagcccaataaacctctgtttttgtttctgttttctctttgacgccttaattattttgtattggacagcgctggattttgaccgggccatagttccatgacttaggtggtttatgtttacttttcctccccaataatcttgggtcgagcgatgttataaagctggtcatgcacttcttcca

SEQ ID NO: 855 - DNA, 1447 bp, Triticum aestivum
ctccaagtttcttgcacattggagccaaagatggcaaggtccgccatgtccgggctagtgctcctgctgctctgtgcaacctgcaggttggcgctaggaatcaccgatgggctgctggccaacggcaacttcgagcgcgggccgcagccgtcgcagctgcgcgggacgcaggtggtgggcgcgtcgtcgatcccgtcgtggcggacgtcggggttcgtggagtacatcccgtcggggcggaagcagggggacatggtgctggtcgtccccgagggcgcctacgccgtgcgcctgggcaacgaggcgtccatcgcgcagcgcctccgcggggccgtccccggcgcgcgctacagcctcaccttcagcgcggcgaggacgtgcgcgcaggcggagcgcctcaacgtgtccgcgtccggccagtccggcgtgctggtcatgcagaccatgtacagcagcaacggctgggactcctactcctgggcctgggacgccaccgccgacgaggtcgaggtcgtcgtccacaaccccggtgtcaccgaggaccccgcctgcggccccctcatcgactctgtcgccatcaagaccctcaccccgccccgccgcaccaacaagaacctggtgaagaatggtgatttcgaggaggggccgtacatcatccccgggaccaagtggggggtgctgatcccgtcgcggatggtggacgagcactcgccgctgccgggttggatggtggagtcgctcaaggccgtcaagtacatcgacagcgaccacttcgcggtgccgcgggggcgccgggccgtggagctgctggcggggagggagagcgcgatcgcacaggtgatccgcaccgtgccggggaagcagtacgcgctgtccttcagcgtgggcaacgccagcaacacgtgccgcgggtcgctcatggtggaggcctacgccggcagggagtccaccaaggtgccgtacgagtcggcggggcagggcggcgccgccaagcgggccgtgctcccgttccgcgccacgtcgtctcgcacgcgcgtcgtcttcttcagctccttctacaataccatgactgacgacatgagctcgctctgcgggccggtgatcgacgacgtcgccgtcgtcagcgtgcgcgcccggccgccaaagcgcccctagaacgataagctggctggccctagtgcgttgttgttgcatccgtgttaattagactgcttaggcgctcaaattgcttattgggcttgaatgtgcactaaggaattcgtcggagaggtgccacactcggtatgtcactagctgttggaagactagctgttgaaagacgttaactgtacctctgccttctcttgactgagagatcaccttctcttagcaacgatatgtctcaccacatatttgaggatatctactctagttatgagagataacactaaaagataactattgcaca

SEQ ID NO: 856 - DNA, 1478 bp, Secale cereale
gactccggtgctcttcgtctggtcaatcccctccgcgtttcttgcacattggagccaaagatggcaaggtcagccatgtccgggctagtgctcctgctgctctgtgcaacctgcagattggcgctaggaatcaccgatgggctgctggcgaacggcaacttcgagcgcgggccgcagctgtcgcagctgcgcgggacgcaggtggtgggcgcgtcgtcgatcccgtcgtggcggacgtcggggttcgtggagtacatcccgtcggggcggaagcagggggacatggtgctggtcgtccccgagggcgcctacgccgtgcgcctgggcaacgaggcgtccatcgcgcagcgtctccgcggcgccgtccccggcgcgttctacagcctcaccttcagcgcggcgaggacgtgcgcgcaggcggagcggctcaacgtgtccgcgtccggccagtcgggcgtgctggtcatgcagaccatgtacagcagcaacggctgggactcctactcctgggcctgggacgccaccgccgacgaggtcgaggtcgtcatccacaaccccggcgtcaccgaggaccccgcctgcggccccctcatcgactccgtcgccatcaagaccctcaccccgcctcgccgcaccaacaagaacctggtgaagaatggtgatttcgaggaggggccatacatcatccccgggaccaagtggggggtgctgatcccgtcgcggatggtggacgagcactcgccgctgccgggctggatggtggagtcgctcaaggccgtcaagtacatcgacagcgaccacttcgcggtgccccgggggcgccgggccgtggagctgctggcggggagggagagcgcgatcgcgcaggtgatccgcaccgtgccggggaagcagtacgcgctgtccttcagcgtgggcgacgccagcaacacatgccgagggtcgctcatggtggaggcctacgccggcagggagtcaaccaaggtgccgtacgagtcggcggggcaggggggcgccgccaagcgcgccgtgctcccgttccgcgccacgtcgtctcgcacgcgcgtcgtcttcttgagctccttctacaacaccaggaccgacgacatgagctcgctctgcgggccggtgatcgacgacgtcgccgtcgtcagcgtgcgcgcgcggccgccaaagcgcgcctagaacgctaagctagctggccgttgttgttgcatccgtgttaattagacaaccgctctgctcattgcttaagccctcaactcaaactgcttattgggttgagtgtgcgctaaggaattcgtcagagtctcggagaagtttttttttttttttagtacaagagtctcggagaggtgccaccctcagtatgtcactagctgttggcagggccgggccggcaaaatccgatgccctgtgtcaaaatctgaaacggtgacctatctcatataaaaaaatcaattaataaaaattcagtc

SEQ ID NO: 857 - DNA, 1242 bp, Hordeum vulgare
tgcagttaacgtcttccaagttcctgacgaattccttcgtgcacattcaagctcaatgagcagtttgagcgcccaagcagtgaacagctgcctaattaacacggatgcagcagcagcagcaacaacaacgccgtgcacccagcacactgtatggccagctagctcagccttctaggcgcgctttgggtgccgcgcgcgcacgctgacgactgcgacgtcgtcgatcaccggcccgcagagcgagctcatgtcgtcggtcctggtgttgtagaatgagctgaagaagacgacgcgcgtgcgaggcgacgtggcgcggaacgggagcacggcacgcttggcggcgccgccctgccccgccgactcgtacggcaccttggccgactccctgccggcgtaggcctccaccatgagcgagccgcggcatgtgttgctggcgtcgcccacgctgaaggacagcgcgtactgcttccccggcacggtgcggatcacctgcgcgatggcgctctccctcccggccagcagctccacggcccgacgcccccgcggcaccgcgaagtggtcgctgtcgatgtacttgacggccttgagcgactccaccatccaccccggcagcggcgagtgctcgtccaccgtccgcgacgggatcagcaccccccactttgtcccggggatgatgtatggcccctcctcgaaatcaccattcttcaccagattgcacgagtgctcactgttggtgcggcgaggcggggtgagggtcttgatggcgacggagtcgatgagggggccgcaggcggggtcctcggtgacgccggggttgtggacgacaacctcgacctcgtcggcgctggcgtcccaggcccaggagtaggagtcccagccgttgctgctgtacatggtctgcatgaccagcacacccgactggccggacgcggacacgttaagccgctccgcctgcgcgcacgtcctcgccgcgctgaaggtgaggctgtagcgcgcaccggggaccgcgccgcggagacgctgcgcgatggacgcctcgttgcccaggcgcacggcgtaggcgccctcggggacgaccagcaccatgtccccctgcttttgccccgacgggatgtactccacgaaccccgacgtccgccacgacgggatcgacgacgcgcccaccacctgcgtcccgcgcagctgcgacggctgcggcccgcgctcgaagttgccgttcgccagcagccctgagagagacca

SEQ ID NO: 858 - DNA, 1463 bp, Sorghum bicolor
aggccacattgatcgatcaatcagaagttcagagcaacacgattcgaagtgcagagtctgttcatctctttagatcgagagcaaattggagctagatgggaagattatccatggccgtgccagtgatgcttctgctgctgtgcgcaacgtgcagactggcgcttggaattactgacggtctgctcccgaacggcaacttcgagcggggcccggcgccgtcgcagctgcgcgggacgcgggtgatgggctcgtcggcgatcccggcgtggcagacgtcggggttcgtggagtacatcccgtcggggcggaagcagggggacatggtgctggtggtgcccgagggcgcctacgccgtgcggctcgggaacgaggcctccatccggcagcggctccacggcgccgcccgcggcgcgcgctactcgctcacgttcagcgcggcgcggacgtgcgcgcaggcggagcagctcaacgtgtcggcgtcggggcagtcgggcctgctggcgatgcagaccatgtacagcagcaacggctgggactcgtacgcctgggcctgggtggccgacgccgacgaggtcgacgtcgtcatccacaaccccggcgtcccgaggaccccgcctgcggcccgctcatcgactccgtcgcgatcaagacgctcaacccgcctcgccggaccaacaagaacctggtgaagaacggcgacttcgaggagggcccgtacatcatcccggggacgaaatggggcgtgctgatcccgtcgagggtggtggacgaccactcgccgctgcccgggtggatggtggagtcgctcaaggccatcaagtacatcgacagcgacagcttcgcggtgccgcggggccggcgcgccgtggagctgctggccgggagggagagcgccatcgcgcaggtgatccgcaccgtgccggggcggcagtacgcgctgtccttcaccgtcggcgacgccagcaacgcctgccgtgggtcgctcatggtggaggcatacgccggccgggagtccaccaaggtggcgtacgagtcggcggggaagggcggcgtcaagcgcgccgtgctgccgttccgcgccgcgtccgcgcgcaccaggctcgtcttcttcagctccttctacagcaccaggagcgacgacctcagctcgctctgcgggccagtgctcgacgacgtcgccgtcgtcagcgtgcgcactaccaagcgcggctagagagcaaaagtccggtggtcggtggagctcggccgggcgtgcgagagggagacggagtaactattttcttgatgttgttaccgcacggttgctttgccgtgattgtatgtagctgctcgttgtcgttgggggcatcagaaaatttgttcgaaccatggggaaactggcgtgtcagatagtactagtatatggtttctacatttccactactactttattaagttttcatccacatggtcctgtgtttttt

SEQ ID NO: 859 - DNA, 1896 bp, Sorghum bicolor
gtggaatcttgctctatattatataagctggaccctgcaaattgatcgcattttgttccagcaataagaagggttactgattgatcctgaacatggactcatgttcttgactctgccagatcatgaagaccgcacgttgcaggttctgacataactgaatcttgcagtggtgagaggtaacgcctcagtggcagaactgttaattgcgcccaaatcgaggtgcagccccggaggtcgccttccactccatttaagcaccgcgccctcctcactccacctctcaggccacattgatcgatcaatcagaagttcagagcaacacgattcgaagtgcagagtctgttgatctctttagatcgagagcaaattggagctagatgggaagattatccatggccgtgccagtgatgcttctgctgctgtgcgcaacgtgcagactggcgcttggaattactgacggtctgctcccgaacggcaacttcgagcggggcccggcgccgtcgcagctgcgcgggacgcgggtgatgggctcgtcggcgatcccggcgtggcagacgtcggggttcgtggagtacatcccgtcggggcggaagcagggggacatggtgctggtggtgcccgagggcgcctacgccgtgcggctcgggaacgaggcctccatccggcagcggctccacggcgccgcccgcggcgcgcgctactcgctcacgttcagcgcggcgcggacgtgcgcgcaggcggagcagctcaacgtgtcggcgtcggggcagtcgggcctgctggcgatgcagaccatgtacagcagcaacggctgggactcgtacgcctgggcctgggtggccgacgccgacgaggtcgacgtcgtcatccacaaccccggcgtcccgaggaccccgcctgcggcccgctcatcgactccgtcgcgatcaagacgctcaacccgcctcgccggaccaacaagaacctggtgaagaacggcgacttcgaggagggcccgtacatcatcccggggacgaaatggggcgtgctgatcccgtcgagggtggtggacgaccactcgccgctgcccgggtggatggtggagtcgctcaaggccatcaagtacatcgacagcgacagcttcgcggtgccgcggggccggcgcgccgtggagctgctggccgggagggagagcgccatcgcgcaggtgatccgcaccgtgccggggcggcagtacgcgctgtccttcaccgtcggcgacgccagcaacgcctgccgtgggtcgctcatggtggaggcatacgccggccgggagtccaccaaggtggcgtacgagtcggcggggaagggcggcgtcaagcgcgccgtgctgccgttccgcgccgcgtccgcgcgcaccaggctcgtcttcttcagctccttctacagcaccaggagcgacgacctcagctcgctctgcgggccagtgctcgacgacgtcgccgtcgtcagcgtgcgcactaccaagcgcggctagagagcaaaagtccggtggtcggtggagctcggccgggcgtgcgagagggagacggagtaactattttcttgatgttgttaccgcacggttgctttgccgtgattgtatgtagctgctcgttgtcgttgggggcatcagaaaatttgttcgaaccatggggaaactggcgtgtcagatagtactagtatatggtttctacatttccactactactttattaagttttcatccacatggtcctgtgtttttttggggggaagaatgctccatatagtattttttgacgctaaaacattgacaagaattgaagaacgcggtgtccggattaattagagcccgagtgagaatacgagaaaaaatgaaacagaatttggatgaaatgaaactctcagattatttta

SEQ ID NO: 860 - DNA, 1428 bp, Oryza sativa
aggtcaggtcaccatttccaagaactcagagctctcttccaccggtcatctcctccatctccggccaggctagccatggcggccggctcggcgtcgctgctgctgctaatggtggtgctctgcgcggcggcgagcggaacggcgctcgccgccatcaccgacgggctgctggcgaacggcaacttcgagcgcgggccggcgccgtcgcagctgcgcgggacgcgggtggtcggcgcgtcggcgatcccgtcgtggcggacgtcggggttcgtggagtacatcccgtcggggaggaagcagggggacatggtgctggtggtccccgaggggagccacgcggtgcggctcgggaacgaggcgtcgatccggcagcggctcgccggcgcggcgcgcggcgcgcggtacgcgctcacgttcagcgcggcgcggacgtgcgcgcaggcggagcggctgaacgtgtcggcgtcggggcagtgggcggtgctccccatgcagaccatgtacagcagcaacggctgggactcgtacgcctgggcctgggatgccgccgccgacgcgttcgacgtcgtcatccacaaccccggcgtcaccgaggaccccgcctgcggccccctcatcgactccgtcgccatccgcaccctcaaccctcctcgccgcaccaacaagaacctggtgaagaacggggacttcgaggagggcccgtacatcatcccggggactaggtggggggtgctgatcccgtccatggtggtggacgagcactcgccgctgccggggtggatggtggagtcgctcaaggcggtgaagtacatcgacagcgaccacttcgcggtgccgcgcgggcggcgcgctgtcgagctgctggcggggcgggagagcgcgatcgcgcaggtgatccgcaccgtccccgggaggcagtacgcgctgtcgttcaccgtcggcgacgccagcaacggctgcgaggggtcgctggtggtggaggcgtacgccgggagggagtccaccagggtggcgcacgagtcggctggccgcggcggcgccgccaagcgcgccgtgctgccgttccgcgccgccgcggcgcgcacccgcgtcgtgttcttcagctcgttctacagcaccaggagcgacgacatgagctcgctctgcgggccggtgatcgacgacgtcgccgtcgtcagcgtgcgcgcgcggcggccggcggcgaagcgcggctagggtctagctagcgccattgccgcgatgtcgtactactatttagttgttgattgtttcgtttgtatgtaagaccaagaaattggtcgatcgagaatatatataattattattattttgtcggttcctggtatatatttgaattttgcagtttaagcatgcgttagaaaatcagttcgactgaataataatacaatatttcgtgctctcgaatta

SEQ ID NO: 861 - DNA, 1445 bp, Oryza sativa
aggtcaggtcaccatttccaagaactcagagctctcttccaccggtcatctcctccatctccggccaggctagccatggcggccggctcggcgtcgctgctgctgctaatggtggtgctctgcgcggcggcgagcggaacggcgctcgccgccatcaccgacgggctgctggcgaacggcaacttcgagcgcgggccggcgccgtcgcagctgcgcgggacgcgggtggtcggcgcgtcggcgatcccgtcgtggcggacgtcggggttcgtggagtacatcccgtcggggaggaagcagggggacatggtgctggtggtccccgaggggagccacgcggtgcggctcgggaacgaggcgtcgatccggcagcggctcgccggcgcggcgcgcggcgcgcggtacgcgctcacgttcagcgcggcgcggacgtgcgcgcaggcggagcggctgaacgtgtcggcgtcggggcagtgggcggtgctccccatgcagaccatgtacagcagcaacggctgggactcgtacgcctgggcctgggatgccgccgccgacgcgttcgacgtcgtcatccacaaccccggcgtcaccgaggaccccgcctgcggccccctcatcgactccgtcgccatccgcaccctcaaccctcctcgccgcaccaacaagaacctggtgaagaacggggacttcgaggagggcccgtacatcatcccggggactaggtggggggtgctgatcccgtccatggtggtggacgagcactcgccgctgccggggtggatggtggagtcgctcaaggcggtgaagtacatcgacagcgaccacttcgcggtgccgcgcgggcggcgcgctgtcgagctgctggcggggcgggagagcgcgatcgcgcaggtgatccgcaccgtccccgggaggcagtacgcgctgtcgttcaccgtcggcgacgccagcaacggctgcgaggggtcgctggtggtggaggcgtacgccgggagggagtccaccagggtggcgcacgagtcggctggccgcggcggcgccgccaagcgcgccgtgctgccgttccgcgccgccgcggcgcgcacccgcgtcgtgttcttcagctcgttctacagcaccaggagcgacgacatgagctcgctctgcgggccggtgatcgacgacgtcgccgtcgtcagcgtgcgcgcgcggcggccggcggcgaagcgcggctagggtctagctagcgccattgccgcgatgtcgtactactatttagttgttgattgtttcgtttgtatgtaagaccaagaaattggtcgatcgagaatatatataattattattattttgtcggttcctggtatatatttgaattttgcagtttaagcatgcgttagaaaatcagttcgactgaataataatacaatatttcgtgctctcgaattacaatttgaaaataaaaa

SEQ ID NO: 862 - DNA, 1524 bp, Zea mays
catgttcttgaccctgccaacaccgcacgttgcaggttctgacatacagtttctgaggtcgcctcccactccatttaagcacccgcgccctcctcactcctccgcacgccacattgatcgatcgaacgatctatcagaagttcagaatctatctctctgctcctggttcaccattgcgcaaattggagcaagatgggaaggctagccctggctgtgccggtgatgcttctgctgctttgcacgacgtgcagactgacgctcggaattacagacggtctgctcccgaacggcaacttcgagcggagcccgctgccgtcgcagctgcgggggacccgggtggtgggcgcgtcggcgatcccgtcgtggcagacgtcggggttcgtggagtacatctcgtcggggcagaagcagggtgacatggtgctggtggtgcccgagggcgcctacgccgtgcggctcgggaacgaggcgtccatccggcagcggctccggggcgccgcccgcggcgcgcgctactcgctcacgttcagcgcggcgcggacgtgcgcgcaggcggagcagctgaacgtttctgcgtcggggcagtcgggcctgctggccatgcagaccatgtacagcagcaacgggtgggactcgtacgcctgggcctgggtcgccaacgccgacgaggtcgacatcgtcatccacaaccccggcgtcaccgaggaccccgcctgcggcccgctcatcgattccgtcgccatcaagacgctcaacccgcctcgtcgcaccaacaagaacttggtcaagaatggtgacttcgaggagggcccgtacatcatcccggggaccaagtggggcgtgctgatcccatcgcgcgtggtggaggaccattcgccgcttccggggtggatggtggagtcgctcaaggccatcaagtacatcgacggcgagagcttcgccgtgccgcggggtcggcgcgccgtggagctgctggccgggagggagagcgcgatcgcgcaggtcatccgcaccgtgccggggcgacagtacgtgctgtccttcaccatcggcgacgccagtaacgcctgccgcggctcgctcatggtggaggcatacgcgggccgggagtccaccaaggtggcgtacgagtcggcggggaagggcggcgtgaagcgcgccgtgctgccgttccgcgccgcgtcggcgcgcaccaggctcgtcttcttcagctccttctacagcaccaggagcgacgacctcagctcgctatgcgggccagtgcttgatgacgtcgtcgtcgtcagcgtgcgcacgaagcgcggctagagaagcgtgctctgtggagttggggcgtgccctgtgcgtgcgaaacggaggaatttttcatgctgctgtcatcgcacgggtactttactaccgtgtttgtaggtgctcgttgggggcatcagaaaattgctccaaccatcggaaatttgttgtgttagattattgacagtctgtttggttagcagcgcggcatgatccagagtgatccggacctgt

SEQ ID NO: 863 - DNA, 1389 bp, Panicum virgatum
gttcgaccagaacgacacgatccaaaagggcggcagggcctgttcgtctcctagatcgagaggcatctttggttccttgcaaaccggagcaagatgggaaggtcatccatggctgggccggcgatgcttctgctgctctgcacagtgtgcagactggcgctcggaattactgacgggctgctcccgaacggcaacttcgagcgcgggccggtgccgtcgcagctgcgggggacgcgggtgctgggctcgtcggcgatcccgtcgtggcagacgtcggggttcgtggagtacatcccgtcggggaagaagcagggggacatgctgctggtggtgccggagggcgcctacgccgtgcggctcgggaacgaggcgtcgatccgacagcggctccgcggcgccgcccgcggcgcgcgctactcgctgacgttcagcgcggcgcggacgtgcgcgcaggcggagcagctcaacgtgtcggcgtccgggcagtcgggcctgctggccatgcagaccatgtacagcagcaacgggtgggactcgtacgcctgggcctgggtcgccgacgctggcgaggtcgacgtcgtcatccacaaccccggcgtcaccgaggaccccgcctgcggcccgctcatcgactccgtcgccatcaagacgctcaacccgccgcgccgcacgaacaggaacctggtgaagaacggcgacttcgaggagggcccgtacatcatcccggggaccaggtggggcgtgctgatcccgtcgcgcgtggtggacgaccactcgccgctgcccgggtggatggtggagtcgctcaaggccgtcaagtacatcgacggcggcagcttcgcggtgccgcgggggcggcgcgccgtggagctgctggcggggagggagagcgcggtggcgcaggtgatccgcaccgtgccggggcggcgctacgcgctgtccttcacggtgggggacgccggcaacgcctgccgcgggtcgctcatggtggaggcctacgcggggcgggagtccaccaaggtggcgtacgagtcggcggggaagggcggcgtgaagcgcgccgtgctgccgttccgcgctgcctccgcgcgcacgcgcatcgtcttcttcagctccttctacagcaccaggagcgacgacctcagctcgctctgcgggcccgtcctcgacgacgtcgccgtcgtcagcgtgcgggcgaagcgcggctagacaccaagcaagccggaccgaggagtcgttcttcttgctgtaagcctgtaatgctgttgttatggcggttatacttgccggcagcctgtgttagctggctgctcgttggacgataaaaaaaaatgttcgaaactaggaggttctcaaattataaatggcccttcttgtgttccatacttc

SEQ ID NO: 864 - DNA, 1565 bp, Setaria italica
ccctgcaggccacattgatcgatcagaacgacccgatccaaagtgcagggcctgttcagctcttagatcaagacgtgcctttggtaccttgcagatcggagcaagatgggaaggttagccatggctgggccagtgatccttcttctgctctgcacaatgtgcagattggcgctcggaatcactgacgggctgctcccgaatggcaacttcgagcgcgggccgctgccgtcgcagcttcgcgggacgcgggtgctgggctcgtcgtcgatcccgtcgtggcagacgtcggggttcgtggagtacatcccgtcggggcagaagcagggcgacatgctcctggtggtccccgagggcgcctacgccgtgcgcctcgggaacgaggcctccatccggcagcgcctccgcggcgccgcccccggggcccgctactccctcacgttcagcgcggcgcggacgtgcgcgcaggcggagcgcctgaacatctcggcgtccgggcagtcgggcctcctggcgatccagaccacgtacagtagcaacgggtgggactcgtacgcctgggcctgggtcgccgccgtcgactcctccggcgaggtcgaggtctccatccacaaccccggcgtcgccgacgacccggcctgcggcccgctcatcgactccgtcgccgtcaaggcgctcaacccgccccgccggaccaaccggaacctggtgaagaacggggacttcgaggagggtccctacatcctcccggggaccaagtggggcgtgctgatcccgtcgcgggtggtggacgaccactcgccgctcccggggtggatggtggagtcgctcaaggcggtgaggtacgtcgacggcgggagcttcgcggtgccccggggccggcgcgccgtggagctgctggcggggagggagggcgcggtggcgcaggtggtccggaccgtgccggggcggcggtacgcgctgtcgttcacggtcggggacgccggcaacgcctgccgcgggtcgctcgtcgtggaggcgtacgccgggagggagtccgtgaaggtggcgtacgagtcggaggggaagggcggcgccaggcgcgccgtgctgccgttccgcgccgcggcggcgcgcacgaggatcgtcttcttcagctcgttctacagcaccaggagcgacgacctcagctcgctctgcgggcccgtgctcgacgacgtcgccgtcgtcagcgtgcgcgccaagcgcgggtagagcaagccggatggatcgatgcaattctgcttcttgttgttatggaccatacatggcggttagttgccgcgtgtttacctgcgttgggagcataaaaaatttttcaatcgggagggttctcaaatatacatgcatggttaccttctcgcattccataatctctattgtcctgcctcccagattacgatcaaggtaatagagtaaataactgtatcttggaaccatttggatcacaaataatctgaaataaactgcttaagagtagcttatttgaaattattggtggtcccatagcgatactcaagtatttttttaccataatacccataacccac

SEQ ID NO: 865 - DNA, 1569 bp, Leymus cinereus x Leymus triticoides
  misc_feature (785)..(785): n is a, c, g, or t
  misc_feature (1468)..(1468): n is a, c, g, or t
  misc_feature (1480)..(1480): n is a, c, g, or t
  misc_feature (1488)..(1488): n is a, c, g, or t
  misc_feature (1497)..(1497): n is a, c, g, or t
  misc_feature (1513)..(1514): n is a, c, g, or t
  misc_feature (1517)..(1517): n is a, c, g, or t
  misc_feature (1525)..(1526): n is a, c, g, or t
  misc_feature (1529)..(1529): n is a, c, g, or t
ccgttgctgtcgaagctaagctctttagccatggcggccaccacagtgccgctcctcctcctcctcgccgccacagtcgctgcggccaccgacctctccgtctaccacaacgtccaccctccgtccgcctccccgctcgagtccatcatctctctcgcccgcgacgacgacgcgcgcctcctcttcctctcctccaaggccgcctccaccggcgttacctccgcgcccgtcgcctccggccagaccccgccctcctacgtcgtgcgcgctgggctcggctcgccggcccagcccatcctcctggccctcgacaccagcgccgacgccacctgggcgcactgctccccgtgcggcacctgccccaccaactgcctcttcgtcccggccaactcctcctcctacgcgcccctcccctgctcctcgtccatgtgctccatcctccagggccaaccctgcccggaccgggaccccttcgacagcgcggtgccgctgccgtcgtgcgccttctcgaagccattcgccgacgcctccttccaggcggcgctggccagcgactggctgcatctgggcaaggactccatccccaactacgcgttcgggtgcgtgggctcggtgagcgggccgacgtccaacctgccgaagcaggggctcctgggtctaggccgggggcccatggccctgctgtcccaggtcgggaacatgtacagtggcgtcttctcctactgcctcccgagctacaagtcgtactacttctccggctcgctccggctgggcaccgccggacngcccagggccgcgcggtacacgccgatgctgaagaacccccaccggtcgtcgctgtactacgtgaacgtgacggggctgagcgtggggcggtccccggtgaaggtgcccgcggggtcgttcgcgttcgacccgaacacgggcgcgggcacggtggtcgactccggcacggtgatcacgcggtggacggcgcccgtgtacgcggcgctgcgggaggagttccggcgccacgtggcggcgccgagcgggtacacgtcgctgggcgcgttcgacacgtgcttcaacacggacgaggtggcggccgggggcgcgccggccgtgacgatccacatggacggcggcgtggacctggcgctgccgatggagaacacgctgattcacagcagcgcgacgccgctggcgtgcctggccatggccgaggcgccgcagaacgtgaactccgtcgtcaacgtcgttgccaacctgcagcagcagaacctccgggtcgtcttcgacgtcgccaactcgcgggtcggcttcgcccgggagtcctgcaactagttcccacgagacgagcttggcatgttcatgcagttaatcgaaaccttagccatgcatggatgtacgtatgattgttgatttgcggcttaattttcagtgtgtgcaataaggaatgtggcatcaaagtttgtcacgggtgcgcgtntgttgtgctgtncgtgtcgntagaactantagccgtaactatttnntgngtggttcnnttnattaataggaatctataaatcccgaacgtgttttctcaaa

SEQ ID NO: 866 - DNA, 1663 bp, Triticum aestivum
aacccctatataaacccatgccacactcctcactccctcgcagtgaccgacactttcctagctcaagctaagctccgcaaccatggcgcccaccaggttgcctctcctcctcctcctcgccgccactgtcgctgccgcggccgacctgtccgtctaccacaatgtccaccctccgtccgcctccccgctcgagtccatcatcgcgctcgcccgcgacgacgacgcgcgcctcctcttcctctcctccaaggccgcctccaccggcaccgcctcggcgcccgtcgcctccggccagaccccgccctcctacgtcgtgcgcgccgggctcggctcgccggcccagcccatgctcctggccctcgacaccagcgccgacgccacctgggcgcactgctccccgtgcggcacctgccccgccagcagcctcttcgtcccggccaactcctcctcctacgcgcccctcccctgctcctcgtccatgtgccccatcctccagggccagccctgcccggaccgggaccccttcgacagcgcggcgccgctgccgtcgtgcgccttctccaagccgttcgccgacgcctccttccaggcggcgctggccagcgactggctgcatctgggcaaggactccatccccaactacgcgttcgggtgcgtgggctcggtgagcgggccgacttccaacctcccgaagcaggggctcctgggcctaggccggggccccatggccctgctgtcccaggtcgggaacatgtacaacggcgtcttctcctactgcctgcccagctacaagtcgtactacttctccgggtcgctccggctgggcgccgccggccagccccgggccgcgcggtacacgccgatgctgaggaacccccaccggtcgtcgctgtactacgtgaacgtgacggggctgagcgtggggcggtccccggtgaaggtgcccgcggggtcgttcgcgttcgaccccagcacgggcgcgggcacggtggtggactccggcacggtgatcacgcggtggacggcgcccgtgtacgcggcgctgcgggaggagttccggcggcacgtggcggcgccgagcgggtacacgtcgctgggcgcgttcgacacgtgcttcaacacggacgaggtggcggccgggggcgcgccggccgtgacgatccacatggacggcggcgtggacctggcgctgccgatggagaacacgctgatccacagcagcgcgacgccgctggcgtgcctggccatggcggaggcgccgcagaacgtcaactccgtcgtcaacgtcgtcgccaacctgcagcagcagaacctccgggtcgtcttcgacgtcgccaactcgcgcgtcggcttcgcccgggagtcctgcaactagttcccacgaggcgacctttcttcacgtgttcatgcggttataatcgaatcattagccatgcatttgggtgtacgtacgtacgtactacgtgtgattgttaatttgcggcttagtaattttcagtgtgtgcaataaggaatgtggcatcaaagtttgtcacgggtgggtgcgcgtgtgttgtgctgtactacgtgtcgatagaactagagaattactgtagtactggtcgtaactatttactggtgtgatgtgtggtgcatttaattaacttgtttgtttcgtttggct

SEQ ID NO: 867 - DNA, 1594 bp, Triticum aestivum
tcctagctcaagctaagctccgcagccatggcggccaccaggttgcctctcctcctcctcctcctcgccgccaccgtcgctgcggcggccgacctctccgtctaccacaacgtccaccctcagtccgcctccccgctcgagtccatcatcgcgctcgcccgcgacgacgacgcgcgcctcctcttcctctcctccaaggccgcctccgccggcgccgcctcggcgcccgtcgcctccggccagaccccgccctcctacgtggtgcgcgccgggctcggctcgccggcccagcccatgctcctggccctcgacaccagcgccgacgccacctgggcgcactgctccccgtgcggcacctgccccgccagcagcctcttcgtcccggccaactcctcctcctacgcgcccctcccctgctcctcgtccatgtgccccatcctccagggccagccctgcccggaccgggaccccttcgacagcgcggcgccgctgccgtcgtgcgccttctccaagcccttcgccgacgcctccttccaggcggcgctggccagcgactggctgcatctgggcaaggactccatccccaactacgcgttcgggtgcgtgggctcggtgagcgggccgacgtcgaacctcccgaagcagggcctcctgggcctgggccggggccccatggccctgctgtcccaggtcgggaacatgtacaacggcgtcttctcctactgcctcccgagctacaagtcgtactacttctccgggtcgctccggctgggcgccgccgggcagccccgggcggcgcggtacacgccgatgctgaggaacccgcaccggtcgtcgctctactacgtgaacgtgacggggctgagcgtggggcggtccccggtgaaggtgccggcggggtcgttcgcgttcgaccccagcacgggcgcgggcacggtggtggactccggcacggtgatcacgcggtggacggcgcccgtgtacgcggcgctgcgggaggagttccggcggcacgtggcggcgccgagcgggtacacgtcgctgggcgcgttcgacacgtgcttcaacacggacgaggtggcggccgggggcgcgccggccgtgacgatccacatggacggcggcgtggacctggcgctgccgatggagaacacgctgatccacagcagcgcgacgccgctggcgtgcctggccatggcggaggcgccgcagaacgtcaactccgtcgtcaacgtcgtcgccaacctgcagcagcagaacctccgggtcgtcttcgacgtcgccaactcgcgcgtcggcttcgcccgggagtcctgcaactagttccgacacgagacgacatttcttcacgtgtttatgcggttattaatcgaatcattagccatgcatttgggtgtacgtacgtacgtacgtgtgcgtgtgattgttaatttgcggcttagtaattttcagtgtgtgcaataaggaatgtggcatcaaagtttgtcacgggtgggtgcgcgtgtgttgtgctgtactacgtgtcgatagaactagagaattactgtagtactggtcgtaactatttactggtgtgatgtgtggtgcatttaat

SEQ ID NO: 868 - DNA, 1557 bp, Secale cereale
gtctccgtctaccacaaccgtccaccctccgtccgctccccgctcgagtccatcatctctctcgcccgcgacgacgacgcgcgcctcctcttcctctcctccaaggccgcctccgccggcgccgcctcagcgcccgtcgcctccgggcagaccccgccctcctacgtcgtgcgcgccgggctcggctccccggcccagcccatcctcctggccctcgacaccagcgccgacgccacctgggcgcactgctccccgtgcggcacctgccccaccagcagcctcttcgtcccggccaactcctcctcctacgcgcccctcccctgctcctcgtccatgtgccccatcctccagggccagccctgcccggaccgggaccccttcgacagcgcggcgccgctgccgtcgtgctccttctcgaagccgttcgccgacgcctccttccaggcggcgctggccagcgactggctgcatctgggcaaggactccatccccaactacgcgttcgggtgcgtgggcgcggtgagcgggccgacgtccaacctgccgaagcaggggctcctggggctaggccggggccccatggccctgctgtcccaggtcgggaacctgtacagcggcgtcttctcctactgcctgccgagctacaagtcgtactacttctccggctcgctccggctgggcgccgccggccagccccggggcgcgcggtacacgccgatgctgaggaacccgcaccggtcgtcgctgtactacgtgaacgtgacggggctgagcgtggggcggtcgccggtgaaggtgccggcggggtcgttcgcattcgaccccagcacgggcgcgggcacggtggtggactccggcacggtgatcacgcggtggacggcgcccgtgtacgcggcgctgcgggaggagttccggcggcacgtggcggcgccgagcgggtacacgtcgctgggcgcgttcgacacgtgcttcaacacggacgaggtggcggccgggcgcgcgccggccgtgacggtccacatggacggcggcgtggacctggcgctgccgatggagaacacgctgatccacagcagcgcgacgccgctggcgtgcctggccatggcggaggcgccgcagaacgtcaactccgtcgtcaacgtcctcgccaacctgcagcagcagaacctccgggtcgtattcgacgtcgccaactcgcgcgtcggcttcgcccgggagtcctgcaactagttcccacgacacggcctttcttgacgtgttcttatgattgttagtcgagagattagccatgcatttgggtgtaccgtgtacgtacgtacgtgtgattgttgatttgcggcttgattttcagttgtgtgcaataaggagtgtggcatcaaagtttgtcacgggtgggtgcgcgtgttgtgctgtgcgtgtcgatagaacttgagaattactgtagtcgccgtaactatttttactggcgtggtgtgtggttcatttaattaacttgtttgtttcgtatggctgctgcgcaaggtgcacgttggagactttcacgctgcacaaaaagtc

SEQ ID NO: 869 - DNA, 1629 bp, Brachypodium distachyon
acttcacagagtcacagtgaccgacactctccctacctaagctagctagccagccgaagccaagctcccacgccatggcggccaccagaatcccgctcatcctcctcctcgcaatcgccaccattgcggcggcggccgacctgtccgtgtaccacaacgtgcacccaccgtccagctccccgctggagtccatcatcgcgctggcccgcgaggacgacgcgcgcctcctcttcctctcctccaaggcggcctccacgggggtctcctcggcgccggtcgcgtcgggccagagcccgccgtcctacgtggtccgggccgggctagggtccccggcccagcccatcctcctcgccctcgacaccagcgcggacgccacctgggcgcactgctccccgtgcggcacgtgccccagcagcggcagcctcttcgccccggccaactccacctcctacgcccccctcccttgctcctccaccatgtgcacggtcctccagggccagccctgcccggcccaggacccctacgacagctcggccccgctgcccatgtgcgccttcaccaaacctttcgccgacgcctccttccaggcctcccttgccagcgactggctgcacctgggcaaggacgccatccccaactacgccttcgggtgcgtcagcgccgtgtccgggccgacggccaacctcccgaagcaggggctcctgggcctgggccgcgggcccatggctttgctatcccaggtcgggaacatgtacaacggcgtcttctcctactgcctgcccagctacaagtcctactacttctccggctcgctccgcctcggcgccgccggccagcccaggggcgtgcggtacacgccgatgcttaagaacccaaaccgctcttcgctctactacgtgaacgtgacgggcctcagcgtgggccgggcccctgtcaaagtgccggcgggctcgttcgcgttcgacccggccacgggggccggcacggtggtggactccggcacggtgatcacccggtggacgccgcccgtgtacgcggcgctgcgggaggagttcaggcgccacgtggcggcgccgagcgggtacacgtcgctgggcgcgttcgacacgtgcttcaacacggacgaggtggcggccggcgtggcgcccgccgtgacggtccacatggacggcggcctcgacctggcgctgccgatggagaacacgctcatccacagcagcgccacgccgctggcgtgcctggccatggccgaggcgccgcagaacgtcaacgccgtcgtcaacgtcctcgccaacctgcagcagcagaacctcagggtcgtcttcgacgtcgccaactcccgcgtcggcttcgcgagggagtcctgcaactaatcggtcatctaccccggcttgtgcaataaggggacgtgattaagtggcatatcgaattaagttcgtgacgggtgtgttctgtgtgtgtgtttcgtacgtgtcgataggactcgctagggaccggattactcggaactattactgctgtactgtgtgagatttgtcattgtctgttgcattggttgatttgcaggtgttcgatcacgacttgaaatgaaatgaagaaagttaccgtgcagatacagacaagtacggt

SEQ ID NO: 870 - DNA, 1731 bp, Brachypodium distachyon
aaaacacgcaacatcctaaaataatcagtcacccaaaaccaaaaccccgttatataaacccatcacaccctccactcactctctcacttcacagagtcacagtgaccgacactctccctacctaagctagctagccagccgaagccaagctcccacgccatggcggccaccagaatcccgctcatcctcctcctcgcaatcgccaccattgcggcggcggccgacctgtccgtgtaccacaacgtgcacccaccgtccagctccccgctggagtccatcatcgcgctggcccgcgaggacgacgcgcgcctcctcttcctctcctccaaggcggcctccacgggggtctcctcggcgccggtcgcgtcgggccagagcccgccgtcctacgtggtccgggccgggctagggtccccggcccagcccatcctcctcgccctcgacaccagcgcggacgccacctgggcgcactgctccccgtgcggcacgtgccccagcagcggcagcctcttcgccccggccaactccacctcctacgcccccctcccttgctcctccaccatgtgcacggtcctccagggccagccctgcccggcccaggacccctacgacagctcggccccgctgcccatgtgcgccttcaccaaacctttcgccgacgcctccttccaggcctcccttgccagcgactggctgcacctgggcaaggacgccatccccaactacgccttcgggtgcgtcagcgccgtgtccgggccgacggccaacctcccgaagcaggggctcctgggcctgggccgcgggcccatggctttgctatcccaggtcgggaacatgtacaacggcgtcttctcctactgcctgcccagctacaagtcctactacttctccggctcgctccgcctcggcgccgccggccagcccaggggcgtgcggtacacgccgatgcttaagaacccaaaccgctcttcgctctactacgtgaacgtgacgggcctcagcgtgggccgggcccctgtcaaagtgccggcgggctcgttcgcgttcgacccggccacgggggccggcacggtggtggactccggcacggtgatcacccggtggacgccgcccgtgtacgcggcgctgcgggaggagttcaggcgccacgtggcggcgccgagcgggtacacgtcgctgggcgcgttcgacacgtgcttcaacacggacgaggtggcggccggcgtggcgcccgccgtgacggtccacatggacggcggcctcgacctggcgctgccgatggagaacacgctcatccacagcagcgccacgccgctggcgtgcctggccatggccgaggcgccgcagaacgtcaacgccgtcgtcaacgtcctcgccaacctgcagcagcagaacctcagggtcgtcttcgacgtcgccaactcccgcgtcggcttcgcgagggagtcctgcaactaatcggtcatctaccccggcttgtgcaataaggggacgtgattaagtggcatatcgaattaagttcgtgacgggtgtgttctgtgtgtgtgtttcgtacgtgtcgataggactcgctagggaccggattactcggaactattactgctgtactgtgtgagatttgtcattgtctgttgcattggttgatttgcaggtgttcgatcacgacttgaaatgaaatgaagaaagttaccgtgcagatacagacaagtacggtaaaaaaaaatggtctat

SEQ ID NO: 871 - DNA, 2676 bp, Oryza sativa
cgggaaaaatgccactcctccccgcgccgttccgacctctcgctcccgccgccgccgcggcctccgccgcaccgcgccgcgccaccgccggagaggggggccgctcgtcgctcaccggggcgttctgttcctaagcatcggcgccgccagcgccgccgccgtcgcctgcaggacggggtgcgccttctcccgccgccgcttccccttcctcggggtaagaggtctcagctctgctcggatggagtccgcttccaccaccgtgccatccattgttgtgtatgtgactgttccaaacagggaagcagggaagaagctgtcacagagcatcatcagtgagaaactagctgcttgtgtcaatatagtgcctggcattgaatctgtttattggtgggagggaaaggtgcaaactgatgctgaagagttactcataatcaagactagagaatctcttctagatgccttgactgaacatgtcaaagctaaccatgaatacgatgttcctgaagttatcgctcttcccataactggtggtaacaccaagtacctggagtggatcaagaacagcaccaaggcaaactgatctggcattcaccctgttgtatacgcgcgctgcagacccgcagctcaaaaatatccaacaacatgaagtaactgatcggatgttctctgtttggcctatgtatcacagtgacatttgctgcaaggaatatatgtgtggttgccatcttgtgagttctgatgagtaacttgggtctataattctgctcacataaaaaatcgattcagtactcatacttgtgaattgctgcccttgatttggtattctcatatgaagtttttctagcgatgcaaatgatgaagatctttaagatcgatgtaaacataccaattcacactggtaaaaccctgagtacgtacgtaatcacctagatatagccctattggcacatacagatgagacaggcgcccgtgaccaagttttgatgtcacgtataccttattgcacagatcggaaagctacaagcccacaagaggacaccgtgatttcagaaagggaaaagaagagaatacatagactgcacaagccgttctcgtgcatttgctagcagcagcttggctctagatgagatagcggtagatcatcttaattaatcttaattcttaattagttgcaggactccttggcgaagccgacgcgggagttggcgacgtcgaagacgacccggatgttctgctgctgcaggttggcgatgacgttgacgacggagttgacgttctgcggcgcctcggccatggcgaggcaggccagcggcgtggcgctgctgtggatgagcgtgttctccatcggcagcgccaggtccacgccgccgtccatgtgcaccgtcaccgcgggggctccgccggcggccacctcgtcggtgttgaagcacgtgtcgaacgcgcccagcgacgtgtacccgctcggcgccgctacctgccgccggaactcctcccgcagcgccgcgtacaccggcgccgtccaccgcgtgatcaccgtgccggagtccaccaccgtgccggcgccggtggcggcgtcgaacgcgaacgatcccgcggggaccttcacccacgcgtgccccacgctgagccccgtcacgttcacgtagtagagagacgacctgtgcgggttcctcagcatcggcgtgtaccggacgctcctcggctgcccgccgccggcgcccagccggagcgagccggagaagtagtatgacctgtagctcgggaggcagtaggagaagacgccattgtacaagctcccggcctgggagagcagcgccatggggccacgcccgaggccgagcagcccttgccttggcatgttcgtcgtcggccccgtcaccgagctcacgcacccgaacgtgtagttcgggatggcgtccttgcccagcctcagcgtgtcgctggcgagcgccgcctggaacgacgcgtcggcgaacggcttggagaaggcgcacgtcggcagcgtcgccggcggcggcgccgcgtcgccgccgccctgcggcgccgggcacgcctggccctggaacagcgggcaccacgacgaggagcacgggagggaggcgtaggaggaggagttggccggggcgaagaggctgctgctcgggcacgtgccgcacggcgagcagtgcgcccacgtcgcgtcggcgctggtgtcgagcgccagcagcagctgctgcgacggcgagccgaggccggcccggacgacgtaggacgggggggcctggccggaggcgacgggggcggaggagacgccggcggtggctgccttggaggagaggaagaggaggcgggcgtcgtcgtcgcgggcgagcgcgatgatggactcgagcggggacggcgacgaggggtgcacgttgtggtacacggagagctcggcggcggcggcggcgacggtggcggccaggaggaggaggaggagagggatggtggtggtggccgccatggcaatggagctctcctggctaagctagcttgcttgctaagagagtgtcactgaggggagtgaggattgtgactgagcgagctgggtttatatagggtttctggctgttgatcctgtagtctttggcgccgatcgattgaatggtttgagcttaattacggcggcacggacaacatgacgggctaatagcgcac

SEQ ID NO: 872 - DNA, 1757 bp, Oryza sativa
ctcactcccctcagtgacactctcttagcaagcaagctagcttagccaggagagctccattgccatggcggccaccaccaccatccctctcctcctcctcctcctggccgccaccgtcgccgccgccgccgccgagctctccgtgtaccacaacgtgcacccctcgtcgccgtccccgctcgagtccatcatcgcgctcgcccgcgacgacgacgcccgcctcctcttcctctcctccaaggcagccaccgccggcgtctcctccgcccccgtcgcctccggccaggcccccccgtcctacgtcgtccgggccggcctcggctcgccgtcgcagcagctgctgctggcgctcgacaccagcgccgacgcgacgtgggcgcactgctcgccgtgcggcacgtgcccgagcagcagcctcttcgccccggccaactcctcctcctacgcctccctcccgtgctcctcgtcgtggtgcccgctgttccagggccaggcgtgcccggcgccgcagggcggcggcgacgcggcgccgccgccggcgacgctgccgacgtgcgccttctccaagccgttcgccgacgcgtcgttccaggcggcgctcgccagcgacacgctgaggctgggcaaggacgccatcccgaactacacgttcgggtgcgtgagctcggtgacggggccgacgacgaacatgccaaggcaagggctgctcggcctcgggcgtggccccatggcgctgctctcccaggccgggagcttgtacaatggcgtcttctcctactgcctcccgagctacaggtcatactacttctccggctcgctccggctgggcgccggcggcgggcagccgaggagcgtccggtacacgccgatgctgaggaacccgcacaggtcgtctctctactacgtgaacgtgacggggctcagcgtggggcacgcgtgggtgaaggtccccgcgggatcgttcgcgttcgacgccgccaccggcgccggcacggtggtggactccggcacggtgatcacgcggtggacggcgccggtgtacgcggcgctgcgggaggagttccggcggcaggtagcggcgccgagcgggtacacgtcgctgggcgcgttcgacacgtgcttcaacaccgacgaggtggccgccggcggagcccccgcggtgacggtgcacatggacggcggcgtggacctggcgctgccgatggagaacacgctcatccacagcagcgccacgccgctggcctgcctcgccatggccgaggcgccgcagaacgtcaactccgtcgtcaacgtcatcgccaacctgcagcagcagaacatccgggtcgtcttcgacgtcgccaactcccgcgtcggcttcgccaaggagtcctgcaactaattaagaattaagattaattaagatgatctaccgctatctcatctagagccaagctgctgctagcaaatgcacgagaacggcttgtgcagtctatgtattctcttcttttccctttctgaaatcacggtgtcctcttgtgggcttgtagctttccgatctgtgcaataaggtatacgtgacatcaaaacttggtcacgggcgcctgtctcatctgtatgtgccaatagggctatatctaggtgattacgtacgtactcagggttttaccagtgtgaattggtatgtttacatcgatcttaaagatcttcatcatttgcatcgctagaaaaacttcatatgagaataccaaatcaagggcagcaattcacaagtatga

SEQ ID NO: 873 - DNA, 1575 bp, Oryza sativa
ctcactcccctcagtgacactctcttagcaagcaagctagcttagccaggagagctccattgccatggcggccaccaccaccatccctctcctcctcctcctcctggccgccaccgtcgccgccgccgccgccgagctctccgtgtaccacaacgtgcacccctcgtcgccgtccccgctcgagtccatcatcgcgctcgcccgcgacgacgacgcccgcctcctcttcctctcctccaaggcagccaccgccggcgtctcctccgcccccgtcgcctccggccaggcccccccgtcctacgtcgtccgggccggcctcggctcgccgtcgcagcagctgctgctggcgctcgacaccagcgccgacgcgacgtgggcgcactgctcgccgtgcggcacgtgcccgagcagcagcctcttcgccccggccaactcctcctcctacgcctccctcccgtgctcctcgtcgtggtgcccgctgttccagggccaggcgtgcccggcgccgcagggcggcggcgacgcggcgccgccgccggcgacgctgccgacgtgcgccttctccaagccgttcgccgacgcgtcgttccaggcggcgctcgccagcgacacgctgaggctgggcaaggacgccatcccgaactacacgttcgggtgcgtgagctcggtgacggggccgacgacgaacatgccaaggcaagggctgctcggcctcgggcgtggccccatggcgctgctctcccaggccgggagcttgtacaatggcgtcttctcctactgcctcccgagctacaggtcatactacttctccggctcgctccggctgggcgccggcggcgggcagccgaggagcgtccggtacacgccgatgctgaggaacccgcacaggtcgtctctctactacgtgaacgtgacggggctcagcgtggggcacgcgtgggtgaaggtccccgcgggatcgttcgcgttcgacgccgccaccggcgccggcacggtggtggactccggcacggtgatcacgcggtggacggcgccggtgtacgcggcgctgcgggaggagttccggcggcaggtagcggcgccgagcgggtacacgtcgctgggcgcgttcgacacgtgcttcaacaccgacgaggtggccgccggcggagcccccgcggtgacggtgcacatggacggcggcgtggacctggcgctgccgatggagaacacgctcatccacagcagcgccacgccgctggcctgcctcgccatggccgaggcgccgcagaacgtcaactccgtcgtcaacgtcatcgccaacctgcagcagcagaacatccgggtcgtcttcgacgtcgccaactcccgcgtcggcttcgccaaggagtcctgcaactaattaagaattaagattaattaagatgatctaccgctatctcatctagagccaagctgctgctagcaaatgcacgagaacggcttgtgcagtctatgtattctcttcttttccctttctgaaatcacggtgtcctcttgtgggcttgtagctttccgatctgtgcaataaggtatacgtgacatcaaaacttggtc

SEQ ID NO: 874 - DNA, 1804 bp, Setaria italica
cagcgaaccccatgttcctatataaaccccgcacctcacactcacgccctcacactcaactgacacctcccagctcgctcgccatggcggccaccaccctcctcgtcctcctcctggccgccactgcggcctcggccgccgacctgtccgtgtaccacaacgtgcacccgccgtccccgtcccccctggagtccatcatcgcgctggcgcgcgccgacgacgcgcgccttctcttcctctcgtccaaggcggcggcctcgcccggcgtcacctcggcgcccgtggcctccggtcaggccccgccgtcgtacgtcgtccgcgcggggctcggcaccccggtgcagcagaccctcctcgcgctcgacaccagcgccgacgccacctgggcgcactgcgccccctgcgacacctgccccgccggcagccgcttcatccctgccagctcctcctcgtacgccgcgctcccgtgcgcctccgactggtgcccgctcttccaggggcagccgtgcccggcgaaccaggacgccggcgcgtcgatgccgacgtgcgccttctccaagcccttcgccgacgcctccttccaggcgtcgttgggcagcgacacgctgcgcctgggcaaggacgccatcgccaactacgcgttcgggtgcgtgggcgccgtgaccgggccgaccaccaacctgcccaagcagggtctcctcggcctcggccgtggccccatgtccctgctgtcccagaccgggagcaggtacaacggcgttttctcctactgcctgccgagctacaagtcttactacttctcggggtcgctccggctgggcgccgccgggcagccccggaacgcccggtacacgccgctgctgagcaacccgcaccggccgtcactgtactacgtgaacgtgacggggctgagcgtgggtcgggcgtgggtgaaggtccccgcgggggcgttcgcgttcgaccccgccaccggagccggcacggtgatagactccggcacggtgatcacgcggtggacggcgcccgtgtacgcggcgctgcgggaggagttccggcggcaggtgggcgcgcccagcgggtacacgtcgctgggcgccttcgacacgtgcttcaacacggacgaggtggcggcgggcggcgcgccggccgtgacgctgcacatggacggcggcgtcgacctcacgctgcccatggagaacacgctcatccacagcagcgccacgccgctggcgtgcctcgccatggccgaggcgccgcagaacgtcaactccgtcgtcaacgtcgtggccaacctgcagcagcagaacgtacgggtcgtcgtcgacgtcgccgcctcgcgcgtcggcttcgcgagggagccctgcaactagacactccccacccccattgtgtttcgtttccagtgttgtgtgtgcaataagaagggacgtgacgtgacacgaaaaatattggttcgtcacgggtagctagaggatcacgtagtaaagattctgccagagtgtgtattgctttcgttttttttcaatgttttgtatggctgttgcaagatattaattgatttgcgaaaattcgatgggggcttgttcgccaacgaccgtgtcacgagcatgcacagtagaaaagcatcttggaatggacggaattgcactcgtacgttctacgcgagaggattgcgatacacaagctgtcactcggccgtatctggacgtgcagtgtcttcttctggttggtcgttcatctcagtaacccagtagaggctctaacacgtcaacacctggctcgccggtttacagagcctggcgcg

SEQ ID NO: 875 - DNA, 1555 bp, Panicum virgatum
gcttgctcgccagtcgccatggcggccaccaccatcctcctcctcctcgtcctcgccgccactgcggcctcggccgccgacctctccgtgtaccacaacgtgcacccgccgtccccgtccccgctcgagtccatcatcgcgctcgcgcgcgccgacgacgcgcgcctcctcttcctctcctccaaggccgccgcctcgcccggcgtcacctccgcgcccgtcgcctccggccaggccccgccctcgtacgtcgtccgagccgggctcggcaccccggtgcagcagaccctcctcgcgctcgacaccagcgccgacgccacctgggcgcactgcgccccatgcgacacgtgccccgcgggcagccgcttcatcccggccagctcttcctcgtacgcggcgctcccgtgcacctccgactggtgccccctcttccagggccagccgtgcccggcgaaccaggccgccagcttggcgctgcccgcgtgcgccttctccaagccgttcgccgacgcctccttccaggcgtcgctgggcagcgacacgctgcggctgggcaaggacgccatcgccaacttcgccttcgggtgcgtgggcgcggtgaccgggccgaccacgaacctgccgaagcaggggctcctcggcctcggccgtggccccatgtccctgctgtcccagaccgggagcaggtacaacggcgtcttctcctactgcctcccgagctacaagtcgtactacttctccggctcgctccggctgggcgccgccggccagcccaggaacgtccggtacacgccgctgctgagcaacccgcaccggccgtcgctctactacgtgaacgtgacggggctcagcgtggggcggacgtgggtgaaggtacccgcgggggcgttcgcgttcgacgccaacaccggcgccggcacggtgatcgactccggcacggtgatcacgcggtggacggcgcccgtgtacgcggcgctgcgggaggagttccggcggcaggtgggcgcgccgagcgggtacacgtcgctgggcgcgttcgacacgtgcttcaacacggacgaggtggcggcgggcggcgcgccggccgtgaccctgcacatggacggcggcgtggacctgacgctgccgatggagaacacgctgatccacagcagcgcgacgccgctggcgtgcctggccatggccgaggcgccgcagaacgtcaactccgtcgtcaacgtggtggccaatctgcagcagcagaacgtccgggtcgtcgtcgacgtcgccggctcgcgcgtcggcttcgccagggagccctgcaactgagccccaatccgccgcccgtagccgtgcatgtttccagttccagtgttgtgtgtgtgcaataagggacgtgacgtgacacgaagaagaattggttcgtcacgggtagctagaaagaccaacgtaagaatctgccatgccagagtgtgtatcgctgtcgttttttattgttttggttgtttttgttttttgtatggatgtagctgttgcaagagaacagaaaacgacattctacgcactcattctacgc

SEQ ID NO: 876 - DNA, 1818 bp, Zea mays
ccaaaatcctagctaaagcatcaccatcgcagtacgcactccgagaacccagctatataaacccacctcgcacactcatcactctcacactctgcccagctaagctccctccgtccatcggcatggcgactaccactactaccatcctcctcctcctcctcgtcgcagccactgccgtctcggcggccgacctctccgtgtaccacaacgtgcacccgccgtccccgtccccgctcgagtccatcatcgcgctcgcccgcgccgacgacgcgcggctcctcttcctctcatccaaggcggcctcgtccggcggcgtcacctccgctcccgtcgcctccggccagactccgccctcgtacgtcgtccgcgcggggctcggcaccccggtccagcagctgctcctcgcgctcgacaccagcgccgacgccacctggtcgcactgcgcgccgtgcgacacgtgccccgccggcagccgcttcatcccggccagctcctcctcgtacgcctccctcccgtgcgcctccgactggtgcccgctcttcgagggccagccgtgcccggcgaaccaggacgcctcggcgccgctgccggcgtgcgccttctccaagccgttcgcggacacctcgttccaggcgtcgctgggcagcgacacgctgcgcctgggcaaggacgccatcgccggctacgcgttcgggtgcgtgggcgcggtggccgggccgacgaccaacctgccgaagcaggggctcctcggcctcggccggggccccatgtctctgctgtcccagaccgggagcaggtacaacggcgtcttctcctactgcctgcccagctacaggtcctactacttctccggctccctccggctgggcgccgccgggcagcccaggaacgtccggtacacgccgctgctgaccaacccgcaccgcccgtcgctctactacgtgaacgtgacggggctcagcgtggggcggacctgggtgaaggtccccgcggggtcgttcgcgttcgacccggccaccggcgccggcacggtgatcgactcgggcacggtgatcacgcggtggacagcgcccgtgtacgcggcgctgcgcgaggagttccggcggcaggtggcggcgccgagcgggtacacgtcgctgggagcgttcgacacgtgcttcaacacggacgaggtggcggcgggcggcgcgccgcccgtgacgctgcacatggacggcggcgtggacctgacgctgccgatggagaacacgctgatccacagcagcgccacgccgctggcgtgcctggccatggccgaggcgccgcagaacgtgaacgccgtcgtgaacgtggtggccaaccttcagcagcagaacgtgcgggtcgtcgtcgacgtcgccggctcgcgcgtcgggttcgcgagggagccctgcaactgagcccctgaatccgtccgtgccctatgcacgggaggaaggaggagacgcgctgcggctgccgcatcggtcggtgtgcagttagttgtcctgttagtctatgctacgttgtctgcactctgcaataacggacgtgacccggggaaaaaaactgtttcgtcacgggtagctagagaatcacgtaatggctcttgttttcgtttgtgtcctataatgtatggctattggcctgtttcgagaggttaaaatttggaggtgctgcatcaaattcgtacgtcgacagtgtcagactcacgagcgtgtacagcacagtacaaaagctgccttgtcatggatacgcgagaggatggcgatgcgattcacaagctgtcacttgaccgtatctctgaacgtgtaccatttc

SEQ ID NO: 877 - DNA, 1630 bp, Panicum virgatum
ggtcgacccacgcgtccgcggacgcgtgggcccccgctagccagtagcttgctcgccagtggccatggcggccaccaccaccatctttctcctcctcctcctcgccgccagtagtgcggcctcggccgccgacctctccgtgtaccacaacgtgcacccgccgtccccgtccccgctcgagtccatcatcgcgctcgcgcgcgccgacgacgcgcgcctcctcttcctctcctccaaggccgccgcctcgcccggcgtcacctccgctcccgtcgcctccggccaggccccgccctcgtacgtcgtccgtgccgggctcggcacccccgtgcagcagaccctcctcgcgctcgacaccagcgccgacgccacctgggcgcactgcgccccctgcgacacgtgccccgccggcagccgcttcatcccggccagctcctcctcgtacgccgcgctcccctgcgcctccgactggtgcccgctcttccagggccagccgtgcccggcgaaccagcaggccgcgctgccggcgtgcgccttctccaagcccttcgccgacgcctccttccaggcgtcgctgggcagcgacacgctgcggctgggcaaggacgccgtcgccaacttcgccttcgggtgcgtgggcgcggtgaccgggccgacggcgaacctgcccaagcaggggctcctcggcctcggccgtggccccatgtccctgctgtcccagaccgggagcaggtacggcggcgtcttctcctactgccttccgagctacaagtcctactacttctccggctcgctccggctgggcgccgctggccagcccaagaacgtccggtacacgccgctgctgagcaacccgcaccggccgtcgctgtactacgtgaacgtgacggggctcagcgtggggcgggcgtgggtgaaggtgcccgcgggggcgttcgcgttcgacgccggcaccggcgccggcacggtgattgactccggcacggtgatcacgcggtggacggcgcccgtgtacgcggcgttgcgggaggagttccggcggcaggtgggcgcgccgagcgggtacacgtcgctgggagccttcgacacgtgcttcaacacggacgaggtggcggcgggcggcgcgccggccgtgaccctgcacatggacggcggcgtggacctgacgctgcccatggagaacacgctgatccacagcagcgcgacgccgctggcgtgcctggccatggccgaggcgccgcagaacgtcaactccgtcgtcaacgtggtggccaacctgcagcagcagaacgtccgggtcgtcgtcgacgtcgccgcctcgcgcgtcggcttcgccagggagccctgcaactgagcgtctgagccccaatccgccgccgcccgtagccgtgcattatgtttccagttccagtgttgtggtgctgtgcaataagggacgtgacgtgacacgaacaagaattggttcgtttcgtcacgggtagctagaaagaccaacgtactagtaagaatctgccagtgtgtgtattatttctgtcgtttttttttggttttgttgtttttgtatggctgtagctgttgcaagagattactataatttgcgaaaatccgatggggcacttgtacgtcaaaa

SEQ ID NO: 878 - DNA, 2044 bp, Triticum aestivum
catccactcaagtgtacctgggagccacagcccacggtcatctcgcaacaatgtacaagatgaataggagaaggccagatgcatgaacccagacccagctccatgcctatataacgtgtcgaccaccgagcgatgcccaacgccatcttgtgtgacgccatcactgagagcgcgcgcagcagccactacacacagtatggctccgccgatctccgccgacgtcgtggtggaggccgcaccggcgcctgcgtccatggccgtgctaaaccaaatggtttgcgcgagcgcgccggcgccgatcatcaccgtcgtctccaagcagctggttctgccggagggcgcggcgccggttggagacctcaagctgtccgtctccgacatgcccatgctgtcgtgccactacattcagaaggggctcttcttcccgcccgcgggcatgccgaacgcccgcctcgtgtcgtcgctcgcgctgtcactgtcccgcgcgctcggcgtcttcccggcgctcgcgggacggctcgtcacgctccccgacgaccgcatcgtcatccggtgcgacgacggcgctgccgtcgagttctaccatgcggtggcgcccgctctgtcgctcgccgacttcctcgtgcgcgacgccgacgtgcccaccaggctgacgaaagatctgttcccgatggaccgcaccgtcagctacgaaggccaccgccgcccgctcacgtcgtttcaggtcaccgtgctcggcgacggcgctgtctttgtcggcctcgtcgccaaccacgccgtcgtggacggcacctcattctggcacttcttcaacacgtgggctgggctgtgccgcggcgagccagtccagccgccggacttcagccgcaacttctttggcggctccacggccgtcctccgcttctccgggcgcgacggccccgcagtgacgttcgacgcatcggcgcccctccgtgagcgagtcatccacttcagcgccgcgtcaattcgcggcctgaaggcggcggccaaccgctgcagaaaaaccaacgaagatgacgaggttaacggcaagctcgtgcatgatctcaaggtccagggaggttgcggggagatctcctccttccagtcgatgtgcgcgcacatgtggagggccgtgacgcgagcgcggctgcagctggccgccgacgcgacgacaacgttccgcatggcggtgaactgccgtcaccgcctgcgcccgaagatctccccggtctacttcggcaacgccatccagagcgtggcgacgacggcgacggtggccgagctggcttcccacgacctcgggtgggcggcggccaagctgcacgcgaccgtggtggcgcacgaggacggcgccatccggcaggccgcggcggactgggaggcggcgccccggtgcttcccgctggggaaccccgacggcgcggcgctcaccatgggcagctcgccgcggttcccgatgtacgacggcaacgacttcggctggggcagagcgctcgccgtgcggagcggccgggcgaacaagttcgacggcaagatgtcggcgttcccgggccaggcgggggacggcagcgtggacgtggaggtgtgcctcgccccggacaccatgggccgcctcctctgcgacgacgagttcctgcagttcgtgtcccatgcaccttcaccttgatgcagtgcaccgcatctggccgccctgtgtgttgtaccactacagtaccagcgcataagatgtgacatggccacctgtgatcgatgtggtcacctggacatgtcacatgatgcatgtatgtaacacatgttgcgcagcagatacgtaatggatttgtatggttgcaagatatcaagaaatatcatggactggttggctactctgtatatccaggagtggccagctagataggatatgtagcggtgctactggcgctcaagtcgtgccgaagagggccaaaaccactgtatttttctccttttcttgtggaaacactgttatcattttattaacgaagttaagcatgatttgatcttgtttcgaaacttttgcatg

SEQ ID NO: 879 - DNA, 1545 bp, Secale cereale
accgtcgtctccaagcagctggttctgccggagggcgcgcccccggttggagacctcaagctgtccgtctccgacatgcccatgctgtcgtgccactacattcagaaggggctcttcttcccgcccgcgggcatgccgaacgcgcgcctcgtgtcgtcgctcgcgctgtcgctgtcccgcgcgctcggcgtcttcccggcgctcgcgggacggctcgtcacgctccccgacgaccgcatcgtcatccggtgcgacgacggcgccgtcgagttctaccatgcggtggcgcccgctctgtcgctcgccgacttcctcgtgcgcgacgccgacgtgcccaccaggctgacgaaagatctgtttcccatggaccgcaccgtcagctacgaaggccaccgccgcccgctcacgtcgtttcaggtcaccgtgctcggcgacggcgctgtctttgtcggcctcgtcgccaaccacgccgtcgtggacggcacctcgttctggcacttcttcaacacgtgggctgggctgtgccgcggcgagccagtccagccgccggacttcagccgcaacttcttcggtggctccacggccgtgctccgcttctccgggcgcgacggccccgcagtgacgttcgacgcatcggcgcccctccgtgagcgagtcatccacttcagcgccgcgtcaattcgcggcctgaaggcggcggccaaccgctgcagaaaacccaacgaagatgacgaggttaacggcaagctcgtgcatgatctgaaggtccagggaggttgcggagagatctcctccttccagtcgatgtgcgcgcacatgtggagggccgtgacgcgagcacggctgcagctggccgccgacgcgacgacaacgttccgcatggcggtgaactgccggcaccgcctgcgcccgaagatctccccggtctacttcggcaacgccatccagagcgtggcgacgacggcgacggtggccgagctggcctcccacgacctcgcgtgggcggcggccaggctgcacgcgaccgtggtggcgcacgaggacggcgccatccggaaggccgcggcggactgggaggcggcgccccggtgcttcccgctggggaaccccgacggcgcggcgctcaccatgggcagctcgccgcggttcccgatgtacgacggcaacgacttcggctggggcagggcgctcgccgtgcggagcggccgggcgaacaagttcgacggcaagatgtcggcgttcccgggccaggccggggacggcagcgtggacgtggaggtgtgcctcgccccggacaccatgggccgcctcctgtgcgacgacgagttcctgcagttcgtgtcccatgcaccttgatgcagtgcaccgcatctggccgccccgtgtgttgtaccactacagtaccagcgcataagatgtgacatggccacctgtgatcgatgtggtcacctggacatgtcacatgcatgtatgtaacacatgttgcgcagcagatacgtaatggatttgtatgattgcaagatatcaagaaatatcgtggactgg

SEQ ID NO: 880 - DNA, 1778 bp, Brachypodium distachyon
tcttgtgtgacgccgtatcaccgagcagcacagcagccactccagataagaagagaacatggctccgccggtgtccgccgacgccgttgtggtcgaggctgcccctgctgcggcagcgtccaaggtggccgtgctaaaccagatggtctgcacgagcgtagtaccggcggcgccgatcgtcaccgtcgtctccaagcagaccgttgtgccagagggcgtgtgggcagcaacaggagacctcaagctgtccgtctccgacatgcccatgctgtcgtgccactacattcagaagggcctgttcttccccaagcctccagttggcatgccaatcactgccagcctcgcgacggcgctcgcccgcgcgctcgctgtcttcccggcgctcgccggacggctcgtcacgctccccgacgaccgcatcgtcatccggtgcgacgaaggcgcgtccgtggagttgtaccacgcggtggcgcctgctctgtcgctggccgatttcctcgtgccggacgccgacgtgccgaccaggctgaccaaagacctgttccccatggaccgcaccgtgagctacgagggccaccgccgccggctcacgtccttccaggtgaccgtgctcggcgacggcgccgtcttcgttggcttcgtcgccaaccacgccgtcgtggacggcacctccttctggcacttcttcaacacgtgggccgggctttgccgcggcgcggaggctccggaagtacagccgccagacttccgccgcaacttcttcggcgactccacggccgtcctccgcttccccggaagcgagggccccgcggtgacgttcgacgccgcggcgcccctccgcgagcgcgtcatccacttcagcgccgcggcgatccgcgacatgaaggcagcggccaaccgcagaaaaaccagtggtcgagctaaagataatgccgaggttaacggcaagctcgcccatgactcgagggagatctcctcgttccagtcgctgtgcgcgcacatgtggagggccgtgacgcgggcgcggctgcgtctgtcggcggacgcggtcaccacgttccgcatggccgtcaactgccggcaccggctgcgcccgagcatctccccgctctacttcggcaacgcgatccagagcgtggcgacgcacgccacggtgtccgagctggcttccgaggactttccctgggcggcggcaaagctgcacgcgaccgtggtggcgcacgaggacggagccatccggcaggccgcggcggactgggaggccgcgcccaggtgcttcccgctgggcaacccggacggcgcggcgctcaccatgggcagctcgccacggttccccatgtacgacgggaacgacttcgggtggggccgcgcgctggccgtgcggagcggccgcgccaacaagttcgacggcaagatgtcggcgttcccgggacaggccggggacggcagcgtcgacgtcgaggtgtgcctcgcgccggacaccatggcgcgactcctcggggacgaggaattcctgcagtacgtgtcccgtgcaccgttgtgatgcacgggttttcgcagtgcaacgtatctggtccatcccgagatccgtgttgtactaccagcgcacgagatgtgacatgggacatggccatctctgatcgatgtgggcactgggtggagtactctggacatgtaacacatgttgctgcccggcacatgcatactggtctagctaccggatttgtatgatcgcaaaatatcacatgaagaaatatcaagtactagtccgatactgc

SEQ ID NO: 881 - DNA, 2598 bp, Brachypodium distachyon
cgatatccaaaaccatctacgtttaggatcagagggagcatgtgtacaaattttgtgctgatccgaagatattcggatcgaatgcaaacgtgcactgaaatgcgactcaccacaccttttcccttgtaacagcgacagcttgctgtgcgctagtcgtaaattatcccctttctaagcttctctgctctgtggccagcaggaacaggaggcgcaacttccttatcagcacatcttcatctgggagccacagacgtttcgcagaaatgtgcaacatgaacaggactacaggaacgatggaacgctactgcgcaggtgcacgaacccaaacccaacgccatgcctatataacgtgtcgagcacccggcaatgcccagcagcgccatcttgtgtgacgccgtatcaccgagcagcacagcagccactccagataagaagagaacatggctccgccggtgtccgccgacgccgttgtggtcgaggctgcccctgctgcggcagcgtccaaggtggccgtgctaaaccagatggtctgcacgagcgtagtaccggcggcgccgatcgtcaccgtcgtctccaagcagaccgttgtgccagagggcgtgtgggcagcaacaggagacctcaagctgtccgtctccgacatgcccatgctgtcgtgccactacattcagaagggcctgttcttccccaagcctccagttggcatgccaatcactgccagcctcgcgacggcgctcgcccgcgcgctcgctgtcttcccggcgctcgccggacggctcgtcacgctccccgacgaccgcatcgtcatccggtgcgacgaaggcgcgtccgtggagttgtaccacgcggtggcgcctgctctgtcgctggccgatttcctcgtgccggacgccgacgtgccgaccaggctgaccaaagacctgttccccatggaccgcaccgtgagctacgagggccaccgccgccggctcacgtccttccaggtgaccgtgctcggcgacggcgccgtcttcgttggcttcgtcgccaaccacgccgtcgtggacggcacctccttctggcacttcttcaacacgtgggccgggctttgccgcggcgcggaggctccggaagtacagccgccagacttccgccgcaacttcttcggcgactccacggccgtcctccgcttccccggaagcgagggccccgcggtgacgttcgacgccgcggcgcccctccgcgagcgcgtcatccacttcagcgccgcggcgatccgcgacatgaaggcagcggccaaccgcagaaaaaccagtggtcgagctaaagataatgccgaggttaacggcaagctcgcccatgactcgagggagatctcctcgttccagtcgctgtgcgcgcacatgtggagggccgtgacgcgggcgcggctgcgtctgtcggcggacgcggtcaccacgttccgcatggccgtcaactgccggcaccggctgcgcccgagcatctccccgctctacttcggcaacgcgatccagagcgtggcgacgcacgccacggtgtccgagctggcttccgaggactttccctgggcggcggcaaagctgcacgcgaccgtggtggcgcacgaggacggagccatccggcaggccgcggcggactgggaggccgcgcccaggtgcttcccgctgggcaacccggacggcgcggcgctcaccatgggcagctcgccacggttccccatgtacgacgggaacgacttcgggtggggccgcgcgctggccgtgcggagcggccgcgccaacaagttcgacggcaagatgtcggcgttcccgggacaggccggggacggcagcgtcgacgtcgaggtgtgcctcgcgccggacaccatggcgcgactcctcggggacgaggaattcctgcagtacgtgtcccgtgcaccgttgtgatgcacgggttttcgcagtgcaacgtatctggtccatcccgagatccgtgttgtactaccagcgcacgagatgtgacatgggacatggccatctctgatcgatgtgggcactgggtggagtactctggacatgtaacacatgttgctgcccggcacatgcatactggtctagctaccggatttgtatgatcgcaaaatatcacatgaagaaatatcaagtactagtccgatactgcagtcggaggagtgaccaggtagagctgcacagcgacactggtgtggtgccgctcaagactggaaccgacaatatgtaccaaagagtcaaagacatggcaaagcgctgacaacaacaagggaaaaaaaccgacatgctctgttcattatatcgttgtagtaccaaacatgagcaatagttatgagttttggagttgaaatgagacttcttagttactcctcgttacagaaagttcggcaagattttcaactaaaaccagttcaaagtcgtgcaaatttttaggtagaagtttggttctggagcgaggtgaaatggaatgtaacggttctatttttacagaaatggaatggaaggggatttttaggcctcttgactaccgtacagatgtagtacttgctccgtccaacaaaagatgtctcaagtttatcaaattcagatg

SEQ ID NO: 882 - DNA, 2570 bp, Triticum aestivum
cgctacgttcttgccggggttgttcttcttcgatttttagggttgcggagcccttggatttcgcgtagggaagcctcctcccggccgtgtgatggacgcgagggagatgtgaagcctggctgttaactgatgctcgtggagagattcggaggagaggagcgcgcggtgaggaggcggtggaggcggaagcgacggagagttgggcaccagcgcagccacggacgacgcgcagccgccgggggacgaggcctggaacagggctgctccgcccctcacggccgccgccgccgccgcctccatgggggagtcgctgctcaccgcgctctccatggacaccgccacggcccaccacccgcaccagggcccctccaccttcctctccatggacactgcctcccacgacgagttcgacctcttcctcccgccgccaggccccttccagcgctgcctccatgccgccgcagccgccccccctgacatcaacctccccctcgccgctgacccgtcgcctccccctccggccatgcagaccaccaacctccatgaatccaacgtcgacatgctggatgttggcctcggctgcccgcagctctatgactcggactcgcctgctgctgccgccgccacctcggccccagtgtccaccacaacaactgtccatgtgtctcacaccaagagctccggttccagcgccgcgcgcaagtgcgtgaagcggaacgatagcatctggggtgcatggttcttcttcacccactacttcaagccggtcatgtcggctgataagggcggcaagacgaaggcacccactgctgctgggaatggtaatagtgccacactggatgctttcctggtgcagcatgacatggagaacatgtacatgtgggtgtttaaggatcggccggagaatgccctggggaagatgcagctgaggagcttcatgaatggtcactcgcgccttggggagccacagtttcctttcagcgcagacaaagggtttgtgcgctcacaccggatgcagcgtaagcactaccgggggttgtcaaacccgcagtgccttcatgggattgagatcgtgcgggcaccaaacttagtgggtgttcctgaggccgatatgaagaggtggttcgagctcaccgggagagatgccaatttctccgttcccactgaggcggatgattttgaatcatggaggaatctgccgaccacggaatttgagctcgagaggcctgcaactgctgctccagcaaagagcacctcacatggccatcacaagaaggtgctgaatggttctggccttaacctgtcaacacatgcatcaaagcatggttctggggatggtatggacatctcaggcgtgtgccacaaacgtaggaaggattcctccccctctgccatggaagaggattgcagcaattcaaattcagacaaggttcaggacatggatgtgagccacacttttgagccatcatggacgaatgacttcactggtgtgatgcgtcatgcttctgggccagtaactgccgcaaaaacaatatatgaagatagcaagggctacttgatcatcattagcctgccatttgctgatatacagaaggtgaaggttacctggaagaacactcttacgaatggcgtcgttaagatatcatgcactagcgtgggacggatgccattcttgaagcgacatgatcggaccttcaagttgacggatccttcacctgagcattgtccaccaggggagttcatccgggaagttccattgcctacccggatcccagaagatgctactctggaagcatactgtgatgaatcaggaacaggcctagagattattgtccctaaacaccgtgctggacctgaagaacatgaagtccgtgtgtccctgaggcctccctcatcatggtgccaatgaaaacatgttgaaggtgtgtgatagatgttcatgtagtagttagagtgcccattattgtcagctgctcttgactgatcctttgctgtcttgtctgctaaccctctagtatgcggggagacaaggtgtggatgttaccatacaacaaatgcagctcagttttgctaattgtgacggagcagtcctagtcgattgaagcattctggtagttggaagttggcagctgtggaaatttaggggcatgctacaggccacaaggagcatatctggattactcactcgccctatgttttggtatcgttgctgggagtaccttgtgtattatcttttgcttttgtggaatttttctttgtatgaaaggtttgtcgcctgctcaatgtgcttccattccatctgtgcattactctggcgagcagtctgtttaggcatttatagttagttttcataggttggtgagaagtctgctttgtgggcgttcctggaaacttcatccaggaaaggagttcatgcaagtgtttctaggatttgtccatgttttgtgggtactatattgtttttattagcattcaaacgctttccagaaattggtgggaggcgagtgcaattgtttcaaggtaccagtgtaaacaatctgtcatcaatatagattttagtctttatcagt

SEQ ID NO: 883 - DNA, 2748 bp, Secale cereale
cccacccgctgctcatcaacattcaacaggaattcgatttgatttcgattggttgattgcaactccgccgcgagagaggccttcgctacgttctggcagaggttcttcttcttcgatttttagggttgcggagcccttggatttcgcgtaggaaaccctcctcccggccgtgtgatggacgcgagggagatgtgaagcctggctgttaactgatgctcgtggagagattcggaggagaggagcgcgcggtgaggaggcggtggaggcggaagcgccggagagttgggcaccagcgcagcgacggacgacgcgcagccgccgggggacgaggcctggaactgggctgctccgcccctgacggccgccgccatgggggagtcgctgctcaccgcgctctccatggacaccgccacggcccaccacccgcaccagggcccctccaccttcctctccatggacactgcctcccacgacgacttcgacctcttcctcccgccgccaggccccttccagcgctgcctccatgccgcggcagccgccccccctgacatcaacctccccctcgccgctgacgcgtcgcctccccctccggctatgcagaccaccaccctccatgaatccaacgtcgacatgctggatgttggcctcggctgcccgcagctctatgactcagactcgcctgctgctgccgccgcgacctcggccccggtgtccaccacaacaactgtccatgtgtctcacaccaagagctctggttccagcgccgcgcgcaagtgcgtgaagcggaacgatagcatctggggtgcatggttcttcttcacccactacttcaagccggtcatgtcagctgataagggcagcaagacgaaggcacccaccgctggtgggaatggtaatagcgccacactggatgctttcctggtgcagcacgacatggagaacatgtacatgtgggtgtttaaggatcggccggagaatgccctggggaagatgcagctgaggagcttcatgaatggtcactcacgccttggggagccacagtttcctttcagcgcagacaaagggtttgtgcgctcacaccggatgcagcgtaagcactaccgggggttgtcaaatccgcagtgccttcatgggattgagatcgtgcgggcaccaaacttagtgggtgttcctgaggctgatatgaagaggtggttcgagctcactgggagagatgccaatttctcggttcccactgaggcagacgattttgaatcatggaggaatctgccgaccacggaatttgagctcgagaggcctgcaactgctgctccagcaaagggcacctcacatggtcatcacaagaaggtgctgaatggttctggccttaacctgtcaacacatgcatcaaagcatggttctggggatggtttggacatctccggctcgtgccacaaacgtaggaaggattcctccccctctgccatggaagaggattgcagcaattcaaattcagacaaggttcaggacatggatgtgagccacacttttgagccatcatggacgaatgacttcaccggtgtgatgcgtcatgcttctgggccggtaactgccgcaaaaacaatatatgaagatagcaagggctacttgatcatcattagcctgccatttgctgatatacagaaggtgaaggttacctggaaaaatactcttacgaatggtgtcgttaagatatcatgcactagtgttggacggatgccattcttgaagcgacatgaccggaccttcaagttgacggacccttcacctgagcattgtccaccaggggagttcatccgggaagttccattgcctacccggatcccagaagatgctactctggaagcatactgtgatgaatcaggaacaggcctagagattattgtccctaaacaccgtgctggacctgaagaacatgaagtccgtgtgtccctgaggcctccctcgtcatggtgccaatgaaaacatgttgaaggtgtgtgatagaagttcatgtagtagttagtgttcattattgtcagctgctcttgaccgatcctttgctgtctgctgaccctctagtctgtggggagacaaggtgtggatgttaccatacgacaaatgcagctcagttttgctaattgtgacggagcagtcctagtcgattgaagcattctggtagttggaagttggcagctgtggaattttagggacatgctacaggccacaaggaacacatctggattacccgcgcgccctatgtttcggcatcgttgctggggaataccttgtgtattatcttttgcttttgttgaatttttctttgtatggaaggtttgtggcctgctcaatgtgctttcgtctgtgcattactctggtgagcagtctgtttaggcatttatagtcagatttcataggttggtgagaagtctgctttgtgggcattcttggaaatttcatccaagaaaggagttcatgcaagtgtttctaggatttgtccatgttttgtcggtactattgttgttatcatcattcgaacgctctctgggaaattgctggaaggcgagtgcaattgtttgaaggtaccaataccaatgtaaacaatctgtcatcaatatagattttactagtctttatacaaaaaaaagttaaaaaaaaaaaaaaaaaaacaaaaaaaaaaaaaactaaaaaagagaagtactaccgaacggaacgaccaacgaagggaaggtagagccccccccccccccc

SEQ ID NO: 884 - DNA, 2308 bp, Triticum aestivum
acgacgcgcagccgccgggggacgaggcctggaacagggctgctccgccgctgacggccgccgccgccgcctccatgggggagtcgctgctcaccgcgctctccatggacaccaccacggcccaccacccgcaccagggcccctccaccttcctctccatggacactgcctcccacgacgaattcgacctcttcctcccgccgccaggccccttccagcgctgcctccatgccgccgcagccgccccccctgacatcaaccttcccctcgccgctgacccgtcccctccccctccggccctgcagaccaccaccctccatgaatccaacgtcgacatgctagatgttggcctcggctgcccgcagctctatgactcggactcgcctgctgctgccgccgccacctcggccccagtgtccaccacaacaactgtccatgtgtctcacaccaagagctccggttccagcgccgcgcgcaagtgcgtgaagcggaatgatagcatctggggtgcatggttcttcttcacccactacttcaagccggttatgtcggctgataagggcagcaaggccaaggcacccgctgctgccgggaatggtaatagtgccacactggatgctttcctggtgcagcatgacatggagaacatgtacatgtgggtgtttaaggatcggccggagaatgccctggggaagatgcagctgaggagcttcatgaatggtcactcgcgcctcggggagccacagtttcctttcagcgcagacaaagggtttgtgcgctcacaccggatgcagcgtaagcactaccgggggttgtcaaacccgcagtgccttcatgggattgagatcgtgcgggcaccaaacttagtgggtgttcctgaggccgatatgaagaggtggttcgagctcaccgggagagatgccaatttctccgttcccactgaggcggatgattttgaatcatggaggaatctgccgaccacggaatttgagctcgagaggcctgcaactgctgctccagcaaagagcacctcacatggccatcacaagaaggtgctgaatggttctggccttaacctgtcgacacatgcatcaaaacatggttctggggatggtatggacatctcagctgtctgccacaaacgtaggaaggattcctccccctctgccatggaagaggattgcagcaattcaaattcagacaaggttcaggatatggatgtgagccacacttttgagccatcatggacaaatgacttcaccggtgtgatgcgtcatgcttctgggccagtaactgccgcaaaaacaatatatgaagatagcaagggctacttgatcatcattagcctgccatttgctgatatacagaaggtgaaggttacctggaagaacactcttacgaatggcgtcgttaagatatcatgcactagtgtcggacggatgccattcttgaagcgacatgaccggaccttcaagttgacggatccttcacctgagcattgtccaccaggggagttcatccgggaagttccattgcctacccggatcccagaagatgctactctggaagcatactgtgatgaatcaggaacaggcctagagattattgtccctaaacaccgtgctggacctgaagaacatgaagtccgtgtgtccctgaggcctccctcatcatggtgccaatgaaaacatgttgaaggtgtgtgatagatgttcatgtagtagttagagtgtctattattgtcagctgctcttgactgatcctttgctgtcttgtctgctaaccctctagtatgcggggagacaaggtgtggatgttaccatacaacaaatgcagctcagttttgctaattgtgacggagcagtcctagtcgattgaagcattctggtagttggaagttggcagctgtggaaatttaggggcatgctacaggccacaaggaacatagcgccctatgttttggtatcgttgctggggagtaccttgtgtattatcttttgatttgtggaatttttgtttgtattaaaaggtttgtcgcctgctcaatgtgcttccatctgtgcattactctggtgagcagtctgtttaggcatttatagtcagttttcataggttggtgagaagtctgctttgtggtcattcttggaaatttcatccaagaaaggagctcatgcaagtgtttgtaggatttgtccatgttttgtcggtactattgtttttatcagcattcgaacgctttccaggaaattgctggaaggcgagtgcaattgtttgaaggtaccaatgtaaacaatctgtcatcaatata

SEQ ID NO: 885 - DNA, 2519 bp, Brachypodium distachyon
agggggggaaaggaccctatcttctctcagccgtggaatggacgcgagggaggtgtgaagcctggttgttaactgatgctcgtggagagatttgggggagaggagcgcgcggtgaggaggcggtggaggcggaagcgccgaagggttggacaccagcgcagcgacggacgacgcgcagtcggcgggggacgaggcctcgaagaaggctgctccgccactgacggccgccgacgctgccgccatgggggagtcgctgctcaccgcgctctccatggataccgccacggcccaccatccgcaccagggcccctccaccttcctctccatggacaccgcctcccacgacgatttcgacctcttcctcccgccgccggggcccttccaacgctgcctccatgccgcggcggccgccccccctgacatcaacctccccctcgccgctgacccctcccctccccctcccgccctgcagacaaacactctccatgaatccaacgtagacatgctagatgtcggcctcggctgcccgcagctctatgactcagactcgcctgctgctgctggggtggcctctgccccagtatccacaatgacaattgtccctgtgtctcacacaaagagctccggttccagcgccgcacgcaagtgcgtgaagcggaacgatagcatctggggtgcatggttcttcttcacccactacttcaagccggtcatgtcggctgataagggtggcaagtcaaaggcagccacggccggtgtgaatggtaataatgccacgctggatgctttcctggttcagcacgacatggagaacatgtacatgtgggtgtttaaggaccggccagagaatgccctggggaagatgcagctgaggagcttcatgaatggtcactcacgccttggtgagccgcagtttcctttcagcgcagacaaagggtttgtgcgctcacaccggatgcaacgtaagcattatcgtgggctgtcaaacccccagtgccttcatgggattgagattgtgcggacaccgaatctggtgggtgtgcctgaggccgatctgaagaggtggtttgagctcaccgggagggatgccaatttctcgatccccactgaggcgggtgattttgagtcatggaggaatcttccgagcacagaatttgagctcgagaggccagcaactgctgctccagcaaagagcaccgcacatggccatcacaagaagttgctgaatggttctggtcttaacctgtcaacacatgcatcgaagcatggttctggggatggtttggacatctcagctgtgtgccataaacgccgaaaggattcctccccctctgccatggaagaggactgcagcaattcaaattcagacaagttgcaggacatggatgtaagccacagctttgagccatcatggatgaatgacttctctggtgtaatgcgccatgcttctgggccagtaactgctgcaaaaacaatatatgaagatagcaagggctacttgatcatcattagtctgccatttgctgatatacaaaaggtgaaggttacatggaagaacactcccacaaatgggatcgttaagatatcatgcactagtgttggtcggatgccagtcctgaagcggcatgatcggaccttcaagttggcggattcttcccctgagcattgttcaccaggagattttattagggaagttacattgcctacccggattccagaagatgctactttggaagcatactgtgatgaaacaggaacaggtctagaaattattgttcctaaataccgtgttggtcctgaagaacatgaagttcatgtgtctctgaggcccccctcatcatggtgtcaatgaaatacaacttcaagtttgcgaggggacttgctgcggatgttaccatgcaacaatgcagttcagttttgctaattgtgatggaaacaatcctaatcagttgaagcattctggtaattgggagttgataactgcagcacttcaaacattttaggaacatgctataggtcacaagggacatttctggattacttgctttgtgtctcattatctttaccgtggaatacattatgtattaccgtttacttttgtcaaagttttctttgtatgaaaggcttgccgcttgtttggtgtgcttccatatgtgcattactgcggtgaactgtataggcacttatagtcaatttccataggggcgagaagtaagtttgtgggcattcttggaaactttatctcatttgtttgatgggaactaggaaaggagttgacagtgggtttgttgatgttttagggaactagtcttttgttagcatttgaacgttttccaggaattactggaaggcaagtgtaattgattgaagctaccaatgtaatctatctgttatcaaatatcaacatagactagtgttatcagttatgacttactagagcactgctgtagatttaactccaattccatatgcttcagttactatctagtaatatccatggttattgttttgttgtgttc

SEQ ID NO: 886 - DNA, 3297 bp, Brachypodium distachyon
gagggggaggggagaggaagggaggcccaattcatccatccacggatccaatccaaccgcacggcacgccagagcaccaccgcttttccgcgtcaaattacgggcgtgccactgccttccttctccttctcgtcgccttcccgatccaacccgagccaatccgcctgcgcaccaagccgtcaccgtcaagtaacggccccccaccctcccctcgtcccggctccttctgggggagggcgcctctcctcccccgcccccggtctgcgcccaccgtggcctttaactccccccttcctccgttaccgtctccctccttcccacctcccccacccgctgctcatcaacacgaattcgatttgatttcgattgattgattgcaactttgctgcgaggagggggggaacaggaggtcttcgctaagttcctggttgtttgttcttcgatttgagagtcgcggactccttggatttcctctaggtacgtggcgttcctgctgttagatttgcttggggtcggatctctctgttcctgtgaattgctgggatttttttttgttggatttaggtttttggtgggaggttgatgtggttcctgtgtgtgatttgcagggggggaaaggaccctatcttctctcagccgtggaatggacgcgagggaggtgtgaagcctggttgttaactgatgctcgtggagagatttgggggagaggagcgcgcggtgaggaggcggtggaggcggaagcgccgaagggttggacaccagcgcagcgacggacgacgcgcagtcggcgggggacgaggcctcgaagaaggctgctccgccactgacggccgccgacgctgccgccatgggggagtcgctgctcaccgcgctctccatggataccgccacggcccaccatccgcaccagggcccctccaccttcctctccatggacaccgcctcccacgacgatttcgacctcttcctcccgccgccggggcccttccaacgctgcctccatgccgcggcggccgccccccctgacatcaacctccccctcgccgctgacccctcccctccccctcccgccctgcagacaaacactctccatgaatccaacgtagacatgctagatgtcggcctcggctgcccgcagctctatgactcagactcgcctgctgctgctggggtggcctctgccccagtatccacaatgacaattgtccctgtgtctcacacaaagagctccggttccagcgccgcacgcaagtgcgtgaagcggaacgatagcatctggggtgcatggttcttcttcacccactacttcaagccggtcatgtcggctgataagggtggcaagtcaaaggcagccacggccggtgtgaatggtaataatgccacgctggatgctttcctggttcagcacgacatggagaacatgtacatgtgggtgtttaaggaccggccagagaatgccctggggaagatgcagctgaggagcttcatgaatggtcactcacgccttggtgagccgcagtttcctttcagcgcagacaaagggtttgtgcgctcacaccggatgcaacgtaagcattatcgtgggctgtcaaacccccagtgccttcatgggattgagattgtgcggacaccgaatctggtgggtgtgcctgaggccgatctgaagaggtggtttgagctcaccgggagggatgccaatttctcgatccccactgaggcgggtgattttgagtcatggaggaatcttccgagcacagaatttgagctcgagaggccagcaactgctgctccagcaaagagcaccgcacatggccatcacaagaagttgctgaatggttctggtcttaacctgtcaacacatgcatcgaagcatggttctggggatggtttggacatctcagctgtgtgccataaacgccgaaaggattcctccccctctgccatggaagaggactgcagcaattcaaattcagacaagttgcaggacatggatgtaagccacagctttgagccatcatggatgaatgacttctctggtgtaatgcgccatgcttctgggccagtaactgctgcaaaaacaatatatgaagatagcaagggctacttgatcatcattagtctgccatttgctgatatacaaaaggtgaaggttacatggaagaacactcccacaaatgggatcgttaagatatcatgcactagtgttggtcggatgccagtcctgaagcggcatgatcggaccttcaagttggcggattcttcccctgagcattgttcaccaggagattttattagggaagttacattgcctacccggattccagaagatgctactttggaagcatactgtgatgaaacaggaacaggtctagaaattattgttcctaaataccgtgttggtcctgaagaacatgaagttcatgtgtctctgaggcccccctcatcatggtgtcaatgaaatacaacttcaagtttgcgaggggacttgctgcggatgttaccatgcaacaatgcagttcagttttgctaattgtgatggaaacaatcctaatcagttgaagcattctggtaattgggagttgataactgcagcacttcaaacattttaggaacatgctataggtcacaagggacatttctggattacttgctttgtgtctcattatctttaccgtggaatacattatgtattaccgtttacttttgtcaaagttttctttgtatgaaaggcttgccgcttgtttggtgtgcttccatatgtgcattactgcggtgaactgtataggcacttatagtcaatttccataggggcgagaagtaagtttgtgggcattcttggaaactttatctcatttgtttgatgggaactaggaaaggagttgacagtgggtttgttgatgttttagggaactagtcttttgttagcatttgaacgttttccaggaattactggaaggcaagtgtaattgattgaagctaccaatgtaatctatctgttatcaaatatcaacatagactagtgttatcagttatgacttactagagcactgctgtagatttaactccaattccatatgcttcagttactatctagtaatatccatggttattgttttgttgtgttcaacctcatgaaacatcactctgaagatttcagtgacacatggagttgtatttgcaaggatcagctttgtagctagggatattatctgtagcatgtccttttgttcgaatttacctattccagtgtcttaagtttgaagcaaacctcgttaactaccgagaatagtcttgttc

SEQ ID NO: 887 - DNA, 2124 bp, Oryza sativa
cggctgtgtgatggacgcgagggaggtgtgaagcccagtcgctgatgctcgtggagagattcggaggagaggagcgcgcggtgaggaggcggtggaggcggaagcggcgacgagttggcgagaagcgcagcagcgacggacgacgagcaaccggcgggcgacgagggcaggaagagggctgctcctccccctccgcctccgccgccggccgacgccgtcatgggggagtcgctgctcaccgcgctctccatggacaccaccacggcccaccacccgcaccagggcccctccacgttcctctccatggacaccgcctcccacgacgacttcgacctcttcctcccgccgccgccggggccgttccgccgctgcctccatgccgcggccgccgccccccctgacatcaacctccccctcgacgccgacccctcccctccgcctccggctctgcagtccggcgccctccacgaccccaacgtcgacatgcttgatgtcggcctcggcggcccgcagctttacgactcggactcacctgctgccaccaccggcgtgtcccctgccccggccgccgcgaccaccacggtcgccgtatcacatgccaagggctccaattccagcgctgcccgcaagtgcgtgaagaggaacgataccatatggggcgcgtggttcttcttcacccactacttcaagccggtcatgtcggctgacaagaacggcaaggcgaaggcccccaccgccggtgggaacggtaataatgctacgctggatgctttcctagtgcagcacgacatggagaacatgtacatgtgggtgttcaaggagcggccagagaatgccctggggaagatgcagctaaggagcttcatgaacgggcactcgcgccttggggagcctcagttcccgttcagcgcggagaaagggttcgtgcgctcacaccgcatgcagcgcaagcactaccgggggctgtccaacccgcagtgcctgcacgggatcgagatcgtccgggcaccaaacttggctggtgtgcccgaagctgatttgaagaggtggacagagctcaccggaagggacgctaacttctcgattgatgctgaggcgagtgattatgagtcatggagaaatcttcctagcacagattttgagcttgagaggccagcaactactgctgccacgaagactagctcacatggccatcacaagaagttgctcaacggttctggccttaacctgtcaacacagccatcgaatcacagctctggggatggtctggacatcccaaatatttgcaacaagcgccggaaggattcctcccccacagcgatggaagaagattgcagcaattcaaattcagacaaggtccaggacatggaagtgagccacacgttcgagccgtcatggatgaatgacttcactggtgtgatgcgccatgcttctggtccagtgactgcagcaaaaacaatctatgaagatagcaaggggtacttgatcatcattagcctaccgtttgctgatatacaaagggtgaaggtttcatggaagaatactcttacaaatgggatagttaaggtatcatgcactagtgttggccggatgccattcttgaagagacatgaccggaccttcaagttagtcgatcctacacctgagcattgtccaccaggagagtttattcgggaaattccactccctactcggatcccggaagatgctactttagaagcatactgtgatgaatcaggaacaggcctagagattattgttccaaaataccgtgttggtcctgaagaacatgaagttcatgtgtccatgaggcccccctcgtcatggtgccagtcttaacatgttcaaggtgtgtggtgcatgccatagcatacaagaaaattgctctcatttttgctaattggaaagggaaagggaaacaatcgtaattgattgaagcattctggtatttggcatttgaaacatttgtaggaccatgctacatatcacaaggaacatatctggattaattcgatcttcgtttcagtatatttgtttgggaataccttatgtattatcttttgttttcattagaatttctgtgtatgcatagtttgttgcccgctcgatgtgcttccgtatgtg

SEQ ID NO: 888 - DNA, 3075 bp, Oryza sativa
atcgtgtgcacactgcctctaccgccgcgtgcgcggccgggcgatccgggccgtgccaatccaccaccaccaccaccacgacgcagggggaggggggcgtcaccgtcaagtaacggccccccaccccaccccccctcgtccagggcgcttctgggggagggcgcctgcgcccaccgtgggtggtcgcctttaacacccccctcgctccgttaccgtctctccccttccccctccccctcccccacacccgctcgctgctcattcatccacgcgcggttcgatttgatctttgattgattgaaacgctgccgtcgaatcgaaaaaaataattcaaggattgtgtttttgttggttcgtcctgtaataacgttttttttgattgttcgttcgttcgttcgtctgtggatgtgaggaggaggaaggaggtcctctgattcgggagttgcggagttcttggatttggcctaaggaggagagattttcgtttttcgtatcaacccgacggctgtgtgatggacgcgagggaggtgtgaagcccagtcgctgatgctcgtggagagattcggaggagaggagcgcgcggtgaggaggcggtggaggcggaagcggcgacgagttggcgagaagcgcagcagcgacggacgacgagcaaccggcgggcgacgagggcaggaagagggctgctcctccccctccgcctccgccgccggccgacgccgtcatgggggagtcgctgctcaccgcgctctccatggacaccaccacggcccaccacccgcaccagggcccctccacgttcctctccatggacaccgcctcccacgacgacttcgacctcttcctcccgccgccgccggggccgttccgccgctgcctccatgccgcggccgccgccccccctgacatcaacctccccctcgacgccgacccctcccctccgcctccggctctgcagtccggcgccctccacgaccccaacgtcgacatgcttgatgtcggcctcggcggcccgcagctttacgactcggactcacctgctgccaccaccggcgtgtcccctgccccggccgccgcgaccaccacggtcgccgtatcacatgccaagggctccaattccagcgctgcccgcaagtgcgtgaagaggaacgataccatatggggcgcgtggttcttcttcacccactacttcaagccggtcatgtcggctgacaagaacggcaaggcgaaggcccccaccgccggtgggaacggtaataatgctacgctggatgctttcctagtgcagcacgacatggagaacatgtacatgtgggtgttcaaggagcggccagagaatgccctggggaagatgcagctaaggagcttcatgaacgggcactcgcgccttggggagcctcagttcccgttcagcgcggagaaagggttcgtgcgctcacaccgcatgcagcgcaagcactaccgggggctgtccaacccgcagtgcctgcacgggatcgagatcgtccgggcaccaaacttggctggtgtgcccgaagctgatttgaagaggtggacagagctcaccggaagggacgctaacttctcgattgatgctgaggcgagtgattatgagtcatggagaaatcttcctagcacagattttgagcttgagaggccagcaactactgctgccacgaagactagctcacatggccatcacaagaagttgctcaacggttctggccttaacctgtcaacacagccatcgaatcacagctctggggatggtctggacatcccaaatatttgcaacaagcgccggaaggattcctcccccacagcgatggaagaagattgcagcaattcaaattcagacaaggtccaggacatggaagtgagccacacgttcgagccgtcatggatgaatgacttcactggtgtgatgcgccatgcttctggtccagtgactgcagcaaaaacaatctatgaagatagcaaggggtacttgatcatcattagcctaccgtttgctgatatacaaagggtgaaggtttcatggaagaatactcttacaaatgggatagttaaggtatcatgcactagtgttggccggatgccattcttgaagagacatgaccggaccttcaagttagtcgatcctacacctgagcattgtccaccaggagagtttattcgggaaattccactccctactcggatcccggaagatgctactttagaagcatactgtgatgaatcaggaacaggcctagagattattgttccaaaataccgtgttggtcctgaagaacatgaagttcatgtgtccatgaggcccccctcgtcatggtgccagtcttaacatgttcaaggtgtgtggtgcatgcccttgtagctggtagaaatcgattattgtcaacttctgttgactgatgttttgctgtctgctaaccctcagctcgcaaggagacgttcagagacatagcatacaagaaaattgctctcatttttgctaattggaaagggaaagggaaacaatcgtaattgattgaagcattctggtatttggcatttgaaacatttgtaggaccatgctacatatcacaaggaacatatctggattaattcgatcttcgtttcagtatatttgtttgggaataccttatgtattatcttttgttttcattagaatttctgtgtatgcatagtttgttgcccgctcgatgtgcttccgtatgtgcattattgtctcgagcggtttgattctacaaaattgactcctgaagaactgtataggcattccatagataggtgagaagcttgttcttgtgagcattcttggaaatttcatctcatttatttgatggaaactaggaaaaggagtacttatcagtgctttctaggatttgccaatgtttagttggaattagtgggagctttttagcacttgtgaacgttttccattaatcgctggaaggcaagtgtaagtgattgatggtgccaatgtgcctatatatgttatcattatagaaatgatcagcacctatcagttacgagtacttcagttttcatctgatatcattcagtatggttgtt

SEQ ID NO: 889 - DNA, 3040 bp, Oryza sativa
atcgtgtgcacactgcctctaccgccgcgtgcgcggccgggcgatccgggccgtgccaatccaccaccaccaccaccacgacgcagggggaggggggcgtcaccgtcaagtaacggccccccaccccaccccccctcgtccagggcgcttctgggggagggcgcctgcgcccaccgtgggtggtcgcctttaacacccccctcgctccgttaccgtctctccccttccccctccccctcccccacacccgctcgctgctcattcatccacgcgcggttcgatttgatctttgattgattgaaacgctgccgtcgaatcgaaaaaaataattcaaggattgtgtttttgttggttcgtcctgtaataacgttttttttgattgttcgttcgttcgttcgtctgtggatgtgaggaggaggaaggaggtcctctgattcgggagttgcggagttcttggatttggcctaaggaggagagattttcgtttttcgtatcaacccgacggctgtgtgatggacgcgagggaggtgtgaagcccagtcgctgatgctcgtggagagattcggaggagaggagcgcgcggtgaggaggcggtggaggcggaagcggcgacgagttggcgagaagcgcagcagcgacggacgacgagcaaccggcgggcgacgagggcaggaagagggctgctcctccccctccgcctccgccgccggccgacgccgtcatgggggagtcgctgctcaccgcgctctccatggacaccaccacggcccaccacccgcaccagggcccctccacgttcctctccatggacaccgcctcccacgacgacttcgacctcttcctcccgccgccgccggggccgttccgccgctgcctccatgccgcggccgccgccccccctgacatcaacctccccctcgacgccgacccctcccctccgcctccggctctgcagtccggcgccctccacgaccccaacgtcgacatgcttgatgtcggcctcggcggcccgcagctttacgactcggactcacctgctgccaccaccggcgtgtcccctgccccggccgccgcgaccaccacggtcgccgtatcacatgccaagggctccaattccagcgctgcccgcaagtgcgtgaagaggaacgataccatatggggcgcgtggttcttcttcacccactacttcaagccggtcatgtcggctgacaagaacggcaaggcgaaggcccccaccgccggtgggaacggtaataatgctacgctggatgctttcctagtgcagcacgacatggagaacatgtacatgtgggtgttcaaggagcggccagagaatgccctggggaagatgcagctaaggagcttcatgaacgggcactcgcgccttggggagcctcagttcccgttcagcgcggagaaagggttcgtgcgctcacaccgcatgcagcgcaagcactaccgggggctgtccaacccgcagtgcctgcacgggatcgagatcgtccgggcaccaaacttggctggtgtgcccgaagctgatttgaagaggtggacagagctcaccggaagggacgctaacttctcgattgatgctgaggcgagtgattatgagtcatggagaaatcttcctagcacagattttgagcttgagaggccagcaactactgctgccacgaagactagctcacatggccatcacaagaagttgctcaacggttctggccttaacctgtcaacacagccatcgaatcacagctctggggatggtctggacatcccaaatatttgcaacaagcgccggaaggattcctcccccacagcgatggaagaagattgcagcaattcaaattcagacaaggtccaggacatggaagtgagccacacgttcgagccgtcatggatgaatgacttcactggtgtgatgcgccatgcttctggtccagtgactgcagcaaaaacaatctatgaagatagcaaggggtacttgatcatcattagcctaccgtttgctgatatacaaagggtgaaggtttcatggaagaatactcttacaaatgggatagttaaggtatcatgcactagtgttggccggatgccattcttgaagagacatgaccggaccttcaagttagtcgatcctacacctgagcattgtccaccaggagagtttattcgggaaattccactccctactcggatcccggaagatgctactttagaagcatactgtgatgaatcaggaacaggcctagagattattgttccaaaataccgtgttggtcctgaagaacatgaagttcatgtgtccatgaggcccccctcgtcatggtgccagtcttaacatgttcaaggtgtgtggtgcatgcccttgtagctggtagaaatcgattattgtcaacttctgttgactgatgttttgctgtctgctaaccctcagctcgcaaggagacgttcagagacatagcatacaagaaaattgctctcatttttgctaattggaaagggaaagggaaacaatcgtaattgattgaagcattctggtatttggcatttgaaacatttgtaggaccatgctacatatcacaaggaacatatctggattaattcgatcttcgtttcagtatatttgtttgggaataccttatgtattatcttttgttttcattagaatttctgtgtatgcatagtttgttgcccgctcgatgtgcttccgtatgtgcattattgtctcgagcggtttgattctacaaaattgactcctgaagaactgtataggcattccatagataggtgagaagcttgttcttgtgagcattcttggaaatttcatctcatttatttgatggaaactaggaaaaggagtacttatcagtgctttctaggatttgccaatgtttagttggaattagtgggagctttttagcacttgtgaacgttttccattaatcgctggaaggcaagtgtaagtgattgatggtgccaatgtgcctatatatgttatcattatagaaatgatcagcacctatcagttacgagtact

SEQ ID NO: 890 - DNA, 2792 bp, Sorghum bicolor
ccaggctccttctgggggaggccgcggctcaccgggctggctgcgcccccaccggcgcctccgcctttaactctccctgcctccgttaccgtcttcccccttcccacctcccccacccgccgtgctcatccatcatcgaccgcgaccgcgacgagcccccgcccgccgattggattacacgcttgatttttttttttcatttgatttgattgcaacgcaccgcagcagcaggaagggagggattcttgggccgtcgttcgggtggatggtggaggcggttcgtcgatttgagagctccgggtttcttggacctgcgtaggtaacaacactgcccccatttcctctcggccggcggatggacgcgagggaggtgtgaagcctggtcgctaactgatgctcgtggagcgattcggaggagaggagcgcgccgtgcggaggcggtggaggaggaagcgccgacgatttggacagcgtagcggcggcgacggaaggggagcagcaggcggacgaggagcgagccgccaggaggacgacggccgccgccgccgccgccgccatgggcgagtcgctgctcaccgcgctctccatggacaccgcaacggcccaccacccgcaccagggcccctccaccttcctctccatggacaccgcctcccacgacgacttcgacctcttcctccagccacaggggcccttccgccgctgcctacatgccgcggcggtcgccccccctgacatcaacctccccctcgccgccgacccgtctccgccccctccggcgtcgcacgacgtcaacgttgacatgctagatgtcggtctcggcggcccgcagcactacgactcggattcgcccgctgccgccgggcctgtcacggccccagcagctgccgcgaccaccatggtcgccgtgtcccacaccaagggctccggttccagcgctgcgcgcaagtgcgtcaagaggaatgatagcatctggggagcgtggttcttcttcacccactacttcaagccagtcatgtccgctgacaagggtggcaaggcgaaggctgctgccaccaccaccaccaccaccggcgggaacggtaatagtgccacactggatgctttcctggtgcagcacgacatggagaacatgtacatgtgggtgtttaaggagcggccggagaatgccctggggaagatgcagctgaggagcttcatgaatgggcactcgcgccttggggaaccacagttccctttcagcgcagacaaagggtttgtgcgctcacaccggatgcagcgcaagcactatcgtgggctctctaacccgcagtgtcttcacgggatcgaaatcgtgagggcgccaaacttggcaggtgtacctgaggctgatttaaagaggtggatggagctcactgggagggatgccaatttctcggtcccaactgaggccagtgattttgagtcctggaggaatttgccgagcacagactttgagctcgagaggccagcaaccatggctcctgcaaagagcagctcacatgggcaccacaagaagttgctgaacggttctggccttaacctctcgacacaaccatccaatcacagttctggggatggcatggagatcacggccacctgtaacaagcgcaggaaggattcctcaccggctgcaatggaagaggattgcagcaactcgaattcagacaaggcccaagacatggatgtgagccacacctttgagccaacatggatgaatgacttctcaggtgtgatgcgccatgcctctggaccagtaactgctgcaaaaacaatatatgaggacagcaagggctacttgatcattatcagcctgcccttcgctgattttcagaaggtgaaggtttcatggaagaatactcttacaaatgggattgttaaggtatcatgcactagcgttggtcggatgcctttcctgaaaaggcatgatcggactttcaagttggcagatcctgctcctgagcattgcccacctggtgagtttgtccgggaaattccactgcctacccggatccctgaagacgctactttggaagcataccgtgatgaaacagggacaggcctggagattattgtcccaaaattccgcgttggtcctgaagaacatgaagtgcatgtgtccatgaggccaccttcgtcatggtgccaatgaaacttgttcaagcttgcggggagacacatatggtgcggaggttcccaactgttaccacaaggctactgtacaacaaacgcagctcagttttgctaattttgatcagaaacagtcctaattgattgaagcattctggtagttggccattgcagcatttggaacagtttaggaatattctacagatcacaaggaacatgtctgcattacttagttcttggttttgatatgttcttctggtgacaccttatgtattatattttgttttcgctgtgtcaaaagactagttgtcttgctcgatgtggtacaatctgtgcatcacctgacacgagcaatcgaatctgtttgttctacagaatggcaactggatgtatagggcataatttatagtcattttccatagattgaggtttgctttgttggcattgttgggtaattcatctgaaattggtggaaactaggaaaaaaagagaacatgccagtgtctttaggatttgtcaagagtcttaatggggtttagtggtgctgtaggattctgtctagtttccaggaatttctggaagacaagtgtggaaactgtatcttatctgtcatcaatatagaagtgctcagtgtctatcagcaa

SEQ ID NO: 891 - DNA, 3105 bp, Sorghum bicolor
catccacccaccccggccgcaccacccccaccccaccccaacgcaacgccactcgcgccgcatgcttttgccgcggcgagttaccaggcacacgacaggcagcaaggcgcgggccgtccccttccgttccgcctcgccgatgcggcttgctccagccgtcaccgtcaagtaacggccccccaccccacccctcgcgtccaggctccttctgggggaggccgcggctcaccgggctggctgcgcccccaccggcgcctccgcctttaactctccctgcctccgttaccgtcttcccccttcccacctcccccacccgccgtgctcatccatcatcgaccgcgaccgcgacgagcccccgcccgccgattggattacacgcttgatttttttttttcatttgatttgattgcaacgcaccgcagcagcaggaagggagggattcttgggccgtcgttcgggtggatggtggaggcggttcgtcgatttgagagctccgggtttcttggacctgcgtaggtaacaacactgcccccatttcctctcggccggcggatggacgcgagggaggtgtgaagcctggtcgctaactgatgctcgtggagcgattcggaggagaggagcgcgccgtgcggaggcggtggaggaggaagcgccgacgatttggacagcgtagcggcggcgacggaaggggagcagcaggcggacgaggagcgagccgccaggaggacgacggccgccgccgccgccgccgccatgggcgagtcgctgctcaccgcgctctccatggacaccgcaacggcccaccacccgcaccagggcccctccaccttcctctccatggacaccgcctcccacgacgacttcgacctcttcctccagccacaggggcccttccgccgctgcctacatgccgcggcggtcgccccccctgacatcaacctccccctcgccgccgacccgtctccgccccctccggcgtcgcacgacgtcaacgttgacatgctagatgtcggtctcggcggcccgcagcactacgactcggattcgcccgctgccgccgggcctgtcacggccccagcagctgccgcgaccaccatggtcgccgtgtcccacaccaagggctccggttccagcgctgcgcgcaagtgcgtcaagaggaatgatagcatctggggagcgtggttcttcttcacccactacttcaagccagtcatgtccgctgacaagggtggcaaggcgaaggctgctgccaccaccaccaccaccaccggcgggaacggtaatagtgccacactggatgctttcctggtgcagcacgacatggagaacatgtacatgtgggtgtttaaggagcggccggagaatgccctggggaagatgcagctgaggagcttcatgaatgggcactcgcgccttggggaaccacagttccctttcagcgcagacaaagggtttgtgcgctcacaccggatgcagcgcaagcactatcgtgggctctctaacccgcagtgtcttcacgggatcgaaatcgtgagggcgccaaacttggcaggtgtacctgaggctgatttaaagaggtggatggagctcactgggagggatgccaatttctcggtcccaactgaggccagtgattttgagtcctggaggaatttgccgagcacagactttgagctcgagaggccagcaaccatggctcctgcaaagagcagctcacatgggcaccacaagaagttgctgaacggttctggccttaacctctcgacacaaccatccaatcacagttctggggatggcatggagatcacggccacctgtaacaagcgcaggaaggattcctcaccggctgcaatggaagaggattgcagcaactcgaattcagacaaggcccaagacatggatgtgagccacacctttgagccaacatggatgaatgacttctcaggtgtgatgcgccatgcctctggaccagtaactgctgcaaaaacaatatatgaggacagcaagggctacttgatcattatcagcctgcccttcgctgattttcagaaggtgaaggtttcatggaagaatactcttacaaatgggattgttaaggtatcatgcactagcgttggtcggatgcctttcctgaaaaggcatgatcggactttcaagttggcagatcctgctcctgagcattgcccacctggtgagtttgtccgggaaattccactgcctacccggatccctgaagacgctactttggaagcataccgtgatgaaacagggacaggcctggagattattgtcccaaaattccgcgttggtcctgaagaacatgaagtgcatgtgtccatgaggccaccttcgtcatggtgccaatgaaacttgttcaagcttgcggggagacacatatggtgcggaggttcccaactgttaccacaaggctactgtacaacaaacgcagctcagttttgctaattttgatcagaaacagtcctaattgattgaagcattctggtagttggccattgcagcatttggaacagtttaggaatattctacagatcacaaggaacatgtctgcattacttagttcttggttttgatatgttcttctggtgacaccttatgtattatattttgttttcgctgtgtcaaaagactagttgtcttgctcgatgtggtacaatctgtgcatcacctgacacgagcaatcgaatctgtttgttctacagaatggcaactggatgtatagggcataatttatagtcattttccatagattgaggtttgctttgttggcattgttgggtaattcatctgaaattggtggaaactaggaaaaaaagagaacatgccagtgtctttaggatttgtcaagagtcttaatggggtttagtggtgctgtaggattctgtctagtttccaggaatttctggaagacaagtgtggaaactgtatcttatctgtcatcaatatagaagtgctcagtgtctatcagcaatgccttctatactcttacctttgttcggatcaatctcacgagatgagattattcagcctgaaacttttgcaggtctacggggttaggtttgctgttagagcaactccaaccattat

SEQ ID NO: 892 - DNA, 2771 bp, Setaria italica
ccaggctccttctgggggaggccgcgggtccgcggctcaccgggctggctgcgccccaccggcgcccgcctttaactctcccccgcctccgttaccgtcttcccccttcccacctcctccccacccccgctgcgctgctcatccgtcgacccgggacgagccctcgccgattcgatttcgtatgatttgatttgattgcagcgcgcaacagggaggggatctctctggaccttcgtcgttgggcggcggctcggcggttcctcgatttgagagctccggatttcttggacctgcgtaggtagaagaagcaacgctccattttcctctcggccgccggatggacgcgagggaggtgtgaagcctggtcgctaactgatgctcgtggagagattcggaggagaggagcgcgcggtgcggaggcggtggaggcggaagcgccgacgatttggacagcgcagcgacggaaggggagcagcaggcggacgaggggcgcgccgccaggaggacgacggttgccgccgccgccgccgccgccgccatgggcgagtcgctgctcaccgcgctctccatggacaccgcaacggcccaccacccgcaccaggggcccaacaccatcctctccatggacaccgcctcccacgaagacttcgacctctacctccagccacaggggcccttccgccgctgcctgcatgccgcggcggtcgtcccccctgacatcaacctccccctcgccgctgacccttctccgccccctccggcgctgcaggactgcaacgtcgacatgctagacgtcggcctcggcggcccgcagcagtacgactcggattcgcctgctgccgccgtgcccgtctcggccccgccagcggccacgactgccacggtcgccgtggcgcacaccaagggctccggttccagcgccgcacgcaagtgcgtcaagaggaacgatagtatctggggggcgtggttcttcttcacccactacttcaagccggtcatgtccgccgacaagggtggcaaggcgaagtcagccactgccggcgggaacggtaatagtgccacactggatgcattcctggtgcagcacgacatggagaacatgtacatgtgggtgtttaaggagcgtccggagaatgccctagggaagatgcagctgaggagcttcatgaatgggcactcgcgccttggggaaccacagttccctttcagcgcagataaagggtttgtgcgctcgcaccgaatgcagcgcaagcattatcgtgggctctcgaacccacagtgtcttcatgggattgagatcgtcagggcgccaaacatgacaggtgtacctgaggctcatatgaagaggtggatggagctcactgggagggatgccaatttctcgatcccaaccgaggcgagtgattttgagtcgtggaggaatttgccaaccacagactttgagcttgagagagcagcaagtactgctcctgcaaagagcagctcacatgggcaccacaagaagttgctgaatggttctgggcttaacctctcgacacagccatccaatcatagttctggggatggtatggaaatcactgccacttgcaacaagcgcaggaaggattcctcacctgttgccatggaagaggactgcagcaattcaaattcagacaaggcccatgacatggatgtgagccacacttttgagccatcatggatcaatgacttcactggtgtgatgcgccatgcttctgggccagttactgctgcaaaaacaatatatgaggatagcaagggctacttgatcatcattagcctgcctttctctgattttcagaaggtgaaggtttcctggaagaatactcttacaaatggtattgttaaggtatcatgcactagtgttggtcgaatgccattcctgaaaagacatgatcgaactttcaagctggctgatccttcccctgagcattgtccacccggagagtttgtccgggaaattccactgcctacccggatccctgaagacgccactttggaagcataccgtgatgaaacagggacaggcctagagattattgtccctaaattccgtgttggccctgaagaacatgaagtgcatgtgtccatgaggccaccctcgtcatggtgccaatgaagacatgttcaagcttacgaggagacatttggtgtggaggttccctattgtgaccataagactactgtacaacagcccagcacagttttgctaattttgatgggaaacaatcctagttgattgaagcattctggtagttggcaattgcagcatctggaacatttttaggaatatgctacaggtcacaaggaccatgtctgcattacttagctcttggtttcaatatgtttgtttggggataccttgtgtattgtctttggtttagttgtaacttttgtttgtgtcaaaagattggttgtctgctcgatgtgcttaaatgtgtgcatcaccgacatgagcaatctgtttgttttatagaatggctcctggataactgtatagggcatttatagtcatttgccatagattgtgacaggtttgctttgtgggcattgttggaaaaatcatctcaaattgatggaaattaggaaatggagtacatgtcagtgaatttaggatttgccaatgttccatgggaattagtgtcattgtagcattttgtgaacgttttccaggaatttctcgaagactagtgtaatctattggaaaatgtatcttctctgctatcaatatagtagtggtcattgtcttatca

SEQ ID NO: 893 - DNA, 2675 bp, Zea mays
gtcttccccctttccacctccccccaccccgctgtgctcatccatcgaccgcgacgagcccccgcccgccgattcgactacgtttattttttttatttcatttgatttgattgcaaagcaccgcagcagcaggaggaggggaagggagggatcgttggaccgtcgttcggctggatggtggaggcggttcgtcgatttgagggcaccgggtttcttggacctgcgtaggtaaaaaacaccagccccatttccctctcggccggcggatggacgcgagggaggtgtgaagcctggtcgctaactgatgctcgtggagagattcggaggagaggagcgcgccgtgcggaggcggtggaggaggaagcgccgacgatttggacagcgcagcgacggaaggggagcagcaggcggacgaggagcgagccgccaggaggacgacggccgccgccgccgccgccgccatgggcgagtcgctgctcaccgcgctctccatggacaccgccacagcccaccacccgcaccagggcccctccaccttcctctccatggacaccgcctcccacgacgacttcgacctcttcctccagccacaggggcccttccgccgctgcctacatgccgcggcggtcgccccccctgacatcaaccttcccctagccgccgacccgtctccgccacctctggcgtcgctcgacgccaacgttgacatgctagatgtcggcctcggcggctcgcagcactacgactcggattcgcccgctgccgctgggccagtctcggccccggcagcagcagcgaccaccatggtcgccgtgtcccacaccaagggctccggttccagtgctgcgcgcaagtgtgtcaagaggaatgttagcatctggggagcgtggttcttcttcacccactacttcaagccagtcatgtctgcggacaaggctggcaaagcgaaggcagccaccaccaccggcgggaacggcaatagcgccacactggacgctttcctggtgcagcacgacatggagaacatctacatgtgggtgtttaaggagcgtccggagaatgccctggggaagatgcagctgaggagcttcatgaatgggcactcacgccttggggagccacagttcccattcagcgcagacaaagggtttgtgcgctcacaccggatgcagcgcaagcactaccgtggcctctctaacccacagtgtcttcatgggatcgaaatcgtgagggcgccaaatttggcgggtgtacctgaggctgatttaaagaggtggatgcagctcactgggagggacgccaatttctcggtcccaactgaggcgagtgattttgagtcctggaggaatctgccgagcacagactttgagctcgagaggccagcaaccgcggctcctgcaaagagcagttcacatggacaccacaagaagttgctgaacggttctggccttaacctctcgacgcaaccatccaatcacagttctggggatggcatggagatcacagccacctgtaacaagcgcaggaaggattcctcaccgaccgcaatggaagaggactgcagcaattcgaattcggacaaggcccaagacatggatgtgatccacaccttcgagccatcatggatgaatgacttctcaggtgtgatgcgccatgcttctggaccagtaaccgctgcaaaaacaatatacgaggacagcaagggctacttgatcatcgttagcctgcctttcgctgattttcagaaggtgaaggtttcatggaagaacactcttacaaatgggatcgttaaggtatcatgcactagcgttggtcggatgccactcctgaaaaggcatgatcggactttcaggttggcggatcctgctcctgagcattgcccgccgggagagtttgtccgggagatcccactccctacccgaatccctgaagacgccactctggaagcgtactgcgatgaaacagggacagggctggagattattgtcccgaagttccgcgttggccctgaagaacacgaagtgcatgtgtccatgaggccaccctcgtcctggtgccaatgaaacctgtttccaagcttgcggggggagacacacatacggtgtggaggtttgccgtaaggctaaggctactgcacaacaaatgcagctcagttttgctaattttgatgggaaacagtccttgattgattgaagcattctggtagttggccgccgcagcgtttggaacattttaggaaatatgctacgggtcgcaaggaacatgcttgcattacttagttcttgtatggggatacacctagtgtgttacatttcgtttccgttgtgtcgaaagactggttgtctgctcgatgtgctgcaatccgtgcatcgcccacccgtcacgagcaacaatctgtttgtgttgtacacagaatggcaactggatgtataggggcatttatagtcattttccatagattgaggtttgctttgtgggcatcgtgtaaaattcgtctcagattgatggaaactaggaagaaaaagaagatggcagtgtctttaggatttggcgaagttgtaatggggattaggcggtgctgtagcattctgtctagtttccaggaatttgtagaagacaaatgtaaatctgttgttccgtcatcaatatagaaaagtggtctgtgtctaccagca

SEQ ID NO: 894 - DNA, 2319 bp, Setaria italica
cgccgccaggaggacgacggttgccgccgccgccgccgccgccgccatgggcgagtcgctgctcaccgcgctctccatggacaccgcaacggcccaccacccgcaccaggggcccaacaccatcctcctcccacgaagacttcgacctctacctccagccacaggggcccttccgccgctgcctgcatgccgcggcggtcgtcccccctgacatcaacctccccctcgccgctgacccttctccgccccctccggcgctgcaggactgcaacgtcgacatgctagacgtcggcctcggcggcccgcagcagtacgactcggattcgcctgctgccgccgtgcccgtctcggccccgccagcggccacgactgccacggtcgccgtggcgcacaccaagggctccggttccagcgccgcacgcaagtgcgtcaagaggaacgatagtatctggggggcgtggttcttcttcacccactacttcaagccggtcatgtccgccgggcaaggcgaagtcagccactgccggcgggaacggtaatagtgccacactggatgcattcctggtgcagcacgacatggagaacatgtacatgtgggtgtttaaggagcgtccggagaatgccctagggaagatgcagctgaggagcttcatgaatgggcactcgcgccttggggaaccacagttccctttcagcgcagataaagggtttgtgcgctcgcaccgaatgcagcgcaagcattatcgtgggctctcgaacccacagtgtcttcatgggattgagatcgtcagggcgccaaacatgacaggtgtacctgaggctcatatgaagaggtggatggagctcactgggagggatgccaatttctcgatcccaaccgaggcgagtgattttgagtcgtggaggaatttgccaaccacagactttgagcttgagagagcagcaagtactgctcctgcaaagagcagctcacatgggcaccacaagaagttgctgaatggttctgggcttaacctctcgacacagccatccaatcatagttctggggatggtatggaaatcactgccacttgcaacaagcgcaggaaggattcctcacctgttgccatggaagaggactgcagcaattcaaattcagacaaggcccatgacatggatgtgagccacacttttgagccatcatggatcaatgacttcactggtgtgatgcgccatgcttctgggccagttactgctgcaagatagcaagggctacttgatcatcattagcctgcctttctctgattttcagaaggtgaaggtttcctggaagaatactcttacaaatggtattgttaaggtatcatgcactagtgttggtcgaatgccattcctgaaaagacatgatcgaactttcaagctggctgatccttcccctgagcattgtccacccggagagtttgtccgggaaattccactgcctacccggatccctgaagacgccactttggaagcataccgtgatgaaacagggacaggcctagagattattgtccctaaattccgtgttggccctgaagaacatgaagtgcatgtgtccatgaggccaccctcgtcatggtgccaatgaagacatgttcaaggtgtgtggtagatgttcttgtagcagctaggagtccattcttgttagctgctcttcgctgatgttttgttgtctgctaaccctctagcttacgaggagacatttggtgtggaggttccctattgtgaccataagactactgtacaacagcccagcacagttttgctaattttgatgggaaacaatcctagttgattgaagcattctggtagttggcaattgcagcatctggaacatttttaggaatatgctacaggtcacaaggaccatgtctgcattacttagctcttggtttcaatatgtttgtttggggataccttgtgtattgtctttggtttagttgtaacttttgtttgtgtcaaaagattggttgtctgctcgatgtgcttaaatgtgtgcatcaccgacatgagcaatctgtttgttttatagaatggctcctggataactgtatagggcatttatagtcatttgccatagattgtgacaggtttgctttgtgggcattgttggaaaaatcatctcaaattgatggaaattaggaaatggagtacatgtcagtgaatttaggatttgccaatgttccatgggaattagtgtcattgtagcattttgtgaacgttttccaggaatttctcgaagactagtgtaatctattggaaaatgtatcttctctgctatcaatatagtagtggtcg

SEQ ID NO: 895 - DNA, 2748 bp, Zea mays
ccaggctccttctgggggaggccgcggctcaccgtgttggctgcgcccccaccgtcgcctcgccttaaactctccccgcctccgttaccgtcttcccccttcccacctcccccacccgctgtgttcatccatcgaccgcgcgagcccccgcccgccgattcgacgacgtttgattttttttcatttgatttgattgtaacgtaccgcagcaggaggagggagggattcttggaccgttgttcggctggatggtggaggcggttcgtcgatttgagagctccgggtttcttggacctgcgtaggtaaaagcaccaccccccccatttcctctcggctggcggatggacgcgagggaggtgtgaagcctggtcgctaactgatgctcgtggagcgattcggaggagaggagcgcgccgtgcggaggcggtggaggaggaagcgccgaagatttgggcagagaagcgacggaaggggagcagcaggcggacgaggagcgagccgccaggaggacgacggccgccgccgccgccatgggcgagtcgctgctcaccgcgctctccatggacaccaccacggcccaccatccacaccagggccctttcaccttcctctccatggacaccgcctcccacgaccacttcgacctcttcctcccgccacaggggcccttccgccgctgcctacatgccgcggcggtcgccccccctgacatcaacctccccctcaccgccgacccgtctccgccacctccggcgtcgcacgacgccaacgttgacgtgctagatgccggcctcggcggcccgcagcactacgactcggattcgcccgctgctgccgggcctgtcttggccccagcagcagccgcggccaccgtgatcgccgtgtcccacaccaagggctccggttccagcgtggcgcgcaagtgcgtcaagaggaatgatagcatttggggagcgtggttcttcttcacccactacttcaagccagtcatgtccaccgacaagggtggcaaggcgaaggcagccaccaccggcgggaatggtaatagtgccagtgccactctggacgctttcctggtgcagcacgacatggagaacatgtacatgtggatctttaaggagcgatcggagaatgccctggggaagatgcagctgaggagcttcatgaatgggcactcgcgccttggggatccacagttccctttcagcgcagacaaagggtttgtgcgctcacaccggatgcagcgcaagcattatcgtgggctctctaacccgcagtgtattcacgggatcgaaatcgtgagggcgccaaacttggcaggtgtacctgagtctgatttaaagaggtggatggagctcaccgggagggatgccaatttctcgatcccagccgaggcaagtgatttcgagtcttggaggaatctgccgagcacggaatttgagctcgagaggctagcagccgtggttcctacaaagagtagctcacatgggcaccacaagaggttgctgaacggttctggccttaacctatcgacacaaccatccaatcacagttctggggatgccatggagatcgcaaccatctgtaacaagcgcaggaaggattcctcaccgtctgcaacggaagaggactgcagcaattcgaattcagacaaggcccaagacatggatgtgagccacacctttgagccatcatggatgaatgacttcacaggtgtgatgcgccatgcttctggaccagtaactgccgcaaaaacaatatatgaggacagcaagggctacttgatcattgttagcctgcctttctctgattttcagaaggtgaaggtttcatggaagaatactcttacgaatgggattgttaaggtatcttgcattagcgttggtaggatgccattattgaaaaggcatgatcggactttcaagttggcggatccttctcctgagcattgcccaccaggagagtttgtccgggaaatcccactgcctacccggatccctgaagatgccactctggaagcataccgcgatgaaacggggacaggcctggagattattgtcccaaagtaccgtgttggccctgaagaacatgaggtgcatgtgtccatgagaccgccctcgtcatggtgccaatgaaacttgttccgagctcgaggggagacacatctggtgcggaggttccctgttgttaccataaggctgaggctactgtccgagaaacgcagctcagttttgccaattttgatggggaacagtcctaattgattcaagcattctggtagttggcattgcagcatttggaacgtattaggtatatgctatagatcacaaggaacatgtctgcattatgtttgtctgggggtgcataatgtatcataatttgttttcacggtgtcaaaaggctagcttagctgtctgctggatgtgctgcaatccgtgcatcacctgacactagcaatctgtttattctactgaatggctcctggatatatatagggcatttgtcgttttctttagcttgacgtttgctttgtgggtactgttgggaaattcatctcgaattgatggaaactaggggaaaaaaaggagagcttgccagtgtctttaggatttgtcaaaaagttttaacggggattagtggtgctgtaggactctgtctagtttccaggaatttctggaagacaattgtaatttgttgtaaactgtatcttatctgtcaccaatatagaattggtcatggcctatcagc

SEQ ID NO: 896 - DNA, 1124 bp, Secale cereale
cccaattggccgacgtgggcggcccggagaggggaattaaaggagagaagcccggctttccttcctcctaggctacggctgttcccttctcgtccgcacccgcttcaaaccctcacaagtacccactcccacggcggcggcggcggcggcggagacggagacggagacgaccacaacagagaggagcccccaccggcgacgtctcagctcataaatggatagcggaagcgactccgacagcgctcctgaggagctcaccgctgtccagggtgtggagaaacatgaagaaatcagcaaagtagagaaggacagcgccgtcagagcaacccaggaggagaaagaccggaggaaacgctgggcccaacggaaaacatcctcaaaaccgaataaaaagaagcctctgaaagtagaagatgaagatacagaagtggatgaggagacacatgctatgcccgggacactccctaagagcgtaattgaaatgcttgcagcacgtgagaagcaaaccttctcatcggattctgaggaagaaaatgtaaaccagaaggtccaaaagaagaagaaaagattgaaaactacaactactggacctgaaacaattctgctgaaagatgttcggtcaacggagcacataaaaaaagctctcgaattcctgaaccacaggaaaaaccaggtgccaagatccaatgcagttttgaagaatcctaatgctatgcgtctctttaataaacctaatttcacgagttgagtggcagactgaggcagtttcttaattctgtgtcgaggctcgtctggaagactgatatggttgataggttgagatatcaattgtttttatgtgtttgatgagagcaaacatatatgcttgtgatttgcaatgccgcacgggtgtgatgatgtataatgctcatcctcgttagaaatcctatgagctatagttatgtacggacaatgtgtcgcctgtgaggtgtgagctgaatgcgcatcgtattgttcaacacctctccatgttctggcattactgtgaagcatgtgctttatgtgtttgccaattcatattcctttgggaatgagattttatgttttcctgtatgtgtcgttattcttaatacagacattagaag

SEQ ID NO: 897 - DNA, 926 bp, Triticum aestivum
ccacgcgtccgctcgtccgcacccgcttcaaaccctcgcaagtatccactcccacggcggcggcggcggcggagacggaggcgaccacaacagagctcccaccggggacgtctcagctcataaatggatagcggaagcgactccgacagcgcccccgaggagctcaccgccgtccagggtgtggagaaacatgaagaaatcagcaaagtagagaaggacagcgctgtcagagcaacccaggaggagaaagaccggaggaaacgctgggcccaacggaaaacatcctcaaaaccgaataaaaagaagcctctgaaagtagaagataaagatacagaagtggatgaggagacacatgctatgcctgggacactccccaagagcgtaattgaaatgcttgcagcacgtgagaagcaaaccttctcatcggattctgaggaagaaaatgtaaaccagaaggtccaaaagaagaagaaaagattgaaaaccacaactactggacctgaaacaattctgctgaaagatgttcggtcaacggagcacattaaaaaagccctcgaattcctgagtcgcaggaaaaaccaggtgccaagatccaatgcagttttgaagaatcctaatgctatgcgtctatttaataaacctaatttcacgagttgagtgtggcagacctaggcagtttctgaattctgtgtcgaggcttgtctggaagactgatatggttgacaggttgagatatcaattgtctttatgcgtttgatgagaacatatatgcttgtgatttgcaacgccgcatgggtgtgatgatgtataatgttcatcctcgttagaaatcctatgagctatagttatgtacggataatgtatcacctgtgaggtgtgagctgaatgcgcataatgttcacctctccatgctccggcattactgt

SEQ ID NO: 898 - DNA, 927 bp, Triticum aestivum
gcttcaaaccctcgcaagtacccactcccacggcggcggcggcggcggcggcggagacggaggctagcgaccacaatagagaggagctccgaccggcaacgtctcagctcataaatggacagcggaagcgactccgacggcgcccccgaggagctcaccgccgtccagggtgtggagaaacatgaagaaatcagcaaagtagagaaggacagtgctgtcagagcaacccaggaggagaaagaccggaggaaacgctgggcccaacggaaaacatcctcaaaaccgaataaaaagaagcctctgaaagtagaagataaagatacagaagtggatgaggagacacatgctatgcctggcacacttcccaagagcgtaattgaaatgcttgcagcacgtgagaagcaaaccttctcatcagattctgaggaagaaaatgtaaaccagaatgtccaaaagaagaagaaaagattgaaaactgcaactactggacctgaaacaattctgctgaaagatgttcggtcaacagagcacattaaaaaggccctcgaattcctgagtcgcaggaaaaaccaggtgccaagatccaatgcagttttgaagaatcctaatgctatgcgtctctttaataaacataatttcacgagttgagtgtggcggactgaggcagtttctgaactctgtgttgagactcgtctggaagactgatatggttgacaggttgagatatcaattgtttttatgtgtttgatgagaacgaatcatatatgcttgtgatttgcaacgccgcatgagtgtgatgatgtataatggttcatccttgttagaaatcctatgctctgtaggtgttgcatgtttttttttgacctttgagctatagttatgtatggataatgcatcacctgtgaactgaatgcgcatagtattgtt

SEQ ID NO: 899 - DNA, 1128 bp, Triticum aestivum
cccgcttcaaaccctcgcaagtacccactcccacggcggcggcggcggcggcggcggagacggaggctagcgaccacaatagagaggagctccgaccggcaacgtctcagctcataaatggacagcggaagcgactccgacggcgcccccgaggagctcaccgccgtccagggtgtggagaaacatgaagaaatcagcaaagtagagaaggacagcgctgtcagagcaacccaggaggagaaagaccggaggaaacgctgggcccaacggaaaacatcctcaaaaccgaataaaaagaagcctctgaaagtagaagataaagatacagaagtggatgaggagacacatgctatgcctggcacacttcccaagagcgtaattgaaatgcttgcagcacgtgagaagcaaaccttctcatcagattctgaggaagaaaatgtaaaccagaatgtccaaaagaagaagaaaagattgaaaactgcaactactggacctgaaacaattctgctgaaagatgttcggtcaacagagcacattaaaaaggccctcgaattcctgagtcgcaggaaaaaccaggtgccaagatccaatgcagttttgaagaatcctaatgctatgcgtctctttaataaacataatttcacgagttgagtgtggcagaccgaggcagtttctgaattctgtgttgaggctcgtctggaagactgatatggttgacaggttgagatatcaattgtttttatgtgtttgatgagaacgaatcatatatgcttgtgatttgcaacgccgcatgggtgtgatgatgtataatgttcatcctcgttagaaatcctatgctctgtaggtgttgcatgtttttttttgacctttgagctatagttatgtacggataatgtatcacctgtgagctgaatgcgcatagtattgttcaacacctctccatggtccacattactgtgaagcatgtgtttgccagttcatattcctttgggaatgagattttatgttttcctgtatgtgtcgttattcttcttaatacaaacagcagaaacatttgaagcactagtgcaaaattaattagtcgtagcgaatataatactatatatgctgaacctctacgctatatta

SEQ ID NO: 900 - DNA, 816 bp, Brachypodium distachyon
ccggctgtgtcccgtcttgtccgcgcacccgaacgctaaaaccctcttgtcccactcccacggcggcggcggcggcggcggcggccaccgcgcgaagagaagctccccaccggcggaatcactggtgatagatggacagcgggagcgaatccgacggcgcccccgaggagctcaccgccgttcagggtgtcgagaagcatgaaaagatcagcaaggtagagaaggacagcgccgccagagcaacacaagaagggaaagatcggagaagacgttgggcccaacgaaaaacaccctcaaaaccaaaaaagaagaagcctctggaggtagaagataaagataccaaagcggatgaggagaacaaggatacacatgctatgcctggcacactgcccaagagtgtaattgatatgcttgcagcacgcgagaagcaaaccttctcatcagacacagaggaagaaaatgtaagccagaaggttcaaaaaaggaagaagagattgaaaacttcaggacctgaaacaattctgctgaaagatgtccggtgcactcagcacgtgaagaatgccctcgacttcttggagcacaggaaaaacaaggtgccaagatccaatgcagttttgaagaatgctaataaggctatgcgtctctttaaaagcaattcttaagttgagtgtgttaaaatgaggcagttcctaaagtgaactccatgttacacttgtctgaaagactgatatggttgagatatctcctctattggaaacttgatttcttgatgtatgtttcgctaactattcaattttgattcctggttatatgttt

SEQ ID NO: 901 - DNA, 937 bp, Brachypodium distachyon
agggaaagaaatgcagaaaagcccggataccaccggttccggctgtgtcccgtcttgtccgcgcacccgaacgctaaaaccctcttgtcccactcccacggcggcggcggcggcggcggcggccaccgcgcgaagagaagctccccaccggcggaatcactggtgatagatggacagcgggagcgaatccgacggcgcccccgaggagctcaccgccgttcagggtgtcgagaagcatgaaaagatcagcaaggtagagaaggacagcgccgccagagcaacacaagaagggaaagatcggagaagacgttgggcccaacgaaaaacaccctcaaaaccaaaaaagaagaagcctctggaggtagaagataaagataccaaagcggatgaggagaacaaggatacacatgctatgcctggcacactgcccaagagtgtaattgatatgcttgcagcacgcgagaagcaaaccttctcatcagacacagaggaagaaaatgtaagccagaaggttcaaaaaaggaagaagagattgaaaacttcaggacctgaaacaattctgctgaaagatgtccggtgcactcagcacgtgaagaatgccctcgacttcttggagcacaggaaaaacaaggtgccaagatccaatgcagttttgaagaatgctaataaggctatgcgtctctttaaaagcaattcttaagttgagtgtgttaaaatgaggcagttcctaaagtgaactccatgttacacttgtctgaaagactgatatggttgagatatctcctctattggaaacttgatttcttgatgtatgtttcgctaactattcaattttgattcctggttatatgtttcttctgtttgcatcatagttcaatggatcccatcaagaacaagaaaacacagtttgcaagcagccttttaggttgaatctcaa

SEQ ID NO: 902 - DNA, 1981 bp, Secale cereale
cgcgcgacacaggcagagagaaggaggccgaggcgcgacccccaagcaagccctaggcgacgagacgcaacggcgacggcggcggcgaaggcgtaccccgcgtccgcgtgcccggattcgggcctcatcccatcggctcggccatgtccaccaagagggttctttgcaagttcttcatgcatggtgcttgcttgaaaggagagtattgtgagttctcccatgactggagtgaccaagcaaataatgtttgcacgttttaccagagaggctcatgctcttatggtagccgttgcagatatgaccatgtcaaagtttctcgtaacaacccagtgcctccactaccatcatcaagtaccgcaacacgtaacccagttcgcccgccaccatcgtcaagtactgcaacacatgtcgcatctacatctctacaacttctaagttctggacgtcctcttcacacgggacaccaaacaaattcaagcaaccaaaggcaacagatatctatggataagctggcactttctgaaagtaagcctgcatggaggaatgaggtccaacttgacagtgtatcagaggatgggattgactggtcatccattcaaactgcgcaaaaccaaacttccatgaaacttgctgatatgccaatttgttcttttgctgctggtggtaactgcccgtatggggaagagtgcgctcacatgcatggggatttgtgtgcgttctgtgggaaaatgtgcttgcatccttatcgtcctgatgagaggcaggagcatatcaagctatgtgaaaagaaccacaagcgtctcgaggctttgaaacgtagccaagaaatagaatgcagtgtctgcttggaccgtgtgctctcaaagcctactgctgctgaaaggaaatttggactattatctgaatgtgatcatcccttctgtatttcatgcataagaaattggcgtggcaactctcctacatctggtatggatgtgaactcagcactgagggcttgcccaatatgccgcaaactttcgtactatgtcattccaagtgttctttggtacttctcgaaagaggaaaagttggagatcactgaaaactacaaagcaaaactcaagtcaatagattgcaagtacttcgatttcggaactggcacttgcccctttgggacaagctgtttctacaagcatgcttacagagatggccgcttggaagaagtcgtactgcgacatcttgattgtgatgatggaagtacacttattgctaagaatattaggttgtcagacttcctcggtcggttgcatctttagggaccagcggctgcatatatatcaaatgcatcattctgggattttgctgtctaccaaatatttgcagtattccgaagacatcagtttaaatcaaggcatcttcgaaaactgctgctttatctccaatttattggtggttgctttgtcgcgaaacatacaaagaaaattcgaagttcgctgcgggacacctgggtgaccttatagcactattgaccagtggaacaatggaaaagaagttatgctgcgagtatgcttgaaaagtgaaaaaaatacacaataattataactgttgaaacacctttctgtatgcgctttgtgttgcttcctgggtggtcaccattgattcggtagaacgttacgttacctggccattgtgcgaaggactggtgtataatactcatttccaaactgccatttccctgttgaggaaggctacccgcaccaacaactggtgaactgagaccgtttggttgtacgctggatggaaaaggaaaagaattaaaagaatatgcttcatacttatatgaagtttgattggtcagatgcttgcccatgtaaatttgtatttagtttttttagtctcataagaccaataacttcatcagtcccacccattattttgttaattagggtaattctgtctatttttcttctttaacgtgagggtatcgttggaccagatgtcc

SEQ ID NO: 903 - DNA, 2020 bp, Secale cereale
gactgcgcgcgacacaggcagagagaaggaggccgaggcgcgaccccccaagcaagccctaggcgacgagacgcgacggcgacggcgacggcggcggcgaaggcgtaccccgcgtccgcgtgcccggattcgggcctcatcccatcggctcggccatgtccaccaagagggttctttgcaagttcttcatgcatggtgcttgcttgaaaggagagtattgtgagttctcccatgactggagtgaccaagcaaataatgtttgcacgttttaccagagaggctcatgctcttatggtagccgttgcagatatgaccatgtcaaagtttctcgtaacaacccagtgcctccactaccatcatcaagtaccgcaacacgtaacccagttcgcccgccaccatcgtcaagtactgcaacacatgtcgcatctacatctctacaacttctaagttctggacgtcctcttcacacgggacaccaaacaaattcaagcaaccaaaggcaacagatatctatggataagctggcactttctgaaagtaagcctgcatggaggaatgaggtccaacttgacagtgtatcagaggatgggattgactggtcatccattcaaactgcgcaaaaccaaacttccatgaaacttgctgatatgccaatttgttcttttgctgctggtggtaactgcccgtatggggaagagtgcgctcacatgcatggggatttgtgtgcgttctgtgggaaaatgtgcttgcatccttatcgtcctgatgagaggcaggagcatatcaagctatgtgaaaagaaccacaagcgtctcgaggctttgaaacgtagccaagaaatagaatgcagtgtctgcttggaccgtgtgctctcaaagcctactgctgctgaaaggaaatttggactattatctgaatgtgatcatcccttctgtatttcatgcataagaaattggcgtggcaactctcctacatctggtatggatgtgaactcagcactgagggcttgcccaatatgccgcaaactttcgtactatgtcattccaagtgttctttggtacttctcgaaagaggaaaagttggagatcactgaaaactacaaagcaaaactcaagtcaatagattgcaagtacttcgatttcggaaccggcacttgccccttcgggacaagctgtttctacaagcatgcttacagagatggccgcttggaagaagtcgtactgcgacatcttgattgtgatgatggaagtacacttattgctaagaacattaggttgtcagacttcctcggtcggttgcatctttagggaccagcggctgcatatatatcaaatgcatcattctgggattttgctgtctaccaaatatttgcagtactccgaagacaacagtttaaatcaaggcatcttcgaaaactgctgctttatctccaatttattggttgttgctttgtcgccaaacatacaaagaaaattcgaagttcgctgcgggacacctgggtgaccttatagcactattgaccagtggaacaatggaaaagaagttatgctgcgagtatgcttgaaaagtgaaaaaaatacacaataattataactgttgaaacacctttctctatgcgctttgtgttgcttcctgggtggtcaccattgattcggtagaacgttacgttaactggccattgtgcgaaggactggtgtataatactcatttgcaaactgccatttccctgttgaggaaggctacccgcaccaacaactggtgaactgagaccgtttggttgtacgctggagggaaaaggaaaagaattaaaagaatatgcttcatacttatatgaagtttgattggtcagatgcttgcccatgaaatttgattagttttttttagctcataagaccaataacttcatcagtcccaccatatttttgtaatgggaattctgcatttttcttcttaacgtgagggatcttggaccagatgctcctgattttagtcatggataaaaaactggccattcgcagac

SEQ ID NO: 904 - DNA, 1768 bp, Secale cereale
acggcgacggcgacggcggcggcgaaggcgtaccccgcgtccgcgtgcccggattcgggcctcatcccatcggctcggccatgtccaccaagagggttctttgcaagttcttcatgcatggtgcttgcttgaaaggagagtattgtgagttctcccatgactggagtgaccaagcaaataatgtttgcacgttttaccagagaggctcatgctcttatggtagccgttgcagatatgaccatgtcaaagtttctcgtaacaacccagtgcctccactaccatcatcaagtaccgcaacacgtaacccagttcgcccgccaccatcgtcaagtactgcaacacatgtcgcatctacatctctacaacttctaagttctggacgtcctcttcacacgggacaccaaacaaatttaagcaaccaaaggcaacagatatctatggataagccggcactttctgaaagtaagcctgcatggaggaatgaggtccaacttgacagtgtatcagaggatgggattgactggtcatccattcaaactgcgcaaaaccaaacttccatgaaacttgctgatatgccaatttgttcttttgctgctggtggtaactgcccgtatggggaagagtgcgctcacatgcatggggatttgtgcgcgttctgtgggaaaatgtgcttgcatccttatcgtcctgatgagaggcaggagcatatcaagctatgtgaaaagaaccacaagcgtctcgaggctttgaaacgtagccaagaaatagaatgcagtgtctgcttggaccgtgtgctctcaaagcctactgctgctgaaaggaaatttggactattatctgaatgtgatcatcccttctgtatttcatgcataagaaattggcgtggcaactctcctacatctggtatggatgtgaactcagcactgagggcttgcccaatatgccgcaaactttcgtactatgtcattccaagtgttctttggtacttctcgaaagaggaaaagttggagatcactgaaaactacaaagcaaaactcaagtcaatagattgcaagtacttcgatttcggaactggcacttgccccttcgggacaagctgtttctacaagcatgcttacagagatggccgcttggaagaagtcgtactgcgacatcttgattgtgatgatggaagtacacttattgctaagaacattaggttgtcagacttcctcggtcggttgcatctttagggaccagcggctgcatatatatcaaatgcatcattctgggattttgctgtctaccaaatatttgcagtattccgaagacatcagtttaaatcaaggcatcttcgaaaactgctgctttatctccaatttattggtggttgctttgtcgccaaacatacaaagaaaattcgaagttcgctgcgggacacctgggtgaccttatagcactattgaccagtggaacaatggaaaagaagttatgctgcgagtatgcttgaaaagtgaaaaaaatacacaataattataactgttgaaacacctttctgtatgcgctttgtgttgcttcctgggtggtcaccattgattcggtagaacgttacgttaactggccattgtgcgaaggactggtgtataatactcatttgcaaactgccatttccctgttgaggaaggctacccgcaccaacaactggtgaactgagaccgtttggttgtacgctggagggaaaaggaaaagaattaaaagaatatgcttcatacttatatgaagtttgatt

SEQ ID NO: 905 - DNA, 2073 bp, Triticum aestivum
aaaaaagcgagacgacgggacgagacggcgcgagcgagacagacagacaggaggccgaggccgaggccgaggcgcgacccacccaagcaagccctaggcgacgagacgcgacggcgacgacggcggcggcgaaggcgtatcccgcgtccgcgtgcccggattcggggctcatccggtcggctcggccatgtccaccaagagggttctttgcaagttcttcatgcatggtgcttgcttgaaaggagagtattgtgagttctcccacgactggagtgaccaagcaaataatgtttgcacgttttaccagagaggctcatgctcttatggtaaccgttgcagatatgaccatgtcaaggtttctcgtaacaacccagtgcctccactaccatcatcaagtaccgcaacacgtaattccccagttcgcccgccaccatcatcaagtactgcgacacatgttgcatctacatctccacaacttttaagttctggacgtcctcttcacttgggacaccaaacaaattcaagcaaccaacggcaacagatatctatggataagctggcagtttctgaaagtaagcctgcatggaggaatgaggtccaacttgacagtgtatcagaggatgggattggctggtcatccattcaaactgcgcaaaaccaaacttccatgaaacttgctgatatgccaatttgttcttttgctgctggtggtaactgcccgtatggggaagagtgccctcacatgcatggggatttgtgtgcgttctgtgggaaaatgtgcttgcatccttatcgtcctgatgagaggcaggagcatatcaagctatgtgaaaagaaccacaagcgtcttgaggctttgaaacgtagccaagaaatagaatgcagtgtctgcttggaccgtgtgctctcaaagcctactgctgctgaaaggaaatttggactattatctgaatgtgatcatcccttctgtatttcatgcataagaaattggcgtggcaactctcctacatctggtatggatgtgaactcagcactgagagcttgcccaatatgccgcaaactttcgtactatgtcattccaagtgttctttggtacttctcgaaagaggaaaagttggagatcactgaaaactacaaagcaaagctcaagtcaatagattgcaagtacttcgatttcggaacgggcacttgccccttcgggacaagctgtttctacaagcatgcttacagagatggccgcttggaagaagtcgtactgcgacatcttgattgtgatgatggaagtacacttattgctaagaacattaggttgtcagacttcctcggccggttgcatctttagggacctgctgcatatatatcgaattattccgaagacatcagtttaaatcgaggcatcttggaaaactgctgctttatctccaatttattggtggttgctttgtcgccaaacatacaaagaaaattcgaagttcgctgccggacacctggatgaccttgtagcactattgaccagtgaaacaatggaaaagaagttatgccgcgagtatgcttgaaaagtgaaaagaaaaattacaataattagaactgctgaaacgcctttctgtatgcactttgtgttgcttcctgggtggtcaccagtgattcggtagaacgttacctggccattgtgcgaacgaccggtgtgtaatactcatttccaaactgccattcccctgttgaggaaggctaccgcaccaacaactggtgaactgagaccgtttggttgtataacgtgtacgctggaggaaaaaggaaaagaattcaaagaatatgcttcatacttgatgatatgaagtttgattggtcagatgcttgcccatgaaatatgattgaatttgatcgtgttttaagctcatgatataagactgaattaatttcaatctagttccaacaacattatttttgtaacgtagtaaattctgctatttttcttctgcgatacaacggatcttggacatatgctcctgtattttagtcgtggaaaacaaaaaatgtccattgtcatcataacaacgtcctcctagaatggtc

SEQ ID NO: 906 - DNA, 1862 bp, Triticum aestivum
aaaaaaagcgagacgacgggacgagacggcgcgagcgagacagacagacaggaggccgaggccgaggccgaggcgcgacccacccaagcaagccctaggcgacgagacgcgacggcgacgacggcggcggcgaaggcgtatcccgcgtccgcgtgcccggattcggggctcatccggtcggctcggccatgtccaccaagagggttctttgcaagttcttcatgcatggtgcttgcttgaaaggagagtattgtgagttctcccacgactggagtgaccaagcaaataatgtttgcacgttttaccagagaggctcatgctcttatggtaaccgttgcagatatgaccatgtcaaggtttctcgtaacaacccagtgcctccactaccatcatcaagtaccgcaacacgtaattccccacttcgcccgccaccatcatcaagtactgcgacacatgttgcatctacatctccacaacttttaagttctggacgtcctcttcacttgggacaccaaacaaattcaagcaaccaacggcaacagatatctatggataagctggcagtttctgaaagtaagcctgcatggaggaatgaggtccaacttgacagtgtatcagaggatgggattggctggtcatccattcaaactgcgcaaaaccaaacttccatgaaacttgctgatatgccaatttgttcttttgctgctggtggtaactgcccgtatggggaagagtgccctcacatgcatggggatttgtgtgcgttctgtgggaaaatgtgcttgcatccttatcgtcctgatgagaggcaggagcatatcaagctatgtgaaaaaaaccacaagcgtcttgaggctttgaaacgtagccaagaaatagaatgcagtgtctgcttggaccgtgtgctctcaaagcctactgctgctgaaaggaaattcggactattatctgaatgtgatcatcccttctgtatttcatgcataagaaattggcgtggcaactctcctacatctggtatggatgtgaactcagcactgagagcttgcccaatatgccgcaaactttcgtactatgtcattccaagtgttctttggtacttctcgaaagaggaaaagttggagatcactgaaaactacaaagcaaagctcaagtcaatagattgcaagtactttgatttcggaacgggcacttgccccttcgggacaagctgtttctacaagcatgcttacagagatggccgcttggaagaagtcgtactgcgacatcttgattgtgatgatggaagtacacttattgctaagaacattaggttgtcagacttcctcggccggttgcatctttagggacctgctgcatatatatcgaattattccgaagacatcagtttaaatcgaggcatcttggaaaactgctgctttatctccaatttattggtggttgctttgtcgccaaacatacaaagaaaattcgaagttcgctgccggacacctggatgaccttgtagcactattgaccagtgaaacaatggaaaagaagttatgccgcgagtatgcttgaaaagtgaaaagaaaaaaatacaataattagaactgctgaaacgcctttctgtatgcactttgtgttgcttcctgggtggtcaccagtgattcggtagaacgttacctggccattgtgcgaacgaccggtgtgtaatactcatttccaaactgccattcccctgttgaggaaggctaccgcaccaacaactggtgaactgagaccgtttggttgtataacgtgtacgctggaggaaaaaggaaaagaattcaaagaatcgctttatacttgattgtatgaagtttgtttggtcagatgcttgccca

SEQ ID NO: 907 - DNA, 1752 bp, Brachypodium distachyon
agagagctcccctcctccccaaaaaaagcgagacgacgagacgagacggcgcgcgagaggggaggggacgacaacgcgacaccggccaagcaagccctagggcggcgcgacgaacggtcgtggcggcgaaggcatctcgtgctcttgtctttgcgtgcccggattcggtttcatcggatcgagtctcggctcggccatgtcgaccaagagggttctttgcaagttcttcgttcatggagcttgcttgaaaggagagtactgtgagttctcccatgactggagggaccaagcaaataatgtttgcacgttttaccagaaaggctcatgctcatatggtagtcgttgcagatatgaccatgtcaaagtttctcataacaacccagtgcctccgccaccatcatcaagtactccgacacgcaactcctcactgcctctgccaccatcaagcactgtagcacgtgtcgtgtctacttctctacaacctacaagtgctggacgtcctgttcatattggacatcaaacaaatccaagcaaccaaagacaacagatatctatggatatgctggcacattctgaaagtaaacctgcatggaggaatgatttccaacttgacagtgtatcagaagatgggattgactggtcatccaatcgaactgtgcaaaaccaaacatccaagaaacttgctgatatgccaatttgttcttttgctgctgctggtaattgcccgtatgaggaagagtgccctagcatgcatggagatttgtgcacaacctgtgggaaaatgtgcttgcatccttatcgtcctgatgaaagagaggaacatatgaagctatgtgaaaaaaaccacaagcgtattgaggctttgaaacgtagccaagagatagaatgcagtgtctgcttagaccgtgtgctctccaagcctacagctgcagaaaggaaatttggactcttatctgaatgtgaccatcccttctgcatctcatgcattagaaattggcgtggcaattctcctacgtctggtatggatgtgaactcagcactgagggcttgtccaatttgccgcaaactatcgtactatgtgattccaagtgttctttggtacttctcaaaggaggaaaagatggagatcatcgacaactacaaatcgaagctcaagtctatagattgcaagtactttgattttggaacgggtacttgcccatttggtacaagctgtttctacaagcatgcttacagggatggccgcttggaagaggtcatactgcgacatctcgatgctgaagatggaactacacttattgccaaaaatattaggttgtcagacttcctcactcggctgcatctttagggacccggatctgtatatatcacatgtaagatctttcatgggaaattttgaagttcactgcgggacacctggatgaccttaatatagaagcactgttgatccatggaacaaacaacgtaaaagaagccttgtcgcgagtttgcttggagagtcaaaatacaagaattagaactgttgaaacgcttttctatctgcactttgtgttacttcccgggtcaccagtgattcagtagaacaatccctggccattgtgcgaagggcaggtgtataataccctcgtttccaaactgccctttcccagtcgaggaaagctccccgcaccaacaactccttagctgagagcctgagcccgtttgtttgtataactcaatacacataagaaaaataaacaaagaatgcatgtc

SEQ ID NO: 908 - DNA, 1866 bp, Brachypodium distachyon
agagagctcccctcctccccaaaaaaagcgagacgacgagacgagacggcgcgcgagaggggaggggacgacaacgcgacaccggccaagcaagccctagggcggcgcgacgaacggtcgtggcggcgaaggcatctcgtgctcttgtctttgcgtgcccggattcggtttcatcggatcgagtctcggctcggccatgtcgaccaagagggttctttgcaagttcttcgttcatggagcttgcttgaaaggagagtactgtgagttctcccatgactggagggaccaagcaaataatgtttgcacgttttaccagaaaggctcatgctcatatggtagtcgttgcagatatgaccatgtcaaagtttctcataacaacccagtgcctccgccaccatcatcaagtactccgacacgcaactcctcactgcctctgccaccatcaagcactgtagcacgtgtcgtgtctacttctctacaacctacaagtgctggacgtcctgttcatattggacatcaaacaaatccaagcaaccaaagacaacagatatctatggatatgctggcacattctgaaagtaaacctgcatggaggaatgatttccaacttgacagtgtatcagaagatgggattgactggtcatccaatcgaactgtgcaaaaccaaacatccaagaaacttgctgatatgccaatttgttcttttgctgctgctggtaattgcccgtatgaggaagagtgccctagcatgcatggagatttgtgcacaacctgtgggaaaatgtgcttgcatccttatcgtcctgatgaaagagaggaacatatgaagctatgtgaaaaaaaccacaagcgtattgaggctttgaaacgtagccaagagatagaatgcagtgtctgcttagaccgtgtgctctccaagcctacagctgcagaaaggaaatttggactcttatctgaatgtgaccatcccttctgcatctcatgcattagaaattggcgtggcaattctcctacgtctggtatggatgtgaactcagcactgagggcttgtccaatttgccgcaaactatcgtactatgtgattccaagtgttctttggtacttctcaaaggaggaaaagatggagatcatcgacaactacaaatcgaagctcaagtctatagattgcaagtactttgattttggaacgggtacttgcccatttggtacaagctgtttctacaagcatgcttacagggatggccgcttggaagaggtcatactgcgacatctcgatgctgaagatggaactacacttattgccaaaaatattaggttgtcagacttcctcactcggctgcatctttagggacccggatctgtatatatcacatgtaagatctttcatgggaaattttgaagttcactgcgggacacctggatgaccttaatatagaagcactgttgatccatggaacaaacaacgtaaaagaagccttgtcgcgagtttgcttggagagtcaaaatacaagaattagaactgttgaaacgcttttctatctgcactttgtgttacttcccgggtcaccagtgattcagtagaacaatccctggccattgtgcgaagggcaggtgtataataccctcgtttccaaactgccctttcccagtcgaggaaagctccccgcaccaacaactccttagctgagagcctgagcccgtttgtttgtataactcaatacacataagaaaaataaacaaagaatgcatgtcataattcagactgttttctaagaaccgtgcaaggatttttttttaattaaggcctcgttggccactagtgtttttaaagtgtattttagggtattatccatttcaaattgaaaa

SEQ ID NO: 909 - DNA, 2262 bp, Oryza sativa
cccgcaaaggcagagagagagagagagagagagagagagcgcttcccgtttttcccccaaaaagcgagacgacgacgcgcgacgggacaggacaggggtgggagacgcatgcgacgcgggcggagaggagacacgacccacccccgccaccgcccggaggagccacgagcgagcaagccctagcccccgggcgcgagggcggcggccgctgctgcgtcgaccgtctctctctcgtgctccggcgctgctcgtcgtctccttggccgaatccaatccgggaggtgcgggggccgttccgatcgagtcggtcctgccatgtcgaccaagagggttctttgcaagttcttcatgcatggagcttgcttgaaaggagagtactgtgagttctcccatgattggaatgatcaaccaaacaatgtttgcacgttctaccagaaaggttcatgctcgtatggtagccgttgccgatatgaccatgtcaaagtttctcgtaaccccacagtggctccaccaccaagctcaagtactacaacacgtgcatctagttctcttcagcctttgagtttcgggcgccctcaccatgtggggtaccaagcagattcaagcaacccaaggcaacagatatctatggatgtgctggcacattctggaagtaagcctgtatggagaaatgattttcaacatgaaagtgtacttgaggatgggattgactggtcaataagtccaactgtgcaaaaccagacaaccttgagtcctgctgatctgccaatctgttcttttgctgctggtggtaattgtccttatggggaagagtgccctcagatgcatggagatctgtgcacaacctgtgggaaaatgtgcttacatccttatcgtcctgatgagagggaggaacataccaagctatgtgagaaaaaccacaagcgtcttgagtctttgaaacgtagccaagagatagaatgcagtgtctgcctggaccgtgtgctctcaaagcctactgctgctgaaaggaagtttggactcttatctgagtgtgatcatcccttctgtatttcatgtattagaaattggcgtaacaattctcctacgtctggaatggatgtgaactcagcactgagggcttgtccaatatgtcgcaaactttcatactatgtcattccaagtgttctttggtacttttcgaaggaggaaaagctggagattattgacaactataaagccaaactcaagtctattgactgcaagtacttcgattttggaactggtacttgtccctttgggtcaagctgtttctacaagcatgcctacagagacggacgcttggaagaggtcatactgcgacatcttgatgctgacgatggaagtacagtgattgccaaaaatattaggttgtcggacttcctcagtcggttacatctttagggaccagtgactgtatatatgtcaaataattattgaagttcgcagcaggcctcctggaggaagcaatcgtgatctgaggacaaggaaaacagaagttttgtcgcaaatacgctcaatagtccaaacgttagaactaaactgttgaaaaactttgccatatccactcatcttgcctcctggccagcagtgattcagtaaacattcactggccatcgtgccaaagcacaggtgtataatactattccttcctcaatgctctctactgagggaaggctgcctgcacccaaccacaggccacctgatgccgtgtgattgtacttgtatgaaaagaaggaactagaaaaaaagaaagagaggatgaaacaaagattactcttcagactacacattgatgaatccgcattaggacgaggtccagatgcttaaagccgtttggttgtcttggtctgagggagagaaggaaaacaagaaaggaaacaaatcacattctttataaacatcagtgttgaatgtggcatgtgctaatgtgctatatatatctgatgttgatatgccctgtacatgttcctggaacaggttggcgcttttgctcaggaaacaggaacgtctgcctatttgtggtggctttcttctgtgtgattcgatttgtgcccctgtctattctctcgagcgaagtagcgcaggctgtgtttcctctgtgaatcgtaaaggccttacgacgtatacgggcctgtttacataccctgtcacattaaatcgtcaaatgtttgatatatgtatggagtattaaatataaacgaaaaaaataactaattatacagattacgtgtaaattacgag

SEQ ID NO: 910 - DNA, 2061 bp, Oryza sativa
cccgcaaaggcagagagagagagagagagagagagagagcgcttcccgtttttcccccaaaaagcgagacgacgacgcgcgacgggacaggacaggggtgggagacgcatgcgacgcgggcggagaggagacacgacccacccccgccaccgcccggaggagccacgagcgagcaagccctagcccccgggcgcgagggcggcggccgctgctgcgtcgaccgtctctctctcgtgctccggcgctgctcgtcgtctccttggccgaatccaatccgggaggtgcgggggccgttccgatcgagtcggtcctgccatgtcgaccaagagggttctttgcaagttcttcatgcatggagcttgcttgaaaggagagtactgtgagttctcccatgattggaatgatcaaccaaacaatgtttgcacgttctaccagaaaggttcatgctcgtatggtagccgttgccgatatgaccatgtcaaagtttctcgtaaccccacagtggctccaccaccaagctcaagtactacaacacgtgcatctagttctcttcagcctttgagtttcgggcgccctcaccatgtggggtaccaagcagattcaagcaacccaaggcaacagatatctatggatgtgctggcacattctggaagtaagcctgtatggagaaatgattttcaacatgaaagtgtacttgaggatgggattgactggtcaataagtccaactgtgcaaaaccagacaaccttgagtcctgctgatctgccaatctgttcttttgctgctggtggtaattgtccttatggggaagagtgccctcagatgcatggagatctgtgcacaacctgtgggaaaatgtgcttacatccttatcgtcctgatgagagggaggaacataccaagctatgtgagaaaaaccacaagcgtcttgagtctttgaaacgtagccaagagatagaatgcagtgtctgcctggaccgtgtgctctcaaagcctactgctgctgaaaggaagtttggactcttatctgagtgtgatcatcccttctgtatttcatgtattagaaattggcgtaacaattctcctacgtctggaatggatgtgaactcagcactgagggcttgtccaatatgtcgcaaactttcatactatgtcattccaagtgttctttggtacttttcgaaggaggaaaagctggagattattgacaactataaagccaaactcaagtctattgactgcaagtacttcgattttggaactggtacttgtccctttgggtcaagctgtttctacaagcatgcctacagagacggacgcttggaagaggtcatactgcgacatcttgatgctgacgatggaagtacagtgattgccaaaaatattaggttgtcggacttcctcagtcggttacatctttagggaccagtgactgtatatatgtcaaataattattgaagttcgcagcaggcctcctggaggaagcaatcgtgatctgaggacaaggaaaacagaagttttgtcgcaaatacgctcaatagtccaaacgttagaactaaactgttgaaaaactttgccatatccactcatcttgcctcctggccagcagtgattcagtaaacattcactggccatcgtgccaaagcacaggtgtataatactattccttcctcaatgctctctactgagggaaggctgcctgcacccaaccacaggccacctgatgccgtgtgattgtacttgtatgaaaagaaggaactagaaaaaaagaaagagaggatgaaacaaagattactcttcagactacacattgatgaatccgcattaggacgaggtccagatgcttaaagccgtttggttgtcttggtctgagggagagaaggaaaacaagaaaggaaacaaatcacattctttataaacatcagtgttgaatgtggcatgtgctaatgtgctatatatatctgatgttgatatgccctgtacatgttcctggaacaggttggcgcttttgctcaggaaacaggaacgtctgcctatttgtggtggctttcttctgtgtga

SEQ ID NO: 911 - DNA, 2031 bp, Setaria italica
ccccacaacaggcgacgcgacgaggcacgagggcgagggagggagcggaggaaggcgccaccggtttcaagcaagtcctagccctaggcgacccctcggtgaaggattcgatcggtggtgaagcccgaggtgcttcccctgttgctctcctcggcgggctgtgccgcgcggacccgggttgatccgatcgactcggcccggctcggccccgccatgtcgacgaatagggttctttgcaagttcttcatgcatggagcttgcttgaaaggagagtactgtgagttctcccacgactggaaagaccaagcgaataacgtttgcacattctaccagaaaggtgcatgctcatatggtagccgttgcagatatgaccatgtcaaagtttctcgtaaccctacagtgctgccgccaccaccatcgtcaagtactgcaagacttgcatctacatctcgtcaacttttaagttccagtcatcttcctcacacaggacaccaaacagattcaagcaaccaaagaaatcagatatctgtggatatgctggcacatcctaccagtaagcctgcatggagtaatgattttcaacatgttgtttcagaggatgaaattgactggtcctctaaccaaactttgcaaaaccagacaaaattgaaaccttctgatctgcctatttgttcgtttgctgctgctggtaattgtccttatggggaagggtgccctcaaatgcatggagatctttgcacaacctgtggaaagatgtgcttgcatccttatcgttctgatgagagggaggagcatatcaagttatgtgcgaaaaatcacaaacgccttgaagctctgaaacgcagccaagagatagaatgcagtgtctgtttggatcgtgtgctatcaaagcctactgctgctgaaagaaagtttggactgctatctgaatgtgatcatcctttctgtatcgcatgcattagaaattggcgtagcaattctcctgcctctggtatggatgtgaactcagcactgagggcttgtccaatatgtcgcaaactttcgtactatgtcattccaagtgttctttggtacttctcgaaggaagagaaagaggaaatcactgaaagctacaaatccaagctcaagtctattgattgcaagtacttcgattttgggactggctcatgcccctttggtacaagttgtttctacaggcatgcctacagagatggacgcttggaagaggttgtactgcggcatcttgatgctgatgacggaagtacagtaattgcaaaaaatatcaggttgtcggacttcctcagtcggatgcatctttagggaccaccagctgtatatatatctaatgcattctgggatatcattatccaccaattatttgcaatatttgaagagcagtttaacttgaggcatcttcggaaaccacagctttctctccatttagtggtggttgctttgtcgccagttgaacaaagaaattttgaagttctcctggtccggctagacacctggatgacttcttgaaagaagcacagttgacctaagggcaatggggaaaaaagtcccataagaattgtgctggaatgttgaagtaaaataatttataaaattcactgtatgcggctcatgtgttgattgctggtcttctgggctaccaatgattcagtagaacatttcctggccgtccagtaacagggcagggggaaaaagagcaaacgaaacacagaatggtcgttgtcctgcagcaggctcgaaggtgactcgtacttcccagctggaagtgccttgcgacaggtcaattgaggttatttggacatacttcttaaaatgtatgagaataacaaatgaacacatgatcactatactgcactggttgtgcaaagtactccagtaaactgtagacaagccgttgaccgcttatgcctgagaatagcaacatctctggagctcaaatgctgtttctgatttgcggcagcatccgttcgtaattaaacagcgctcatgcgctgcaattgatttgtggtgttggcg

SEQ ID NO: 912 - DNA, 1920 bp, Zea mays
aatcattccaggatttgataccccgcgggtcacgtttccgcaaagggaaagcctcaaaaggcgacgcgcaagggccgaggagagaaaggaacctgaggaaggcacaccagtttcaagcaatccctaggccgtggcgacgtgctgggaaggattcaaatcaggggcgaagcctaggtgacggcgctgttagtcgcctctagtagctgcgcgacgcgggctggcttgtccgatcggtttgcctcggccatgtcgactaagaaagttctttgcaagttcttcatgcatggagcttgcttgaaaggagagtactgtgaattctcccacgactggagtgatcaagcaaataatgtttgcacattctaccaaaaaggtgcatgctcgtatggtagccgttgcagatatgaccatgtcaaagtttctcgtaaccccacagtgccaccaccacgcccaacgtcaagtacttcaagacgtgcatctacttctcttcaactttcaagttacaatcatccacctcatatggtgcaccaaacagattcaagcaaccaaagacatcagatatctgtggatgtgttggcacattctgccagtaagcctgcatggagaaatgattttcagcatgatattgtttcagatgatggaattgactggtcttctaatcaaaatttgataaaccagacatcattgaaacctgtggatctccctatttgttcttttgctgctgctggtaattgtccttatggggaagggtgccctcaaatgcatggagatctgtgtgcaacctgtggaaaactgtgcttgcatccttatcgtcctgatgagagggaggagcatatcaagttatgtgagaaaaatcacaaacgccttgtagctctgaaacgcagccaagaaatagaatgcagtgtatgtttggatcgtgtgctttcaaagcctactgctgctgaaaggaagtttggactcttatccgaatgtgatcatcctttctgtattgaatgcattagaaattggcgtagcaattctcctgcatctggtatggatgtgaactcagcattgagggcttgtccaatatgtcggaaactttcatactatgtcattccaagtgttctttggtacttctcaaaggaagagaaagaggagatcactgaaagctacaaatccaagctcaagtctattgattgcaagtacttcgactttgggactggctcatgccccttcggaacaagttgtttctataagcatgcctacagagatggccgcttggaagaggtaatactgcggcatcttgatgctgatgatggaagtacagtaattgcaaaaagtatcaggttatcagacttccttggtaggatggatctttagggaccagcagctgtattgatatcaaataaagtttgaagatctccatggtcctgtagatgctgggattaccttttcagagcactgttgacctgagggcgacggaaacaagtctgacaacaattgtgcttgaatatcaaaacagaagtaatactcgtatttatagacttcactaagtgtggctctatgtatcaattgctggtcttctaggccaccagataatagctgaacatttcctggccgacaagtgaaaggggcagccgtataaatttgcttccattccacctgaatgttctcttcatattgtggaagggtactgcaccaataggtccaataaggccatttgtttgctttacttaatatacaaaaaaagtatagcagatgaaatgcaatgacaactgtaatgcagcattgttgaatgtgagcgtgagcggtggttttttatcgatgacctgctgaggaaggtcctcttagtaggcaggtaaactgagaacatttttttgttatatatatacagcataattgtacgagaaaaatagcaaatgaaccgagaatgatcattaaatg

SEQ ID NO: 913 - DNA, 1166 bp, Pennisetum glaucum
cccgggttgatccgatcgattcagcgcggcttggccccgccatgtcgaccaacagggttctttgcaagttcttcatgcatggagcttgcttgaaaggagagtactgtgagttctcccatgactggaaagaccaagcgaataacgtttgcacattctaccagaaaggtgcatgctcatatggtagccgttgcagatatgaccatgtcaaagtttctcgtaaccctacagtgccgccgccaccaccatcgtcaagtactgcaagacttgcatctatgtctcgtcaactttcaacttctggtcatcctcctcacacagaacaccaaacagattcaagcaaccaaagaaatcagatatctgtggatgtgctagcacattctaccagtaagcctgcatggagaaatgattgtcaacatgttgtttcagaggatgaaattgactggtcctctaaccaaactttgcaaaaccagtcaaaattgaaaccttcggatctgcctatttgttcgtttgctgctgctggtaattgtccttatggggaaggatgccctcaaatgcatggagatctttgcacaacctgcggaaaaatgtgcttgcatccttatcggtctgatgagagggaggaacatatcaagttatgtgagaaaaatcacaaacgccttgatgctctgaaacgcagccaagagatagaatgcagtgtctgtttggatcgtgtgctatcaaagcctactgctgctgaaagaaagtttggactactatccgaatgtgaccatcctttctgtattgcatgcattagaaattggcgtagcaattctcctacctctggtatggatgtgaactcagcactgagggcttgtccaatatgtcgcaaactttcatactatgtcattccaagtgttctttggtacttctcgaaggaagagaaagatgaaattgctgaaagctacaaatccaagctcaagtctattgattgcaagtacttcgattttgggactggctcatgcccctttggtacaagttgtttctacaggcatgcctacagagatggacgcttggaagaggttgtactgcggcatcttgatgctgatgatggaagtacagtaattgcaaaaaagatcaggttgtcggacttcctcagtcggatgcatctttagggaccaacaattgtatat

SEQ ID NO: 914 - DNA, 1911 bp, Sorghum bicolor
cctcctgtttctgggaatcattcccggattcgacattcgatactggccgcggttccgcaaagcgaagccaaaaaggcgacgcgacaagcgcgaggagagagaggaacctgagcgaggcgcaccagtttcaattcaagcaatccctagcccgtggcgacgtggtgggaagcaattcgaatctgcggtgaagcctaggtgacggcgctgttactcgcctctcggggcgggccggcttgtccgatcggtttggctcggccatggcgactaaaaaggttctttgcaagttcttcatgcatggagcttgcttgaaaggagaatactgtgaattctcccacgactggagtgatcaagcaaataatgtttgcacattctaccagaaaggtgcatgctcgtatggtagccgttgcagatatgaccatgtcaaagtttctcgtaaccccacagtgccaccaccaccctcaacgtcaagtgctgcaagacgtgtcacatctaattctcttcaacttttaagttacagtcatgcacctcacacgggacaccaaactgattcaagcaaccaaagacatcagatatctgtggatgtgctggcacattctgccagtaagcctgcatggagaaatgattttcaacatgacattgtttctgatgatggaattgactggtcctctaatcgaaatttgctaaacgaaacatcattgaaacctgcggatctgcctatttgttcttttgctgctgctggtaattgtccttatggggaagggtgccctcaaatgcatggagatctgtgtgcaacctgtggaaaaatgtgcttgcatcctcatcgtcctgatgagagggaggagcatatcaaggtatgtgagaaaaatcacaaacgccttgaagctctgaaacgcagccaagaaatagaatgcagtgtatgtttggatcgtgtgctttcaaagcctactgctgctgaaaggaagttcggactgttatccgaatgtgatcatcctttctgtattgcatgcattagaaattggcgtagcaattctcctgcatctggtatggatgtgaactcagcactgagggcttgtccaatatgtcggaaactttcatactatgtcattccaagtgttctttggtacttctcgaaggaagagaaagaggagatcactgaaagctacaaatccaagctcaagtctattgattgcaagtactttgactttgggactggctcatgcccctttggaacaagttgtttctacaggcatgcctacagagatggccgcttggaagaggttgtactacggcatcttgatgctgatgatggaagtacagtaattgcaaaagacatcaggttatcagacttcctcggtaggatgcatctttagggaccagcagctgtatagatatcaaataaagtttgaagatctctatggtcctgtagacgctgggattaccttttcaaagcactgttgacctgaggacaatggaaagaagtctgacaacaattgtgcttgaataccaaaacagaagcaatactgtttatagacttcactatatgtgctctatgtatcaattgctggtcttctaggccaccagaagagtaaaaggcaggcgtataagtttacttcccttttacctcaatgttgttctcatattgtggaatggtactgcaccaatgggtcgaataaggtcatttggttgtattacttaatatacaaaaaaaaaaggtatagcagatgaaatacagaatgacaattgtaatgcagcattgttgaatgtgagcgtgagcggtgcttttcatctatgacctgctaagtaaggtcctcttagtagcaggtgaactgagataattttttgcttatatacagcataaatgtacgagaagaatagcatttttttttaccaatatatgacataattgtacga

SEQ ID NO: 915 - DNA, 2175 bp, Sorghum bicolor
accaccactgggggcaaacctgtcatttcgcatcctcctgtttctgggaatcattcccggattcgacattcgatactggccgcggttccgcaaagcgaagccaaaaaggcgacgcgacaagcgcgaggagagagaggaacctgagcgaggcgcaccagtttcaattcaagcaatccctagcccgtggcgacgtggtgggaagcaattcgaatctgcggtgaagcctaggtgacggcgctgttactcgcctctcggggcgggccggcttgtccgatcggtttggctcggccatggcgactaaaaaggttctttgcaagttcttcatgcatggagcttgcttgaaaggagaatactgtgaattctcccacgactggagtgatcaagcaaataatgtttgcacattctaccagaaaggtgcatgctcgtatggtagccgttgcagatatgaccatgtcaaagtttctcgtaaccccacagtgccaccaccaccctcaacgtcaagtgctgcaagacgtgtcacatctaattctcttcaacttttaagttacagtcatgcacctcacacgggacaccaaactgattcaagcaaccaaagacatcagatatctgtggatgtgctggcacattctgccagtaagcctgcatggagaaatgattttcaacatgacattgtttctgatgatggaattgactggtcctctaatcgaaatttgctaaacgaaacatcattgaaacctgcggatctgcctatttgttcttttgctgctgctggtaattgtccttatggggaagggtgccctcaaatgcatggagatctgtgtgcaacctgtggaaaaatgtgcttgcatcctcatcgtcctgatgagagggaggagcatatcaaggtatgtgagaaaaatcacaaacgccttgaagctctgaaacgcagccaagaaatagaatgcagtgtatgtttggatcgtgtgctttcaaagcctactgctgctgaaaggaagttcggactgttatccgaatgtgatcatcctttctgtattgcatgcattagaaattggcgtagcaattctcctgcatctggtatggatgtgaactcagcactgagggcttgtccaatatgtcggaaactttcatactatgtcattccaagtgttctttggtacttctcgaaggaagagaaagaggagatcactgaaagctacaaatccaagctcaagtctattgattgcaagtactttgactttgggactggctcatgcccctttggaacaagttgtttctacaggcatgcctacagagatggccgcttggaagaggttgtactacggcatcttgatgctgatgatggaagtacagtaattgcaaaagacatcaggttatcagacttcctcggtaggatgcatctttagggaccagcagctgtatagatatcaaatgctttctgggatatcgttatccaccaattatttacaatattctgaagagcagtttagcttgaggcatcttcggaaagtacagctttgtctccatttagtggtggttgctttgtcgccagttgaaataagaaagtttgaagatctctatggtcctgtagacgctgggattaccttttcaaagcactgttgacctgaggacaatggaaagaagtctgacaacaattgtgcttgaataccaaaacagaagcaatactgtttatagacttcactatatgtgctctatgtatcaattgctggtcttctaggccaccagaagagtaaaaggcaggcgtataagtttacttcccttttacctcaatgttgttctcatattgtggaatggtactgcaccaatgggtcgaataaggtcatttggttgtattacttaatatacaaaaaaaaaaggtatagcagatgaaatacagaatgacaattgtaatgcagtattgttgaatgtgagcgtgagcggtgcttttcatctatgacctgctaagtaaggtcctcttagtagcaggtgaactgagataattttttgcttatatacagcataaatgtacgagaagaatagcatttttttttaccaatatatgacataattgtacgagaaaaataacattttttgcttatatatacagcataaatgtacgagaaaattggaaaagggagctaaaagttggtttctttttctcttgatataaaatcacgg

SEQ ID NO: 916 - DNA, 1375 bp, Secale cereale
gatgtatcctttggagatggaaggcacctcaaacccaaagacgaacaacaagcccaagtattccaagttcacacagcaggagcttccagcatgcaagccgctactgacacctgaaatcgtcattgctgcctttgcgctcattggcgccctgtttgttcccatcgggcttgcgtcgctgcatgcgtcacggcaggttgtcgaactggtgcatagatatgacgcaagttgcgtgcccgtggatgacaaggttggcttcatccagaactccaggactgacaaaacatgcacagtaacaatgaatgtgccaaaatacatgaagagcccaatccacgtctattacctgattgacggcttctatcaaaaccatcgaaggtatgtgaaaagtcgaagtgacaaacaactgcggtataagaatgctgcacatttgacatcggattgtgtgcctgagggtattaccgctgatcgtgctccaattgttccatgtggccttgttgcttggagtttgttcaatgacacatacactgttcgggtcaatggggtggttactcaagtgaataaaaaggacatagcttggaagagtgacaagaacaataaattcggcaaggatatctatcccagtaacttccagaagggaagtcttataggtggtgctaagctaaatgagagcataccgttaagtgagcaagaagatctcattgtttggatgagaacggctgccctcccaactttcaggaagctgtatggcagaattgagaaagatatcaatgcaaatgataatgtaacagtggttatacagaacaactataacacatatagttttggaggatcaaaagcgttggtcctttctactgcatcttggattggaggaaaaaacaacttcattggtattgcatatctgactattggtggtttgtgcctttcccttgctatgggcttcttagttctctacatggttaaacgaaggaactttggagacccctcgaacctgtcatggaatagatgaatagagttaactattagactggagtatcctgtctgagaataaaagatcattcaatgggtaaattcttccaattggatctatgggtgtttgttcatattcccattcactgggcttgtcatggctcataggcatgaggatcttgttgactttggagccgtaatagcatcatacatacatgaacagaatgtattgtaatcggttgacttaaatcttatctgaccttatctgaccataccgagagtcgtttctgaatgcttattatgaattataaaccaactaattgtgaaacttaaaaaaaaaaaaaaaaaaaaaaagaaaaaaagaaaaaagaaaagaaaaaaaaaagagagagagagagagagagagagacac

SEQ ID NO: 917 - DNA, 1269 bp, Triticum aestivum
gatgtatcctttggaaatggagggcaactcgaacccaaagacgaccaacaagcccaagtattccaagttcacacagcaggagcttccagcatgcaagccactactcacacctgaaatcgtcattgccgccttcgcgctcattggcgccctgtttgttcccatcgggcttgcgtcgctgcatgcatcacgacaggttgtcgaactggtgcatagatatgatgcaagttgtgtgcccgtggatgacaaggttgggttcatccagaactccaggactgacaaaacatgcacagtaacaatgactgtgccaaaatacatgaagagcccaatccatgtctattacctgatcgacggcttctatcaaaaccatcgaaggtatgtgagaagtcgaagtgacaaacaactgcggtataagagtgctgcacatttgacatcggattgtgtgcctgaaggtgataccgctgatcatgctccaattgttccatgtggccttgttgcttggagtttgttcaacgacacatatacagttcgggtcaatggggtggttactcaagtgaataaaaaggacatagcttggaagagtgacaagaacaataaattcggcaagaatatctatcccagtaacttccagaagggaaggcttataggtggcgctacgctaaatgagagcataccattaagtgagcaagaagatctcattgtttggatgagaactgctgccctcccaactttcaggaagctgtatggcagaattgagaaagatatcaatgcaaacgataatgtaacagtggttatacagaacaactataacacatatagttttggaggatcaaaagcgttggtcctttccactgcatcttggattggaggaaaaaacaacttcattggtattgcatatctgactattggtggtttgtgcctttcccttgcaatgggcttcttagttctctacatggttaaacgaaggaactttggagacccctcgaacctgtcatggaatagatgaatagagttaactattagactggagtatcatgtctgagaataaaagatcattcaatgggtaaattcttccaattggatctatgggtgtctgttcttattcccattcactgggcttgtcatggctcataggcatgaggatcttgttgactttggagccgtaatagcatcatacatacatgaacagaatgtattgtgatcggttgacttaaatcttatctgaccttatctgaccataccgagagtcgtttctgaatgcttattatgaat

SEQ ID NO: 918 - DNA, 1332 bp, Triticum aestivum
cctttggaaatggagggcaactcgaacccaaagacgaccaacaagcccaagtattccaagttcacacagcaggagcttccagcatgcaagccactactcacacctgaaatcgtcattgccgcctttgcgctcattggcgccctgtttgttcccatcgggcttgcgtcgctgcatgcatcacgacaggttgtcgaactggtgcatagatatgatgcaagttgtgtgcccgtggatgacaaggttgggttcatccagaactccaggactgacaaaacatgcacagtaacgatgactgtgccaaaatacatgaagagcccaatccatgtctattacctgatcgacggcttctatcaaaaccatcgaaggtatgtgagaagtcgaagtgacaaacaactgcggtataagagtgctgcacatttgacatcggattgtgtgcctgaaggtgataccgctgatcatgctccaattgttccatgtggccttgttgcttggagtttgttcaacgacacatatacagttcgggtcaatggggtggttactcaagtgaataaaaaggacatagcttggaagagtgacaagaacaataaattcggcaagaatatctatcccagtaacttccagaagggaaggcttataggtggcgctacgctaaatgagagcataccattaagtgagcaagaagatctcattgtttggatgagaactgctgccctcccaactttcaggaagctgtatggcagaattgagaaagatatcaatgcaaatgataatgtaacagtggttatacagaacaactataacacatatagttttggaggatcaaaagcgttggtcctttctactgcatcttggattggaggaaaaaacaacttcattggtattgcatatctgactattggtggtttgtgcctttcccttgctatgggcttcttagttctctacatggttaaacgaaggaactttgcagacccctcgaacctgtcatggaatagatgaatagagttaactattagactggagtatcctgtctgagaataaaagatcattcaatgggtaaattcttccaattggatctatgggtgtctgttcttattcccattcactgggcttgtcatggctcataggcatgaggatcttgttgactttggagccgtaatagcatcatacatacatgaacagaatgtattgtgatcggttgacttaaatcttatctgaccttatctgaccataccgagagtcgtttctgaatgcttattatgaattataaaccaactaattgtgcttatgggaggagatacctatacttgttcttgcagtccatgtttcatgttt

SEQ ID NO: 919 - DNA, 1345 bp, Brachypodium distachyon
gtcgcgccggcgatccccgcctcctcgatggatcctgtgaagtcggatggcgactcaaagaaatgcaataagcccaaatattctaagtttacacagcaggagcttccagcatgcaagccactactgacacctggaattgtcatcgctgccttctcgctcataggggtcatatttgttccgattgggcttgcatcgctgtctgcatcgcgagaggttgtcgaattggtgggtcgatatgatgtaagttgtgtgcccgatgatgacaaggtccagttcatccaaaactcccagagtgacaaaaaatgcacaataacactgaatgcgcctaaatatatgaagagcccaatccatgtatactaccaggtcagtggcttctatcaaaaccatcgaaggtatgtgaaaagtcgaagtgataaacaactgcggtataagagtgctgtgcatttgacaaaagattgcgagcctgaagataatgccgctaatggtgctccaattgttccgtgtggccttgttgcttggagtatgttcaatgatacatatgtggttttggtcaacagcaatgctattgaagtgaacaaaaaggatatagcttggaagagtgacaagaatcataaattcggtaaagatatctatcccagtaattttcagaagggaaggctcataggtggtgctaagctaaatgagagcataccattaagcgagcaagaagatctcatcgtttggatgagaaccgctgccctcccaactttcagaaagctgtatggcagaattgagaaagacataatggcaaatgataacataacagtggttatacagaacaactataacacatatagttttggaggatcaaaagcgttggtcctttctactacatcttggattggagggaaaaataacttcattggtattgcatatctgactataggtggtttgtgccttttccttgcaatggctttcatggtaatctacatgcttaagacaaggacccttggagacccctcatacctgtcatggaatagagataaatgagataccctggagcattaaaacttatagaatggagtccccttgatgggaataaaagagcatttcaatgggtaaatttcttccagtttgatatatgggtgcttgttcttattcccattcattatgttggttcagacacatgactctggagccgtaatagcatgatacatgcatgagacagaatgcattgtaatctgttgtcttaaattttatatgaccatgcagacttgccgagagtcgtatcttaattaagactatgaaatataaactaagtaaagtgcttatggtagcagatatttaatatctatccttgttcttc

SEQ ID NO: 920 - DNA, 1542 bp, Brachypodium distachyon
ctggttccttcctcgtcggcttcttctcccaccccgtcactctccaccaccgcccaccgcacccaacacgcgcgccgtccaccacccagaccccacccccaccccgcccccgctcctctccccgttgtcgcgccggcgatccccgcctcctcgatggatcctgtgaagtcggatggcgactcaaagaaatgcaataagcccaaatattctaagtttacacagcaggagcttccagcatgcaagccactactgacacctggaattgtcatcgctgccttctcgctcataggggtcatatttgttccgattgggcttgcatcgctgtctgcatcgcgagaggttgtcgaattggtgggtcgatatgatgtaagttgtgtgcccgatgatgacaaggtccagttcatccaaaactcccagagtgacaaaaaatgcacaataacactgaatgcgcctaaatatatgaagagcccaatccatgtatactaccaggtcagtggcttctatcaaaaccatcgaaggtatgtgaaaagtcgaagtgataaacaactgcggtataagagtgctgtgcatttgacaaaagattgcgagcctgaagataatgccgctaatggtgctccaattgttccgtgtggccttgttgcttggagtatgttcaatgatacatatgtggttttggtcaacagcaatgctattgaagtgaacaaaaaggatatagcttggaagagtgacaagaatcataaattcggtaaagatatctatcccagtaattttcagaagggaaggctcataggtggtgctaagctaaatgagagcataccattaagcgagcaagaagatctcatcgtttggatgagaaccgctgccctcccaactttcagaaagctgtatggcagaattgagaaagacataatggcaaatgataacataacagtggttatacagaacaactataacacatatagttttggaggatcaaaagcgttggtcctttctactacatcttggattggagggaaaaataacttcattggtattgcatatctgactataggtggtttgtgccttttccttgcaatggctttcatggtaatctacatgcttaagacaaggacccttggagacccctcatacctgtcatggaatagagataaatgagataccctggagcattaaaacttatagaatggagtccccttgatgggaataaaagagcatttcaatgggtaaatttcttccagtttgatatatgggtgcttgttcttattcccattcattatgttggttcagacacatgactctggagccgtaatagcatgatacatgcatgagacagaatgcattgtaatctgttgtcttaaattttatatgaccatgcagacttgccgagagtcgtatcttaattaagactatgaaatataaactaagtaaagtgcttatggtagcagatatttaatatctatccttgttcttctagttctttatgggacaaaattatccccatgtgccaattctattgttcatagcgcgatgtttgtgtcctgc

SEQ ID NO: 921 - DNA, 1088 bp, Triticum aestivum
agtgcacctatcttggccgatccgggctgccataacccaaaaccccgaaccgagcgcgcgctcatctataaattgcgctcggacatcacagcgaggcatcatatgcccactcactacttggctcgtactgtcgaatacactacagcaccgaaaaagctgccaaggggctccgtcgtccatggacgtgccgaccgccggacaagccgccgctgtaccgcagcgcaaggcgttggagtgggagggccgggtggtgtccccggtgccgacggcgacggcggacgaggcgtgggcgctgctgtcggacttcctggcgttccacaagtggcacccgcgcgtggcggtgtgccgcctggcgtcctccggcgcggcggcgcccgggtgcgtccgctactgcgagggcaccccgcccgccgacgggacgcccgccgactgggcgcacgagacgctcctcgagcacgaccaggcccgccgcttcttccgctacgagatgaacgacaacaacatgggcttcggcgccttcttcgccgcgttccgcgtcgtccccgccgcggccggcggctgcgtgctgcggtgggagttcgagtgcgagcccgtgcggggcacgcccaaggaggcgctcgaggcgcggctgcaggccgggctcgacggaatggccgcacgcgtgcacgagcacctcatgtccgcgcgcgcggccgtcgccgccgccgcgccggcgaccgccgtgactgcagggctggaggccgccgatgagctcaagctggacagctccatcgcggcctgagctctgagcactcgacgcgcacgacaggcccggttccacctctgtgtgcacgtaccgacgacgtacgtttggttgtgatctcgtctcgttcttttctcgcggtactatgttgtctgatgatattttatctttgttttgttctgggcctttgtctgcttgccgttatgtatgtgcgcgtacgtaccgtttactacagtacggtagtgcccctatacagctgtaccgggaataaatgtatgatattactcgtagtaatatatgcaaaagtgattagtgcatgtgcagccttttttccatcttaatacta

SEQ ID NO: 922 - DNA, 1010 bp, Triticum aestivum
gatcatcatacgcccacgctcaccacttggctcactgtcgtactcggtaccctacagcgccgaaagagctgccaaggggctccgtcgtccatggacgtgccgaccgccggtggagccgccgccgccgcaccgcagcgcagggcctgggagtgggagggccgggtggtgtccccggtgccggcggcgacggcggacgaggcgtgggcgctgctgtcagacttcctggcgttccacaagtggcacccgcgcgtggcggtgtgccgcctggcgtcggcgtcgccctccggcgccgcggcggcgcccgggtgcgtgcgctactgcgagggcaccccgccgggcgacggggcgcccgccgactgggcgcacgagacgctcctggagcacgaccaggcccgccgcttcttccgctacgagatgaacgacaacaacatggggttcggcgccttcttcgccgccttccgcgtcgtccccgccgcccacgcggccggcgggtgcgagctgcggtgggagttcgagtgcgagcccgtgcggggcacgcccaaggaggcgctcgaggcgcggctgcaggccgggctcgacggcatggccgcgcgcgtgcacgagcacctcatgtccgcgcgcgctgccgtcgccgcagccgcgccggcccccgccgtggccgcagggctggaggccgccgacgagctcaagctcgacaactccatcgcggcctgagctctgagcagtgagcactcgatgtacgcacacggttccacgtctgcgtgcacgtaccgacgacgcacgtacggttggttgtgatctcgtcccgtttctttctcgcggtactacgtacgttgtccgatgatattttctctttgttctgttctggcccttctgggcctttgtcggtttgccgttatgtatgtgcggctacgtaccgtttactacagtacggtagtgcccttatatatacagctgtaccgggaataaatgtatgatattactcgtaatatatgcaagtgatcagtgca

SEQ ID NO: 923 - DNA, 967 bp, Secale cereale
caccacttgactcgtaccgtcgtacaccacagcgccgaaaaagccgccaaggggctccgtcgtccatggacgtgccgaccgctgctcaggccgccgccgtatcgcagcgcaaggcgtgggagtgggaggggcgggtggcgtccccggtgccggcggcgacggcggacgaggcgtgggcgctgctgtcggacttcctggcgttccacaagtggcacccgcgcgtggcggtgtgccgcctggcgtcctccggcgcggcggcgccaggcccagggtgcgtccgctactgcgagggcaccccgcccgccgacggggcgcccgccgactgggcgcatgagacgctcctcgagcacgaccaggcccgccgcttcttccgctacgagatgaacgacaacaacatgggcttcggcgccttcttcgccgtgttcggcgtcgtccccgccgcggccggcgggtgcgaactgcggtgggagttcgagtgcgagcccgtgcggagcacgcccaaggaggcgctcgaggcgcggctgcaggccgggctcgacggcatggccgtgcgcgtgcacgaccacctcatgtccgcgcgcgctgccgtggccgtcgccgccgccgcgccgacgaccgctgtggctgcagggctggaggccgccgatgagctcaagctggacaactccatcgcggcctgagctctgagcgagcactcgacgtacagtgccaggcccggttctacctccgtgtgcacgtaccgacgacgtacgtttggttggttgtgatctcgtctcgttcctttctcgcggtactacgttgtcccatgatattttctctttcttttgttctgggcctttgtcggtttgcagttatgtatcaatgtatgcgcgcgtacgtaccgtttactacagcacggtagtcccccccccccccccccctacacagctgtaccgggaataaatgtatgatattactcgtaatatat

SEQ ID NO: 924 - DNA, 1066 bp, Leymus cinereus x Leymus triticoides
  misc_feature (5)..(5): n is a, c, g, or t
  misc_feature (26)..(26): n is a, c, g, or t
  misc_feature (46)..(46): n is a, c, g, or t
  misc_feature (57)..(57): n is a, c, g, or t
  misc_feature (82)..(82): n is a, c, g, or t
  misc_feature (106)..(106): n is a, c, g, or t
  misc_feature (120)..(120): n is a, c, g, or t
  misc_feature (123)..(123): n is a, c, g, or t
  misc_feature (149)..(149): n is a, c, g, or t
  misc_feature (222)..(222): n is a, c, g, or t
  misc_feature (229)..(229): n is a, c, g, or t
  misc_feature (243)..(243): n is a, c, g, or t
  misc_feature (462)..(462): n is a, c, g, or t
  misc_feature (591)..(591): n is a, c, g, or t
  misc_feature (604)..(604): n is a, c, g, or t
  misc_feature (697)..(697): n is a, c, g, or t
  misc_feature (730)..(730): n is a, c, g, or t
  misc_feature (754)..(754): n is a, c, g, or t
  misc_feature (761)..(761): n is a, c, g, or t
  misc_feature (871)..(871): n is a, c, g, or t
  misc_feature (900)..(900): n is a, c, g, or t
ctcanccttggctcgtactgtcgtanaccacagcaccgaaaaagcngccaaggggcnccgtcgtccatggacgtgccgaccnttgccgctgtaccgcagcgcaagncgtgggagtggganggncgggtggtgtccccggtgccggcggngacggcggacgaggcgtgggcgctgctgtcggacttcctggcgttccacaagtggcacccgcgcgtggcggtntgccgcntggcgtcctccggngcggcggcgcccgggtgcgtccggtactgcgagggcaccccgcccgacgacgggacgcccgccgactgggcgcacgagacgctcctcgagcacgaccaggcccgccgcttcttccgctacgagatgaacgacaacaacatgggcttcggcgccttcttcgccgcgttccgcgtcgtccccgccgcggccggcgggtgcgagctgcggtgggagttcgantgcgagcccgtgcggggcacgcccaaggaggcgctcgaggcgcggctgcaggccgggctcgacggcatggccgcacgcgtgcacgagcacctcatgtccgcgcgcgctgccgtcgccgtcgccgcagcngcgccggcccccnccgtgactgcagggctggaggccgccgatgagctcaagctggacaactccatcgcggcctgagctctgagcactcgacgtacacgccaggccnggttccacctccgtgtgcacgtaccgacgacgnaagtttggttgtgatcgtatcgtncctttcncgcggtactacgttgtccccgatgatatttcgtctttgttttgttctgggcctttgtctgtttgccgttatgtatgtgcgcgtacgtaccgtttactacagtacggtagnaccccctatacagctgtaccgggaataantgtatgatattactcgtaatatatgcaaaagtgatcagtgcatgtgcagccctttatcttaatgctcacttatggaaatgtaagccgggcatgaatttttaggcctttgatttgattatcaaaaaatgtattgtttgtcataaaaataatatttttacaaaaaaaa

SEQ ID NO: 925 - DNA, 970 bp, Pseudoroegneria spicata
  misc_feature (226)..(226): n is a, c, g, or t
  misc_feature (290)..(290): n is a, c, g, or t
  misc_feature (414)..(414): n is a, c, g, or t
  misc_feature (424)..(424): n is a, c, g, or t
  misc_feature (444)..(444): n is a, c, g, or t
  misc_feature (518)..(518): n is a, c, g, or t
  misc_feature (701)..(702): n is a, c, g, or t
  misc_feature (749)..(749): n is a, c, g, or t
acttggttcactgtcgtactcgtacactacagcgccgaaaaagctgccaaggggctccgtcgtccatggacgtgccgaccgccggcggagccgccgctgtaacgcagcgcacggcgtgggagtgggaggggcgggtggtgtccccggtgccggcggcgacggcggacgaggcgtgggcgctgctgtccgacttcctggcgttccacaagtggcacccgcgcgtggnggtgtgccgcctggcgtcttcgtccggcgcggcggcgcccgggtgcgtgcgctactgcgagggnaccccgcccgacgacggggcgcccgccgactgggcgcacgagacgctcctcgagcacgaccaggcccgccgcttcttccgctacgagatgaacgacaacaacatgggcttcggcaccttcttcnccgtgttccncgtcgtccccgccgccgcgnccggcgggtgcgagctgcggtgggagttcgagtgcgagcccgtgcggggcacgcccaaggaggcgctcgaggcncggctgcaggccgggctcgacggcatggccgcacgcgtgcacgagcacgtcatgtccgcgcgcgctgccgtcgccgttgccaccgccgccacgccgccgaccaccgtgactgcagggctggaggccgccgatgagctcaagctggacaactccatcgcggcctgagctctgagcacccgacgnncacgccaggcccggttccacctcggtgtgcacgtagcgacgacgtangtttggttgtgatctcgtctcgttcttttctcgcggtactacgttgtctgatgatattttctctttgttttgttctgggcctttgccagtttgccgttacgtatatgcggctacgtcccgtttactacagtacggtagtacccctatacagctgtaccgggaataaatgtatgatattactcgtaatatatgcaagtgatcagtgcatgtgcagtctttta

SEQ ID NO: 926 - DNA, 1683 bp, Triticum aestivum
cgaagctcggagctcggacagccgctcgttccgattacatatagcgggtcactgatctcactggacggttcgctactgactgcctactggcaacattcacgcctgcgctgcgcctccgtcccgtgacttgcctgccttcccctgccgccgcgactgggactgggagagcttcggggcgccatggcgcaaaccccaccgattccccgcgtcagcctcggcacccaaggactggaggtgtccaagctggggttcgggtgcatgggcctcacaggctcctacaactccccggtcgaggacgacgccggcgtcgccgtcatcacgcacgccttccgccgcggcgtcaccttcttcgacacctccgacgtctacgggccccacgccaacgagatcctcctcggcaaggcgctgaagcagctgccgcgggagcaggttcaggtggccaccaagtttgggattcagcgggatgcccagggcaagagcaccatctgcggccgcccggagtacgtgcgcgcctgctgcgaggccagcctgcaccgcctcggcgtcgaccacatcgacctctactaccagcaccgcatcgacaccaccatccccatcgaggacacgattggtgagctcaagaagcttgtggaggaggggaaggtcaagtacattgggttatcggaggctagcccggacaccatccggcgtgctcacgctgtgcaccccatctctgccgtgcagatggagtggtctctgtgggctcgcgacatcgagcccgagatcgtgcctctctgcagggagctagggattggaattgttccctacagcccgattgcccgtgggtttttcggtggaaggggagtgacacaacaagtgtctgctgaatctagtctgaaaggccatccacgtttttcggctgaaaacctggagaagaacaagcaactctatctgaaaatggaagaactggccaagaagcaccagtgcagccctgctcagctagctttatcctgggttctgcatcaaggggatgatgtggttccgataccagggactactaagatcaagaatctagactccaacattgactccttgaaggtgaggctcacggaagatgacctcaaagagattagcaacgagatacgcgaagaagatgttgccggtgggaggcagtatacttcgtttgcgaaattcacctggaattatgcggatacgccaaagaagtgaaactacaaaagattgtggagacggtgaaacaagcatgccatgctatgtgctcgtgtgatgaatggtgccccctgtatcttcatcttgtgaattgtcccgtgaataagaacatgtgcactgtctccacctgccgtgtaaatttatgtgtgcctgtataacagaagactgagactgtgctagctatgtttgtggctctctagtcttaccggctttccgtgacagcaattacactgttggaaaatgtatctgctcaaagagatattcagaagcatatcaagacgtttgaaaaaaaaagcatgtcaagaaaaactgttatggccggtttagctaggcccacagggcagtagttaggggtttggcccacaagttatcttaagttaattcttatgcaagttatcttaggttaattcttatgcaagttatctaggttataaatataggctgtaagactctttttggaatcaagcaataagaata

SEQ ID NO: 927 - DNA, 1503 bp, Triticum aestivum
ggcaacattcacgcctgcgcttccgtctcgtgacttgccttcccctgccgctgcggctgcgagcttcggggcgccatggcgcaaacctcacctattccccgcgtcagcctcggcacccaaggactggaggtgtccaagctggggttcgggtgcatgggcctcacaggctcctacaactccccggtcgaggacgacgccggcgtcgccgtcatcacgcacgccttcaaccgcggcgtcaccttcttcgacacctccgacgtctacgggccccacgccaacgagatcctcctcggcaaggcgctgaagcagctgccgcgggagcaggtgcaggtggccaccaagtttgggattcagcgggatgcccagggcaagagcaccatctgcggccgcccggagtacgtgcgcgcctgctgcgaggccagcctgcaccgcctcggcgtccaccacatcgacctctactaccagcaccgcatcgacaccaccatccccatcgaggacacgattggtgagctcaagaagcttgtggaggaggggaaggtcaagtacattgggttatcggaggcgagcccggacaccatcaggcgtgctcacgccgtgcaccccatctcctccgtgcagatggagtggtctctgtgggctcgcgacatcgagcccgagatcgtgcctctctgcagagagctagggattggaattgttccctacagcccgattgctcgtgggtttttcggtggaaggggagtgacacaacaagtgtctgctgaatctagtctgaaaggccatccacgtttttcggctgaaaacctggagaagaacaagcaactttatctgaaaatagaagaactggccaagaagcaccagtgcagccctgctcagctagctttatcttgggttctgcatcaaggggatgatgtggttccgataccagggactactaagataaagaatctagactccaacattgactccttgaaggtgaggctcacggaagatgacctcaaagagatcagcaacgagatacgcgaagaagatgttgcgggtggaaggcaatatacttcatttgcgaaattcacctggaattatgcggatacgccaaagaagtgaaactacaaaagatcatggagacggtgaaacaagcatgccatgctatgtgctagtgtgatgaatggtgctccctgtatcttcatcctgtgaattgtcccgctctgaataagaacatgtgcactgtctccacctgccgtgtagatttatgtgtgcttgtataacagaagactgagaccgtgcttgctatgtttgtggctctctagtcttaccggctttccgtgacagtaattacaccgttggaaaatgtatctgctcaaagagatattcagaagcatatcaagacgtttgaaaaaaaaagcatgtcaagaaaaactgttatggccgggttagctaggcccacagggcagtagttagggggttggcccacaagttatcttaagttaattcttatgcaagttatct

SEQ ID NO: 928 - DNA, 1614 bp, Triticum aestivum
gctactgactgcctactggcaacattcacgcctgcgctgcgcctccgtcccgtgacttgcctgccttcccctgccgccgcgactgggactgggagagcttcggggcgccatggcgcaaaccccaccgattccccgcgtcagcctcggcacccaaggactggaggtgtccaagctggggttcgggtgcatgggcctcacaggctcctacaactccccggtcgaggacgacgcgggcatcgccgtcatcacgcacgccttccgccgcggcgtcaccttcttcgacacctccgacgtctacgggccccacgccaacgagatcctcctcggcaaggcgctgaagcagctgccgcgggagcaggtgcaggtggccaccaagtttgggattcagcgggatgcccagggcaagagcaccatctgcggccgcccggagtacgtgcgcgcctgctgcgaggccagcctgcaccgcctcggcgtccaccacatcgacctctactaccagcaccgcatcgacaccaccatccccatcgaggacacgattggtgagctcaagaagcttgtggaggaggggaaggtcaagtacattgggttatcggaggcgagcccggacaccatcaggcgtgctcacgccgtgcaccccatctccgccgtgcagatggagtggtctctgtgggctcgcgacatcgagcccgagatcgtgcctctctgcagagagctagggattggaattgttccctacagcccgattgctcgtgggtttttcggtggaaggggagtgacacaacaagtgtctgctgaatctagtctgaaaggccatccacgtttttcggctgagaacctggagaagaacaagcaactttatctgaaaatggaagaactggccaagaagcaccagtgcagccctgctcagctagctttatcctgggttctgcatcaaggggatgatgtggttccgataccagggactactaagattaagaatctagactccaacattgactccttgacggtgaggctcacggaagatgacctcaaagagattagcaacgagatacgcgaagaagatgttgccggtggaaggcaatatacttcatttgcgaaattcacctggaattatgcggatacgccaaagaagtgaaactacaaaagattgtggagacggtgaaacaagcatgccatgctatgtgctagtgtgatgaatggtgctccctgtatcttcatcttgtgaattatcccgtgaataagaacatgtgcactgtctccacctgccgtgtaaatttatgtgtgcttgtataacagaagactgagaccgtgcttgctatgtttgtggctctctagtcttaccggctttccgtgacagtaattacaccgttggaaaatgtatctgctcaaagagatattcagaagcatatcaagacgtttgaaaaaaaagcatgtcaagaaaaactgttatggccggtttagctaggcccacagggcagtagttaagggtttggcccacaagttatcttaggttaattcttatgcaagttatcttaggttaattcttatgcaagttatctaggttataaatataggctgtaagactctttttggaatcaagcaataagaagaata

SEQ ID NO: 929 - DNA, 1370 bp, Brachypodium distachyon
gtgtttgtaaatcagtcagtgactcgtcagtcatcactcatcagctagcgccgtcccttccttcactgctgctgctgttcctgcaagccgtgcgaggcgccgccatggagcaaaccccgttgattcctcgtgtcaggctcggcacccagggactgcaggtgtcgaagctggggttcgggtgcatgggcctgacgggcgcgtacaacaccccgctggacgacgacgccggcgtggccgtcatcgcgcacgccttccgccgcggcgtcaccttcttcgacacctccgacgtctacgggccccacgccaacgagatcctcctcggcaaggcgctgaagcagctgccgcgggagcaggtgcaggtggccaccaagttcgggatccagcgggacgccgccgccggcaagagcaccgtgtgcggccggccggagtacgtgcgcgcctgctgcgaggccagcctgcgccgcctcggcctcgaccacatcgacctctactaccagcaccgcgtcgacaccaccatccccatcgaggacacgatcggcgagctgaagaagctggtggaggaggggagggtcaagtacatcgggctatcggaggcgagcccggacaccatcaggcgcgcccacgccgtgcaccccatcaccgccgtgcagatggagtggtctctctgggctcgcgacatcgagccccagatcgtgccgctctgcagagaattggggattggaatcgttccgtacagccccattgcccgtgggttctttggcggaagaggagtcacacagcaagtgtctgctgaatctagtctgaaagggcatccacggttttctgctgagaatctggagaagaacaagcttctttatctgaaaatggaacagctagccgagaagcaccggtgcagccctgctcagctagctctagcttgggtcctgcatcaaggggatgatgtggttccgataccagggacaactaagatcaagaatctagactccaacatcgactccttgaaggtgaagctcacagaagatgatctgaaagaaattagcagccagatacgcgaagaggatgtggctggtggaaggcagtatacttcctttgcgcataccacctggaattatgcagacacaccaaagaagtaaaagtacaagagattccagagacactgatcggtgaggataaaacggctgtgccattctatttgatgtgctgaatggtgctgcatgtatcttgcgaatgtcatgtgctaaataatgtactagtagggtcaacaataattgcaatctcttcagaaaccatgtaacggatgtgcttgagcaaagagttcatttctgactgtgctcctatgacaaaaggctgagagtatgtgctattgctat

SEQ ID NO: 930 - DNA, 1498 bp, Brachypodium distachyon
tgtgtgtgtgtgtgtttgtaaatcagtcagtgactcgtcagtcatcactcatcagctagcgccgtcccttccttcactgctgctgctgttcctgcaagccgtgcgaggcgccgccatggagcaaaccccgttgattcctcgtgtcaggctcggcacccagggactgcaggtgtcgaagctggggttcgggtgcatgggcctgacgggcgcgtacaacaccccgctggacgacgacgccggcgtggccgtcatcgcgcacgccttccgccgcggcgtcaccttcttcgacacctccgacgtctacgggccccacgccaacgagatcctcctcggcaaggcgctgaagcagctgccgcgggagcaggtgcaggtggccaccaagttcgggatccagcgggacgccgccgccggcaagagcaccgtgtgcggccggccggagtacgtgcgcgcctgctgcgaggccagcctgcgccgcctcggcctcgaccacatcgacctctactaccagcaccgcgtcgacaccaccatccccatcgaggacacgatcggcgagctgaagaagctggtggaggaggggagggtcaagtacatcgggctatcggaggcgagcccggacaccatcaggcgcgcccacgccgtgcaccccatcaccgccgtgcagatggagtggtctctctgggctcgcgacatcgagccccagatcgtgccgctctgcagagaattggggattggaatcgttccgtacagccccattgcccgtgggttctttggcggaagaggagtcacacagcaagtgtctgctgaatctagtctgaaagggcatccacggttttctgctgagaatctggagaagaacaagcttctttatctgaaaatggaacagctagccgagaagcaccggtgcagccctgctcagctagctctagcttgggtcctgcatcaaggggatgatgtggttccgataccagggacaactaagatcaagaatctagactccaacatcgactccttgaaggtgaagctcacagaagatgatctgaaagaaattagcagccagatacgcgaagaggatgtggctggtggaaggcagtatacttcctttgcgcataccacctggaattatgcagacacaccaaagaagtaaaagtacaagagattccagagacactgatcggtgaggataaaacggctgtgccattctatttgatgtgctgaatggtgctgcatgtatcttgcgaatgtcatgtgctaaataatgtactagtagggtcaacaataattgcaatctcttcagaaaccatgtaacggatgtgcttgagcaaagagttcatttctgactgtgctcctatgacaaaaggctgagagtatgtgctattgctatctagagcagttttctgcgacagcaacaacagtggtgtaaatgtgtgtggcaaacagaaattcaaagcatatcaagaaaaaggattcctatctaacccgaggacatatcacaggcaca

SEQ ID NO: 931 - DNA, 1327 bp, Avena sativa
ccgttccatagttccatccccctgcctctgcgactgcgagctggaggcgccatggcggaaaccccactgattgctcgcgtcagtctcggcacccagggactggaggtgtccaagctggggttcgggtgcatgggcctgacgggcgcgtacaactccccgctcggcgacgacgccgggatcgccgtcatcgcgcacgccttccgccgcggcgtcaccttcttcgacacctccgacgtctacggcccccacaccaacgaggccctcctcggcaaggcgctgaagcagctgccgcgggagcaggtgcaggtagccaccaagttcgggatccagcgggactccttcggcacgggcaccgtgtgcggccgcccggagtacgtgcgcgcctgctgcgaggccagcctgcgccgcctcggcctcgaccacatcgacctctactaccagcaccgaatagacaccaccatccccatcgaggacacgattggcgagctcaagaagctggtggaggaggggaaggtcaagtacattgggctatcggaggcgagccctgacaccatcaggcgtgctcacgccgtgcacccgatctccgcggtgcagatggagtggtctctgtgggctcgcgacatcgagcccgagattgtgcctctctgcagggaattggggattgggattgttccttacagcccgattgcccgtggttttttcgctggaagaggggtgactgaacaagtgtctgctgaatctaatctgaaaggacatccacgattttcggcagaaaatctggagaagaacaaacttctttatctgaaaatggaagaattagccaagaagcaccagtgcagccctgctcagctagctttagcttgggttcttcatcaaggggatgatgtggttccgataccagggacaactaagatcaagaatttagactccaacattgactctgtaaagttaaagctaaccaaagatgagctgaaagaaatcagcgaccaggtacacgaagaagatgtggctggcgggaggcaatatacttcttttgcgcataccacatggaattatgcagacacacccaaaaagtaaaagtacaagagattgtagagacagtgatatgtgcgaacaaaaaaccatgccatgctatctgctactgtgctgcatggtgctgcatgtatcttgtgaatgtccgtgctaaataatgtactgtgaatacaaacaagtgcactgtttccaggaaccatgtaaatttctatctgcttgcatagcagaagactgagattgtactaccagctttctggaacatgtgtctgcacaaagagaaactcagaagcatatc

SEQ ID NO: 932 - DNA, 1366 bp, Avena sativa
gactcggcaatattccactccacgagtcctcagcgtcccttcctgcagacctgcgctgcgccatggaggaaaccccggtgattcctcgcgtcaggctcggcacccagggactggaggtgtcgaagctggggttggggtgcatgggcctgacgggctcctacaactccccgctggacgacgacgccggcgtggccgtcatcacgcacgccttccgccgcggcgtcaccttcttcgacacctccgacttctacggcccccacgccaacgagacactcctcggcaaggcgctgaagcggctgccgcgggagcaggtgcaggtggccaccaagttcgggatccagctgtacgagtacggcgtcggcacgggctccgtgtgcggccggccggagtacgtgcgcgcctcctgcgaggccagcctgcgccgcctcggcgtggaccacatcgacctctactaccagcaccggatagacaccaccatccccatcgaggacacgatcggtgagctgaagaagctagtggaggaggggaaagtcaagtacatcgggctgtcggaggcgagccccgacaccatccggagagcccacgccgtgcacccgatctccgcggtgcagatggagtggtctctctgggctcgcgacatcgagcccgacattgtgcctctctgcagagaactagggattggaattgttccttacagcccgatcggccgtgggtttttcggcggaagaggagtcacggaacaagtgtctgctgaatctaatctgaaagggcatccacggttttcagcagaaaatctggagaagaacaagcatctctatctgaagatggaagaactagccaaggaacacaagtgcagccctgctcagctagctttagcctgggttctgcatcaaggggatgatgtggttcccataccagggacaacgaagatcaagaatctggaatccaacattgactccctgaaggtaaagctcacggaagatggcctgaaagaaattagcaaccagatacgtgaagaagatgtggccggtggaaggagttattcttcctttgcacatgccaactggaactatgcagacacaccaaagaagtaaaatttacaaaagattctacagacagtgatgtgtgagaacaaaacacccgtgccatgctatctgacactgtgctgaatgatgctgcgtgtatcttgtgaatgtgctgcaaataagaacaagtcctatgtatttttatcggctcatataacagaagaatgagactgtaagttgtgtgctgggcctctccatcttgagtgaaaacaattagaaatatttgaggaagtttgggcagtacaaatatggattaatacaacttattaaccatgtggagc

SEQ ID NO: 933 - DNA, 1296 bp, Triticum aestivum
gagtcactgttcgctcgtcgctgctcacagctgctcctgcagttccggcaatattcagcacggcgcttccgtctccgcccccgtgacttgctcgtcgacgatccttgctgcgccatggaggaaaccccactgccactgattcctcgcgtcaggctcggcacgcagggcctggaggtgtctaagcttgggttcgggtgcatgggcctgacgggctcctacagcgccccgctcagcgacgacgccggcgcctccgttgtcgcgcacgccttccgccgcggcgtcaccttcttcgacacctccgacttctacggcccccacaccaacgagacgctcctcggcaaggcgctgaagcagctgccgagggagcaggtgcaggtggccaccaagttcgggatccaggagtacgcgtacgacgagggcaggggcgccgtgtgcggccggccggagtacgtgcgcgcctgctgcgaggccagcctgcgccgcctcggagtcgactacatcgacctctactaccagcaccggatcgacaccaccacccccatcgaggacacgatcggtgagctcaagaagctggtggaggaggggaaggtcaggtacatcgggctgtcggaggcgagccccgacaccatccggcgtgctcacgccgtgcatccggtctccgccgtgcagatggagtggtccctgtgggctcgcgacatcgagcccgagattgtgccgctctgcagagaactggggattggaattgttccttacagcccgatcggccgcgggttcttcggcggaagaggagtcacggagcaagtgtctgctgaatccaatctgaaaaggcacccacggttttcggcagaaaatctggagaagaacaagcatctctatctgaaaatggaagaactagctaggaagcaccagtgcagccctgctcagctagctttagcttgggtcctgcatcaaggggatgatgtggttcccataccaggaacaaccaagatcaagaacctggactccaacattgactccttaaagataaagctcaccgaagatgacctgaaagaaattagcagccagatacgtgaagaagatgtggccggtggaaggagttatacttccttggcgcataccaactggaaccatgcagacacaccaaagaagtaaaactacaaaaaacggtgatatgtgagaataaaacagccatgccatctactgtatctgctatcgtgctgaatggtgctgcatgtaccttgtgaatcttccgtgttaaataatgtactgcaaataagaacatgtgcactgtctcca

SEQ ID NO: 934 - DNA, 1452 bp, Oryza sativa
ggcgttgtggcagtgactgagcacctaaatatccaaagcaagaggccagaggcgttggagaacagaacaaaggtggagactgcgattcacttccactcccttccccactgccttcctcctctcactctcactccccctgcgaccgccgccgagaggccatggcggagcaagctccactggcgccgatgcctcgagtcaagctcggcacccggggcctagaggtgtccaagctggggttcgggtgcatggggctcacgggcgcgtacaactcgccgctcgacgacgacgccggcgccgccgtcatcgcgcacgccttccgccgcggcgtcaccttcttcgacacctccgacgtctacggccccctcgccaacgagatcctcctcggcaaggcgctgaagcagctgccgcgggagcaggtgcaggtggccaccaagttcgggattcggcggggcgccgacggcgtgcgcgccgtgtgcggccggccggagtacgtgcgcgcctgctgcgaggccagcctcggccgcctcggcgtcgactacatcgacctctactaccagcaccgcgtcgacaccaccatccccatcgaggacacgattggtgagctcaagaaattggtggaggaggggaaggtgaggtacattgggctatcggaggcgagccctgacaccatcaggcgagctcatgccgtgcacccaatcactgcagttcagatggagtggtctctctgggctcgtgacattgaacccgaaattgtgccgctctgcagggagttgggcattggaattgttccctacagccctatcgcccgcgggtttttcggagggagaggagtgacagaacaattgtctgctgaatctaatttgcaaggacatccacgattttctgctgaaaatttggagaagaataaacagctttatctgaaaacggaagagctggccaagaagcaccagtgcagccctgctcagctagctttagcttgggttcttcatcaaggggatgatgtggtcccaataccaggaacaaccaagataaaaaacctagatgccaacattgactccttaaaggtgaacctcacggatgatgacctgaaagagatctctagccaggtacgcgaagaagatgtcgctggtggaagacagtatacctcatttgcacattacacctggaagtatgctgacacgccaaagaagtaaagctaaaaaaatattagtatatcaaagatattgcctgattgctattctccctgcgtatgtgctggatggtgttaaatgtatgccttgtgaatgctctctgcggttctaataatgtactgccaataacaaattactgcacttccactcgcctttgagagcttcacgaaacatataaaacttgcttaagcacaatttttatgtctgcattcttttagtccttgtatagactgaaagtggagtgttcgttggtttggtggct

SEQ ID NO: 935 - DNA, 1353 bp, Oryza sativa
ttggagaacagaacaaaggtggagactgcgattcacttccactcccttccccactgccttcctcctctcactctcactccccctgcgaccgccgccgagaggccatggcggagcaagctccactggcgccgatgcctcgagtcaagctcggcacccggggcctagaggtgtccaagctggggttcgggtgcatggggctcacgggcgcgtacaactcgccgctcgacgacgacgccggcgccgccgtcatcgcgcacgccttccgccgcggcgtcaccttcttcgacacctccgacgtctacggccccctcgccaacgagatcctcctcggcaaggcgctgaagcagctgccgcgggagcaggtgcaggtggccaccaagttcgggattcggcggggcgccgacggcgtgcgcgccgtgtgcggccggccggagtacgtgcgcgcctgctgcgaggccagcctcggccgcctcggcgtcgactacatcgacctctactaccagcaccgcgtcgacaccaccatccccatcgaggacacgattggtgagctcaagaaattggtggaggaggggaaggtgaggtacattgggctatcggaggcgagccctgacaccatcaggcgagctcatgccgtgcacccaatcactgcagttcagatggagtggtctctctgggctcgtgacattgaacccgaaattgtgccgctctgcagggagttgggcattggaattgttccctacagccctatcgcccgcgggtttttcggagggagaggagtgacagaacaattgtctgctgaatctaatttgcaaggacatccacgattttctgctgaaaatttggagaagaataaacagctttatctgaaaacggaagagctggccaagaagcaccagtgcagccctgctcagctagctttagcttgggttcttcatcaaggggatgatgtggtcccaataccaggaacaaccaagataaaaaacctagatgccaacattgactccttaaaggtgaacctcacggatgatgacctgaaagagatctctagccaggtacgcgaagaagatgtcgctggtggaagacagtatacctcatttgcacattacacctggaagtatgctgacacgccaaagaagtaaagctaaaaaaatattagtatatcaaagatattgcctgattgctattctccctgcgtatgtgctggatggtgttaaatgtatgccttgtgaatgctctctgcggttctaataatgtactgccaataacaaattactgcacttccactcgcctttgagagcttcacgaaacatataaaacttgcttaagcacaatttttatgtctgcattctttta

SEQ ID NO: 936 - DNA, 1367 bp, Panicum virgatum
ccacgcgtccgcggacgcgtgggctccccggttcccctgtgcggctgtgctgtgcctccgccgtcccatcctccaggctcctccagctcccccggtggtcatggcggaccaagcccctctggttccccgcgtcaacctcggcacccagggattggaggtgtccaagctggggttcggctgcatggggctgacgggcgcctacaactccccgctggacgacgaggccggcatcgccgtcatcacgcacgccttccgccgcggggtcaccttctttgacacctccgacgtctacgggccccacgccaatgagatcctcctcggcaaggcgctgaagcagctgccgagggagaaggtgcaggtggccaccaagttcgggatacggcgtgacggtagcggcgtggccaccgtgtgcgggaagcccgaatacgtgcgcgcatgctgcgaggccagcctgcgccgcctcggcatcgactgcatcgacctctactaccagcaccgcatcgacaccaccatccccatagaggacacgattagtgagctcaagaaactggtggaagaggggaaggtcaagtacatcgggttgtcagaggcaagccccgacacgattaggcgtgcacacgctgtgcatcctatcgcagctgtccagatggagtggtctctctggtctcgagacatcgagcctgagattgtgccgctgtgcagagaattgggcattggagttgttccttatagtccaattggccgcggttttttcggcggaagaggagtgacagaacaagtgtctgctgaatctaatctgcatgggcatccaaggtttgcggcagaaaatttggagaagaacaagcaaatttatctgaaaatggaagaactggccaataagcaccagtgcagccctgctcagctagctttggcatgggttctgcatcaaggggatgatgtcgttcctataccaggaaccaccaaaatcaagaatctagatgccaacattgacgccttgaaggtgaagctgacagatgtggacctgaaagaaatcggcagccagatccgcgaagaagatgtggctggtggaagacaatacacttcctttgcacataccacctggaagtacgcagatacaccaaagaaacagagctaaataaagaacttagcaacggtcatagtatgcgattccctgcagatgtgctcagtatcacggaagatgtggctgtgtgcttgataatgtacatcagaagaagaataaagcgtcgcgctatccgaaatatgagcaaaaagtttgattttgtgtgctcttatactaagacaagactctgtattgtcagcatggaatatctgaacctataataaagttacagtatttgtgcaagctg

SEQ ID NO: 937 - DNA, 1265 bp, Triticum aestivum
gagtcactgttcgctcgtcgctgctcacagctgctcctgcagttccggcaatattcagcacggcgcttccgtctccgcccccgtgacttgctcgtcgacgatccttgctgcgccatggaggaaaccccactgccactgattcctcgcgtcaggctcggcacgcagggcctggaggtgtctaagcttgggttcgggtgcatgggcctgacgggctcctacagcgccccgctcagcgacgacgccggcgcctccgttgtcgcgcacgccttccgccgcggcgtcaccttcttcgacacctccgacttctacggcccccacaccaacgagacgctcctcggcaaggcgctgaagcagctgccgagggagcaggtgcaggtggccaccaagttcgggatccaggagtacgcgtacgacgagggcaggggcgccgtgtgcggccggccggagtacgtgcgcgcctgctgcgaggccagcctgcgccgcctcggagtcgactacatcgacctctactaccagcaccggatcgacaccaccacccccatcgaggacacgatcggtgagctcaaaaaactggtggaggaagggaaggtcaggtacatcgggctgtcggaggcgagccccgacaccatccggcgtgctcacgccgtgcatccggtctccgccgtgcagatggagtggtccctgtgggctcgcgacatcgagcccgagattgtgccgctctgcagagaattggggattggaattgttccttacagcccgatcggccgtgggttcttcggcggaagaggagtcacggagcaagtgtctgctgaatccaatctgaaaaggcacccacggttttcggcagaaaatctggagaagaacaagcatctctatctgaaaatggaagagctagctaagaagcaccagtgcagccctgctcagctagctttagcttgggtcctgcatcaaggggatgatgttgttcccataccaggaacaaccaggatcaagaacctggactccaacattgactccttaaagataaagctcacagaagatgacctggaagaaattagcagccagatacgtgaagaagatgtagccggtggaaggagttatacttccttggcccataccaactggaaccatgcagacacaccaaagaagtaaaactatgaaaaaaacggtgacatgcgagccatgccatgctatctgctgttgtactgaatggcgctgcctgtaccttgtaattttccgtgctaaataatggaaacaattccctt

SEQ ID NO: 938 - DNA, 1344 bp, Panicum virgatum
gctgtgctgtgcagccgccgccgcctactcctccagacgactcctccagttcccccggtggtcatggcggatcaagcccctctcgttccccgcgtcaagctcggctcccagggattggaggtgtccaagctggggttcggctgcatggggctgacgggcgcctacaactccccgctggacgacgaggccggcatcgccgtcatcacgcacgccttccgccgcggggtcaccttcttcgacacctccgacgtctacgggccacgcaccaacgaaatcctcctcggcaaggcgctgaagcagctgcccagggatcaggtgcaggtagccaccaagttcgggatacagcgggacgggagcggcgtggccaccgtgtgcgggaagcccgaatacgtgcgcgcctgctgcgatgccagcctgcgccgcctcggcatcgactgcatcgacctctactaccagcaccgcgtcgacaccaccatccccattgaggacacgattggtgagctcaaaaaactggtcgagcaggggaaggtcaagtacatcgggttgtcagaggcaagccccgacacgattaggcgtgcacacgccgtgcatccgatcacagctgtgcagatggagtggtctctctggtctcgtgacatcgagcccgagattgtgccgctgtgcagagaattgggcattggaattgttccttatagtccgattggtcgtggttttttcggtggaagaggagtgacagagcaagtggctgctgaatctaatctgcatgggcatccaaggtttgcggcagaaaatttggagaagaacaagcaaatttatctgaaaatggaagaactggccaataagcaccagtgcagccctgctcagctagctttggcatgggttctgcatcaaggggatgatgtcgttcctataccaggaacaaccaaaatcaagaatctagatgccaacattgatgccttgaaggtgaagctgacagatgaggacttgaaagaaattggcatccagatccgcgaagaagatgttgctggtggaagacaatacacttcctttgcacataccacctggaagtacgcagatacaccaaagaaacagagctaaataaagaacttagcagcggtcatagtatgcgatttcctgcaaatgtgctcagtattatggctgatatgtctttgggattgctgtgtgctagataatatacgacagaagaagaataaagcgtcctgctatccgaaatatgagcaaacacttgattttgtgtatgtttatactagacaagactgatattgtcgcatggaatgtctgaacctataataaagttacagtatgtgtgcaagctgaaccagt

SEQ ID NO: 939 - DNA, 1297 bp, Avena sativa
tccagtagtgctgctgctggttcaatcaatccagttcccagtgagtcatcagtcttggaggccgaggccatggagcagtccctagagattcctcgggtccgtctgggcacccagggcctggaggtgtcgaagctgggtttcgggtgcatgggcctgacgggcacctacaactcgccgctggacgacgacgccggcatctccatcctcgtgcacgccttccgccgcggggtcaccttcttcgacacctccgacgtctacggtccccacaccaacgagacactcgtcggcaaggcgctgaagcagctgccgcgggagcaggtgcaggtggccaccaagttcggcatacggcctgccaccgacggcaagagcggcgtgtgcggccagccggagtacgtgcgcgcctcctgcgaggccagcctgcgccgccttgacgtcgactacatcgacctctactaccagcaccgcatcgacaccaccatccccatcgaggacacgattggtgagctgaagaagctggtggaggaagggaaggtgaggtacatcgggttgtcggaggccagcccagacaccatcaggcgtgctcacgctgtgcatcccatctccgcggtgcagatggagtggtcactgtgggcacgcgacatcgagcccgagattgtgccgctctgcagagaattagggattggaattgttccttacagcccgattggccgcgggtttttcggcggaagaggagtaacggagcaactgtctgctcaatcaagcctgaaagggcatccaaggttcttggctgaaaatcttgagaagaacaagcatctgtatctgaaaattgaacagctagccaagaagcaccagtgcacccctgctcagctagctttagcttgggtcttgcatcaaggggatgatacggttccgatacctgggacaactaagatcaagaacctagatgccaacattgactccttaaaggtgaagctcacgaacgacgacctcaaagagattagcaaccagatacgtgaagaagatgtggccggtggaaggccatataattcccttgcgcacaccacctggaagaatgcaaacacaccaaagctgtgaagctacaagcgacagtggtctgtttgacgaaacaatcgcgccatcctccttgctgatgtgctaaatggggccgactgtatgtcgtgaattaccctatgtcctgaataatgtactagtaagaaaataaaaattgcatccttgttgtagcggcagccatatgctaggttcatgcacgattttaataaaaagaatattatctttc

SEQ ID NO: 940 - DNA, 1297 bp, Avena sativa
tccagtagtgctgctgctggttcaatcaatccagttcccagtgagtcatcagtcttggaggccgaggccatggagcagtccctagagattcctcgggtccgtctgggcacccagggcctggaggtgtcgaagctgggtttcgggtgcatgggcctgacgggcacctacaactcgccgctggacgacgacgccggcatctccatcctcgtgcacgccttccgccgcggggtcaccttcttcgacacctccgacgtctacggtccccacaccaacgagacactcgtcggcaaggcgctgaagcagctgccgcgggagcaggtgcaggtggccaccaagttcggcatacggcctgccaccgacggcaagagcggcgtgtgcggccagccggagtacgtgcgcgcctcctgcgaggccagcctgcgccgccttgacgtcgactacatcgacctctactaccagcaccgcatcgacaccaccatccccatcgaggacacgattggtgagctgaagaagctggtggaggaagggaaggtgaggtacatcgggttgtcggaggccagcccagacaccatcaggcgtgctcacgctgtgcatcccatctccgcggtgcagatggagtggtcactgtgggcacgcgacatcgagcccgagattgtgccgctctgcagagaattagggattggaattgttccttacagcccgattggccgcgggtttttcggcggaagaggagtaacggagcaactgtctgctcaatcaagcctgaaagggcatccaaggttcttggctgaaaatcttgagaagaacaagcatctgtatctgaaaattgaacagctagccaagaagcaccagtgcacccctgctcagctagctttagcttgggtcttgcatcaaggggatgatacggttccgatacctgggacaactaagatcaagaacctagatgccaacattgactccttaaaggtgaagctcacgaacgacgacctcaaagagattagcaaccagatacgtgaagaagatgtggccggtggaaggccatataattcccttgcgcacaccacctggaagaatgcaaacacaccaaagctgtgaagctacaagcgacggtggtctgtttgacgaaacaatcgcgccatcctccttgctgatgtgctaaatggggccgactgtatgtcgtgaattaccctatgtcctgaataatgtactagtaagaaaataaaaattgcatccttgttgtagcggcagccatatgctaggttcatgcacgattttaataaaaagaatattatctttc

SEQ ID NO: 941 - DNA, 1483 bp, Sorghum bicolor
ggaaccaaacttcattccaccgttcctcttcctcgttcagttcaccggcgagcagcggccatggctaaccaagcccctccggttccccgcgtcaagcttggcacccagggattcgaggtgtccaagctggggttcggctgcatggggctgacgggcgcgtacaactccccgctggacgacgaggccggcatcgccgtcatcacgcacgctttcagccgcgggatcaccttcttcgacacctccaatgtatacggccccctcaccaacgaaatcctcctcggcaaggcgctgaagcagctgccgcgggagcaggtgcaggtggccaccaagttcgggatactgcgtgacgagagcggcaaccggaccgtgtgcggacggccggagtacgttcgcgcctgctgcgaggccagcctgcgccgcctcgacatcgactgcatcgacctctactaccagcaccgcattgacaccacaattcccatcgaggagacgattggcgagctcaagaagttggtggaggaggggaaggtcaagtacatcggattgtcagaggcgagcccggacaccattaggcgtgcacacgctgtgcacccgatcaccgccgtgcagatggagtggtctctctggtctcgcgacattgagcctgaaattgtgccgctgtgcagagaattgggcattggaattgtaccatacagtcctcttggccgtgggtttttcggtggaagaggagtgaaagaacaagtgtccgctgaatctgttctgcatgggatcccaaggtttgctcctgaaaatttggagaagaacaagcaaatttatctgcgaatggaagaactggccaataagcaccagtgcagccctactcagctagctttagcatgggttctgcatcaaggaaatgatgtggttcctataccagggacaaccaaaatcaagaatctagattccaacattgactccttgaaggtgaaactgacagacgaagatctgaaagaaatgggcagccagatacgtgaagaagatgtggctggtgggagacaattcgcttcctttgaacatgccacctggaagtatgctgatacacccaagaagcagagctaaaaaatacgtcaaagcatcaatgctgatgcgattggcgtggcactctccctgcagatttcctcaggaacattgtcgatgtgtctttgttaatacctgttctaagtaatgtacagagaagaacaatgaagggcccagtgttgatggaagtacgagcaggaatttgattttgggtgtacttatgtgaagctaagactaatgagtgtagagtttgctcatggttatatgttgtcgcatgaattgtggttgtgtgaacctaccatatagttcgcaaaaaaaaaacagtgatgtgtgctagctcaatcagcatgtaggcaggaaacacatgccaccatctgttcgcttttaatccgcatttgggcctgagaacgagaaacaagcaaaaccaaaa

SEQ ID NO: 942 - DNA, 1538 bp, Sorghum bicolor
attctatagtaataatctaaattaggtgcctataaaatctcgcagaagtggctgctatgtttcctggaaccaaacttcattccaccgttcctcttcctcgttcagttcaccggcgagcagcggccatggctaaccaagcccctccggttccccgcgtcaagcttggcacccagggattcgaggtgtccaagctggggttcggctgcatggggctgacgggcgcgtacaactccccgctggacgacgaggccggcatcgccgtcatcacgcacgctttcagccgcgggatcaccttcttcgacacctccaatgtatacggccccctcaccaacgaaatcctcctcggcaaggcgctgaagcagctgccgcgggagcaggtgcaggtggccaccaagttcgggatactgcgtgacgagagcggcaaccggaccgtgtgcggacggccggagtacgttcgcgcctgctgcgaggccagcctgcgccgcctcgacatcgactgcatcgacctctactaccagcaccgcattgacaccacaattcccatcgaggagacgattggcgagctcaagaagttggtggaggaggggaaggtcaagtacatcggattgtcagaggcgagcccggacaccattaggcgtgcacacgctgtgcacccgatcaccgccgtgcagatggagtggtctctctggtctcgcgacattgagcctgaaattgtgccgctgtgcagagaattgggcattggaattgtaccatacagtcctcttggccgtgggtttttcggtggaagaggagtgaaagaacaagtgtccgctgaatctgttctgcatgggatcccaaggtttgctcctgaaaatttggagaagaacaagcaaatttatctgcgaatggaagaactggccaataagcaccagtgcagccctactcagctagctttagcatgggttctgcatcaaggaaatgatgtggttcctataccagggacaaccaaaatcaagaatctagattccaacattgactccttgaaggtgaaactgacagacgaagatctgaaagaaatgggcagccagatacgtgaagaagatgtggctggtgggagacaattcgcttcctttgaacatgccacctggaagtatgctgatacacccaagaagcagagctaaaaaatacgtcaaagcatcaatgctgatgcgattggcgtggcactctccctgcagatttcctcaggaacattgtcgatgtgtctttgttaatacctgttctaagtaatgtacagagaagaacaatgaagggcccagtgttgatggaagtacgagcaggaatttgattttgggtgtacttatgtgaagctaagactaatgagtgtagagtttgctcatggttatatgttgtcgcatgaattgtggttgtgtgaacctaccatatagttcgcaaaaaaaaaacagtgatgtgtgctagctcaatcagcatgtaggcaggaaacacatgccaccatctgttcgcttttaatccgcatttgggcctgagaacgagaaacaagc

SEQ ID NO: 943 - DNA, 1463 bp, Setaria italica
ataggatcggaggcagccggggcatccggagttgccgaataaaaattagccagccagcaagccctgtcagctggctacactgctgagtgttcgcttccggccacggctgcctccgatcctatcctctgcaaatctccgaccgcaaccgcgcgcgccgccatggaggaggccgccccgccgcaggtgccccgcgtgaagctcggcgcccaggggctggaggtgtcgaagctggggttcgggtgcatggggctcacgggctcctacaacgcgccgctcggggacgaggccgtcgccgccgtcgtcgagcacgccttccgccgcggggtcaccttcttcgacacctccgacgcctacgggccccacaccaacgagaccctcctcgggagggcgctgcagcggctgccgcgggggcaggtgcaggtggctaccaagttcggcgtcgggcagggcggcgcgggcggcggcttgaccatctgcggcacgccggagtacgcgcgcgcctgctgcgaggccagcctgcgccgcctcggcgtcggctacatcgacctctactaccagcaccgcatcgacaccaccgtccccatcgaggacacgattggtgagctcaagaagctggtggaggaggggaaggtcaagtacatcgggttgtcggaggcgagcccggacacgatccggcgcgcgcacgccgtgcatcccatcaccgcggtgcagatggagtggtcgctctggtcccgcgacatcgagcccgagatcgtgccgctctgcagggagttggggattggaattgttccttacagtccaattggccggggattctttggcggaaggggagtgacacaacaagtgtcctctgaatctagtctgcaaaggcatccaaggtttacagcagataatttggagaagaacaagcaactttatctgaaaatggaagacctggccaagaagcaccagtgcagcccagctcagctagctctagcttgggttctgcatcaaggggatgatgtggttcctataccagggacaaccaaaatcaagaacctagatgccaacattgactccctgaaggtgaagctaacagaggaggatatgaaagaaatcaccagccagatacgcgcagacgatgtggctggtggaaggcaatacaattcctatgcacataccgcatggaagtatgcagacacaccaaagaagtaaagctctggattctggaaacgttccagccgcaacaagcctatgcatgcaacaattgaactgttctccctgcatatgtgctaaaatcttttcgcctacgccgatgtttcttgtgaatacatcgtggcaaataatttggacgggcaagaataacttataagtgctatttatcgttgattacgagcagaagagaagactcccgagtgtggagctagctccattttctcctgtatagtcgcagcgattttcagaactctgcacctctcctgttg

SEQ ID NO: 944 - DNA, 1429 bp, Zea mays
agccctccaatctctagcagaaacgtcttgcccgacacgactactcgtccgactagaaccaaacttttcaatccatcgttcgcagttcagttcacacttcacaggcgagcagcgaccatggatacccaagcacgtccggttcctccccgcgtcaagctcggcatccagggattcgaggtgtccaagctggggttcgggtgcatggggctgacgggcgcgtacaactccccgctggacgacgaggccggcatcgccgtcatcgcgcacgctttcagccgcggagtcaccttgttcgacacctccgacgtatacgggcccctcaccaacgaaatcctcctcggcaaggcgctgaagcagctgccgcgggagcaggtgcaggtggccaccaagttcgggatacggcatgacgagagcggcacgcggaccgtgtgcggccggccggagtacgttcgcgcctgctgcgaggccagcctgcgccgcctcggcatcgactgcatcgacctctactaccagcaccgcattgacaccacaactcccatcgaggagacgattggcgagctcaagaagctggtggaggagggtaaggtcaagtacatcggattgtcagaggcgagcccggacaccatcaggcgtgcacatgctgtgcacccgatcaccgcggtgcagatggagtggtctctctggtctcgcgacattgagcccgaaattgtgccgctctgcagagaattgggcattggaattgtaccatacagtcctcttggccgtgggttttttggtggaagaggagtgaaagaacaagtgtctgctgaatctaatctgcatgggatcccaaggtttgctccagaaaatttggagaagaacaagcaaatttatttgcgaatggaagaactggccaataagcaccagtgcagccctgctcagctagctttagcatgggttctgcatcaaggagatgatgtggttcctataccagggacaaccaaaatcaagaatctagattccaacattgactccttgaaggtgaaactgacagacgaagatctgaaagaaatgggcagccagatacgggaagaagatgtggctggtggaagacaattcacttcatttgcacataccacctggaagtacgctgatacgccaaagaagcagagctaaaaaatacttgaaagcaacaatgatgatgcgattggtatggccctctccctgcagatgccctcaggaacattgccgatgcccctttgtgaacagcctcttctagtaaataataatgtatggagaagaacaatgaagggcccagtcttgttggaagtacgaataatgtacagttacaggaatgtgtgctaccatatatttcgtcgcatcagtttgagttgtggttgtgtgaacctaccatatatttcctcgcaaaagaataatgtatagttacaat

SEQ ID NO: 945 - DNA, 1443 bp, Setaria italica
gggcatccggagttgccgaataaaaattagccagccagcaagccctgtcagctggctacactgctgagtgttcgcttccggccacggctgcctccgatcctatcctctgcaaatctccgaccgcaaccgcgcgcgccgccatggaggaggccgccccgccgcaggtgccccgcgtgaagctcggcgcccaggggctggaggtgtcgaagctggggttcgggtgcatggggctcacgggctcctacaacgcgccgctcggggacgaggccgtcgccgccgtcgtcgagcacgccttccgccgcggggtcaccttcttcgacacctccgacgcctacgggccccacaccaacgagaccctcctcgggagggcgctgcagcggctgccgcgggggcaggtgcaggtggctaccaagttcggcgtcgggcagggcggcgcgggcggcggcttgaccatctgcggcacgccggagtacgcgcgcgcctgctgcgaggccagcctgcgccgcctcggcgtcggctacatcgacctctactaccagcaccgcatcgacaccaccgtccccatcgaggacacgattggtgagctcaagaagctggtggaggaggggaaggtcaagtacatcgggttgtcggaggcgagcccggacacgatccggcgcgcgcacgccgtgcatcccatcaccgcggtgcagatggagtggtcgctctggtcccgcgacatcgagcccgagatcgtgccgctctgcagggagttggggattggaattgttccttacagtccaattggccggggattctttggcggaaggggagtgacacaacaagtgtcctctgaatctagtctgcaaaggcatccaaggtttacagcagataatttggagaagaacaagcagatttatctgaaaatggaagacctggccaagaagcaccagtgcagcccagctcagctagctctagcttgggttctgcatcaaggggatgatgtggttcctataccagggacaaccaaaatcaagaacctagatgccaacattgactccctgaaggtgaagctaacagaggaggatatgaaagaaatcaccagccagatacgcgcagacgatgtggctggtggaaggcaatacaattcctatgcacataccgcctggaagtatgcagacacaccaaagaagtaaagctctggattctggaaacgttccagccgcaacaagcctatgcatgcaacaattgaactgttctccctgaatatgtgctaaaatcttttcgcctacgccgatgtttcttgtatggcacatcgtggcaaataatttggacgggcaagaataacttataagtgctatttatcgttgattacgagcagaagagaagactcccgagtgtggagctagctccattttctcctgtatagtcgcagcgattttcagaactctgaacctaacaaca

SEQ ID NO: 946 - DNA, 1372 bp, Setaria italica
ggctacactgccgagtgttcgcttccggccacggcttcctccgatcctatcctctgcaaatctccgaccgcaaccgcgcgcgccgccatggaggaggccgccccgccgcaggcgccccgcgtgaagctcggcgcccaggggctggacgtgtcgaagctggggttcgggtgcatggggctcacgggctcctacaacgcgccgctcggggacgaggccgtcgccgccgccgtcgagcacgccttccgccgcggggtcaccttcttcgacacctccgacgcctacgggccccacaccaacgagactctcctcgggagggcgctgcagcggctgccgcgggggcaggtgcaggtggccaccaagttcggcgtcgggcagggcggcgcgggcggcggcttgaccgtctgcggcacgccggagtacgcgcgcgcctgctgcgaggccagcctgcgccgcctcggcgtcagctacatcgacctctactaccagcaccgcatcgacaccaccgtccccatcgaggacacgattggtgagctcaagaagctggtggaggaggggaaggtcaagtacatcgggttgtcggaggcgagcccggacacgatccggcgcgcgcacgccgtgcatcccatcaccgcggtgcagatggagtggtcgctctggtcccgcgacatcgagcccgagatcgtgccgctctgcagggagttggggattggaattgttccttacagtccaattggccggggattctttggcggaaggggagtgacacaacaagtgtcctctgaatctagtctgcaaagccatccaaggtttacagcagataatttggagaagaacaagcagatttatctgaaaatggaagacctggccaagaagcaccagtgcagcccagctcagctagctctagcttgggttctgcatcaaggggatgatgtggttcctataccagggacaaccaaaatcaagaacctagatgccaacattgactccctgaaggtgaagctaacagatgaggatatgaaagaaatcaccagccagatacgcgcagacgatgtggctggtggaaggcaatacaattcctatgcacataccgcatggaagtatgcagacacaccaaagaagtaaagctctggattctggaaacgttccagccgcaacaagcttatgcatgcaacaattgaactgttctccctgcatatatgctaaaatcttttcgcctacgccgatgtttcttgtgaatacatcgtggcaaataatttggacgggcaagaataacttaataagtgctatttatcggtgattatgagcagaagagaagactcccgagtgtggagctagctccattgctcctgtatagtcgcagcgattttcagaa

SEQ ID NO: 947 - DNA, 1328 bp, Sorghum bicolor
cggaaataggtgcgagctagtagttctacgactacaccactgcagtgcaccgttgtcgtcctgctgctctcccctacgctacgacgaaagctaggctatggaggaggagcaagcagcagccatccaggtggtggttccccgagtcaagctcggcgcccagggattagaggtgtccaagctgggtttcgggtgcttcggcctcaccggcgcttacggatcggcggcgctcgacgacgaggcggcggccgcagtcatcgcgcacgccttccgtcgcggggtcaccttcttcgacacctccgacatctacgggcctctcaccaacgagatcctgctcgggaagcagctcaagcagctgccgcgggagcaggtgcaggtggccaccaagttcgggcttgcgcgggacgacgccagcggcgcctggaccgtctgcggccggcccgagtacgtgcgcgcctgctgcgaggccagcctccgccgccttggcgtccactgcatcgacctctactacctgcaccgcgtcgacaccaccgtccccatcgaggacacgattggcgagctcaagaaactggtggaggaggggaaggtcaagtacatcggattgtcagaggcgagcccggacaccattaggcgtgcgcatgctgtgcacccgatcaccgcggtgcagatggagtggtcgctctggtctcgcgacatcgagcccgagattgtgccgctctgcagagaattggacattggaattgttccttacagcccgattggcaaagggtttttcggcggacgaggagtcacggaacaagtgtccgctgcatctaatctgcgaaggcacccaaggttttcagcagaaaatttggagaagaacaaacaaatttatctgaaaatggaagagctggccaacaaacaccggtgcagccctgctcagctagctctagcttgggttctgcatcaaggggacgatgtgattcctataccaggaacaaccaagatcaagaatcttgatgccaacattgactccttgaaggtgaagttaacggacgatgatctgaaagaaatcagcagcgagatacgcgaagaagatgttgctggtgcgagacagaacacttcttttgggcctactaattggaactatgcagatacaccaaggaaatagagttgctaaaataataaaatgttgtagcaacagatgagctattctccctgcaattctgttatattatggggacagtatcttgagaacactctgttccagataatgtacgacaatgcatgatgcctcgtctcatcaggaaatattagtaatagctagttgattttagattctattttggaca

SEQ ID NO: 948 - DNA, 1722 bp, Sorghum bicolor
aataggtgcgagctagtagttctacgactacaccactgcagtgcaccgttgtcgtcctgctgctctcccctacgctacgacgaaagctaggctatggaggaggagcaagcagcagccatccaggtggtggttccccgagtcaagctcggcgcccagggattagaggtgtccaagctgggtttcgggtgcttcggcctcaccggcgcttacggatcggcggcgctcgacgacgaggcggcggccgcagtcatcgcgcacgccttccgtcgcggggtcaccttcttcgacacctccgacatctacgggcctctcaccaacgagatcctgctcgggaagcagctcaagcagctgccgcgggagcaggtgcaggtggccaccaagttcgggcttgcgcgggacgacgccagcggcgcctggaccgtctgcggccggcccgagtacgtgcgcgcctgctgcgaggccagcctccgccgccttggcgtccactgcatcgacctctactacctgcaccgcgtcgacaccaccgtccccatcgaggacacgattggcgagctcaagaaactggtggaggaggggaaggtcaagtacatcggattgtcagaggcgagcccggacaccattaggcgtgcgcatgctgtgcacccgatcaccgcggtgcagatggagtggtcgctctggtctcgcgacatcgagcccgagattgtgccgctctgcagagaattggacattggaattgttccttacagcccgattggcaaagggtttttcggcggacgaggagtcacggaacaagtgtccgctgcatctaatctgcgaaggcacccaaggttttcagcagaaaatttggagaagaacaaacaaatttatctgaaaatggaagagctggccaacaaacaccggtgcagccctgctcagctagctctagcttgggttctgcatcaaggggacgatgtgattcctataccaggaacaaccaagatcaagaatcttgatgccaacattgactccttgaaggtgaagttaacggacgatgatctgaaagaaatcagcagcgagatacgcgaagaagatgttgctggtgcgagacagaacacttcttttgggcctactaattggaactatgcagatacaccaaggaaatagagttgctaaaataataaaatgttgtagcaacagatgagctattctccctgcaattctgttatattatggggacagtatcttgagaacactctgttccagataatgtacgacaatgcatgatgcctcgtctcatcaggaaatattagtaatagctagttgattttagattctattttggacatctgtcgcgatactgaaggtggcggcaagccacaatagagttggacgcggggctgctgggtcttttgtgcgtgccggagtgttgattctttcaggggtaaaagctgacaggtgatgaggatgtggctcgtgctgtgaacgggtcacggggtgaaaacgctgaaacaaacagctccattgttctagcaacagcaatgacttgtgcagtgcgacagttatgataaatcatttagataacatatgtttggaaatactatgttcaaaataatggatgacgaagaataatacattaaagtgaagatctgagtgtagagctcatggttctatggtcacagccaagattgaacctattgaatacatgtatgctgactctaatctcatttgaaagctgacactgac

SEQ ID NO: 949 - DNA, 1302 bp, Sorghum bicolor
gttcccttccacttccagttccagccttcactcagcacggcagccttcgatcccccgagactgcagccgcccgccgcccgcgccatggagccagccgccctaccgcaggttccccgcgtcaagctcggcacccaggggctggaggtgtcgaagctggggttcgggtgcatggggctcacgggctcctacaacgcgccgctcggcgacgaggccgtcgccgccgtcgtcgcgcacgccttccgccgcggggtcaccttcttcgacacctccgacgcctacgggccccacaccaacgagaccctcctggggaaggcgctcaagcagctgccgcgggagcaggtgcaggtggccaccaagttcgggatagggcagggcgccgccggcggcatgaccgtgtgcggcacgcccgagtacgtgcgcgcctgctgcgaggccagcctccgccgcctcgacgccggctacatcgacctctactaccagcaccgcgtcgacaccaccgtccccatcgaggacacgattggtgagctcaagaagctggtggaggaggggaaggtcaagtacatcggcttgtcggaggcgagcccggacacgatccgccgcgcgcacgcggtgcatcccatcaccgccgtgcagatggagtggtcgctctggtcccgtgacatcgagcccgagatcgtgccactctgcagagaattgggaattggaattgtgccttacagtccaatcggccgcggattttttgctggaagaggagtgacacaggaagtttcttctgtatctagtctgcaaaggcatccaagatttacagcagaaagcttggagaagaacaagcagatttacctgaaaatagaagacctggccaagaagtaccagtgcagcccagctcagctagctctagcttgggttctgcatcaaggggatgatgtggttcccataccagggacaacaaaaacaaagaacctagatgccaacgttgagtccttgaaggtgaagctcacagctgaggacctggaagaaattgccagccagatacgtgcagaagatgtggctggtggaagacaatacaattcctatgcacatacctcctggaagtatgcagatacaccaaagaagtgaagttctggaaaacatgtaccgataagaagcatatgcaaatgttgaactagttccctgcatttgagccggaatcggatgatgatgtaacttgtgaacatgcggcactaataactctagacgaagaataatgtgcttttccatcagtgattatgagcagacgatgattttatccgtgcttcttcagat

SEQ ID NO: 950 - DNA, 1653 bp, Sorghum bicolor
tcttttatgccctgtcagcaactacccactgcactgctgagccgagttcccttccacttccagttccagccttcactcagcacggcagccttcgatcccccgagactgcagccgcccgccgcccgcgccatggagccagccgccctaccgcaggttccccgcgtcaagctcggcacccaggggctggaggtgtcgaagctggggttcgggtgcatggggctcacgggctcctacaacgcgccgctcggcgacgaggccgtcgccgccgtcgtcgcgcacgccttccgccgcggggtcaccttcttcgacacctccgacgcctacgggccccacaccaacgagaccctcctggggaaggcgctcaagcagctgccgcgggagcaggtgcaggtggccaccaagttcgggatagggcagggcgccgccggcggcatgaccgtgtgcggcacgcccgagtacgtgcgcgcctgctgcgaggccagcctccgccgcctcgacgccggctacatcgacctctactaccagcaccgcgtcgacaccaccgtccccatcgaggacacgattggtgagctcaagaagctggtggaggaggggaaggtcaagtacatcggcttgtcggaggcgagcccggacacgatccgccgcgcgcacgcggtgcatcccatcaccgccgtgcagatggagtggtcgctctggtcccgtgacatcgagcccgagatcgtgccactctgcagagaattgggaattggaattgtgccttacagtccaatcggccgcggattttttgctggaagaggagtgacacaggaagtttcttctgtatctagtctgcaaaggcatccaagatttacagcagaaagcttggagaagaacaagcagatttacctgaaaatagaagacctggccaagaagtaccagtgcagcccagctcagctagctctagcttgggttctgcatcaaggggatgatgtggttcccataccagggacaacaaaaacaaagaacctagatgccaacgttgagtccttgaaggtgaagctcacagctgaggacctggaagaaattgccagccagatacgtgcagaagatgtggctggtggaagacaatacaattcctatgcacatacctcctggaagtatgcagatacaccaaagaagtgaagttctggaaaacatgtaccgataagaagcatatgcaaatgttgaactagttccctgcatttgagccggaatcgtacggatgatgatgcatcttgtgaacatgcggcactaataactctagacgaagaataatgtgcttttccatcagtgattatgagcagacgatgattttatccgtgcttcttcagatacaagagtccattgtagatctagctcattgctctgcatagtcagacaaaattttgaactccgaacctaccgacagcaggtactcgcttcgctcgtgctgcgaatgaagcatctttgctcactccaaactaatctgggatgtaggctgattcgtttgagcttatcagttgtatctgtcagccattcagtagtgtttttctctcacaacaaatcagtcaatagtacttcctgtcatgacttatcagccaaatgaacaatgaaacatttcacctctcaccaatgcggcagtttttgacttttcac

SEQ ID NO: 951 - DNA, 1766 bp, Panicum virgatum
cgactccctcttggggattagtcatcaatcactggggcttgtgattagtcgggctcaggcagtagcattcatgccggcctactctaccggcttttgctggtcgcaaacaacgaaccccaacaaaccatggtgtgtcacccctgtcacgtccagacgtgactgagctgcaactgcctccggcacgcacgaatcatgcttgcctcatcgtcccgggagctgcgcaataaattggcctgccctttctcgccatgtcagccgactacactgccgagtgctcgcttcccggcacggctgcctccgatcccctgcgagtctgcgacctccacctgcagccatggagcaagccgccccgccgccgcaggtcccccgcgccaagctcggcacccaggggctggaggtgtcgaagctggggttcgggtgcatggggctcacgggctcctacaacgccccgctcggcgacgaggccgtcgccgccgtcgtcgagcatgccttccgccgcggggtcaccttcttcgacacctccgacgcgtacgggccccacaccaacgagaccctcctgggcagggcgctggggcggctgccgcgggggcaggtgcaggtggccaccaagttcgggatcgggcagggcgcggccggcggcctgaccgtgtgcggcgagcctgagtacgtgcgcgcctgctgcgaggccagcctgcgccgcctcggcgtcagctacatcgacctctactaccagcaccgcgtcgacatcaccgtccccatcgaggacacgattggtgagctcaagaagctggtggaggaggggaaggtcaagtacatcgggctgtcggaggcgagcccggacacgatccggcgcgcgcacgccgtgcaccccatcaccgcggtgcagatggagtggtcgctctggtcccgcgacatcgagcccgagattgtgccgctctgcagggaattggggattggaattgttccttacagtccaattggccgcggattctttgccggaagaggagtgacacagcaagtgtcttctgaatctagtctgcaaaagcatccaaggtttgcagcagataatttggagaagaacaaacagatttacctgaaaatggaggacctggccaagaagcaccagtgcagcccagctcagctagctctagcatgggttctgcatcaaggagatgatgtggtccctataccagggacaaccaaaaccaagaacctagaggccaacattgactcgttgaaggtgaagctgacagatgaggacctgaaagaaatcaccagccagatacgtgcagacgatgtggctggtggaagacaatacaattcctacgcacataccgcctggaagtatgcagacacaccgaagaagtagagctctggaaaacattctagccacaacaagcctatgcatgcaacaattgaactgttctcccctgcatatgcgctaaaatcttttcattgatgccgatgtaccttgtgaatacatcgcggtaaataatttggacaaagattcgaagaataataactaaatgacttatgagttagggtcagggtccatccacttatgagttatcatactctcaagctatgtctccagaattgatctgttgatgcccatgtctccagataaacactgttttcgtttttgtaatcctgaattgatttgttggtgcttttagtcccagttgtagtgctttcctccggcatgtcatctagctgatgtataaaaactgaaggaagactttatttcgtacttcctcatgattagt

SEQ ID NO: 952 - DNA, 917 bp, Triticum aestivum
acacaacgttggctggagcggcggcagggcgaatctcctcagtaggagtatgagataaccccacgcttatcaccatccctttccccactctccagtctccacccttccgacgaaaccccgcccctctccctaagccaaagccctagccaaggccaagccaccgggctagcgagctagccagacctccctcccgtagatctctgctctccgggcgtgctcgcggcgccgatccggcgatgacgaccaaggcgaagctcggggagctaatgtgggagcaccggctgcgtgcggcggcggcggtggcgttcctcgccgtcgccgtggtgtcgatctccgccgtcgggcccaggctcggcgccgtggtctccttcttctggccgctgctcgtctccacgggcttcttcctcgtggccatcaccgtgctgctccggatctcgccgccgcccagcggcgcggaggagtccggcaaggagatcatcgacttcgtcgccgggtgccgccccgagcacctcctcccggaggcgtccgccaccgtggaggtgccgccggagccggagatctgaagagccgaggaggaggaggtgcgcgcggccgcgagatgaccttgttcgccggggctagctcaggagagacgtggggtaacctgtatgggcccgcctgggagccgggggcccggcgccgggcgcccccggtgtgcggcggtgcagccgtggctagcgtaggaatcctcccgtctccgtggtgtggtgtacaatagtaccattgaataaagatgtcataaattcgctctgtcagcgcgcataatttgagtaccaggtaccactggtgctccaatcttcttccgttttcaggtggagtcttcaactcttgatgctttgatttgatgccatgaaagcgagagatcagagctgaagacc

SEQ ID NO: 953 - DNA, 917 bp, Triticum aestivum
acacaacgttggctggaggcggcggcagggcgaatctcctcagtaggagtatgagataaccccacgcttatcaccatccctttccccactctccagtctccacccttccgacgaaaccccgcccctctccctaagccaaagccctagccaaggccaagccaccgggctagcgagctagccagacctccctcccgtagatctctgctctccgggcgtgctcgcggcgccgatccggcgatgacgaccaaggcgaagctcggggagctaatgtgggagcaccggctgcgtgcggcggcggcggtggcgttcctcgccgtcgccgtggtgtcgatctccgccgtcgggcccaggctcggcgccgtggtctccttcttctggccgctgctcgtctccacgggcttcttcctcgtggccatcaccgtgctgctccggatctcgccgccgcccagcggcgcggaggagtccggcaaggagatcatcgacttcgtcgccgggtgccgccccgagcacctcctcccggaggcgtccgccaccgtggaggtgccgccggagccggagatctgaagagccgaggaggaggaggtgcgcgcggccgcgagatgaccttgttcgccggggctagctcaggagagacgtggggtaacctgtatgggcccgcctgggagccgggggcccggcgccgggcgcccccggtgtgcggtggtgcagccgtggctagcgtaggatcctcccgtctccgtggtgtggtgtacaatagtaccattgaataaagatgtcataaattcgctctgtcagcgcgcataatttgagtaccaggtaccactggtgctccaatcttcttccgttttcaggtggagtcttcaactcttgatgctttgatttgatgccatgaaagcgagagatcagagctgaagacc

SEQ ID NO: 954 - DNA, 617 bp, Brachypodium distachyon
ctggctgctcgcgctgccgatctgccgatggcgtctaaggcgaagctcggcgagctaatgtgggagcacaggctgcgtgcggcggccgtggtggcgttcctcgcggccgctgtggtgtcgatctccgccgtcggccccaggctcagcgccgtggtctccttcttctggcctctgctcgtctccacggccttcttcctcgtggccatcaccgtgctgctccggatctcgcccccacccgccggcgccgacgaatccggcaaggatctgatcgacttcgtcgccgggtgccgcccggagcacctcgtcccgctcccggaggcgtccaccaccgtggaggtgccgccggagccagagatctagatgccggaggagagagcccaggagggagggagcacgacgccgggcggcagcgagatgacattgtgcgccgagggtgtggttcgggagggacatgggccgagggtaacctgtatgggcatccaggagttgcgggccgggcgccccggcgtacggtggtgcggccgtggttcggtagcgtaggatcctccgtgtccgtggcctggtgtacaataccatgtttcaataaagatgtcgcccgttcggcgcatacaattgta

SEQ ID NO: 955 - DNA, 827 bp, Brachypodium distachyon
atggttggtggatttgcttacgccattatgcgatcctctgacctggctgctcgcgctgccgatctgccgatggcgtctaaggcgaagctcggcgagctaatgtgggagcacaggctgcgtgcggcggccgtggtggcgttcctcgcggccgctgtggtgtcgatctccgccgtcggccccaggctcagcgccgtggtctccttcttctggcctctgctcgtctccacggccttcttcctcgtggccatcaccgtgctgctccggatctcgcccccacccgccggcgccgacgaatccggcaaggatctgatcgacttcgtcgccgggtgccgcccggagcacctcgtcccgctcccggaggcgtccaccaccgtggaggtgccgccggagccagagatctagatgccggaggagagagcccaggagggagggagcacgacgccgggcggcagcgagatgacattgtgcgccgagggtgtggttcgggagggacatgggccgagggtaacctgtatgggcatccaggagttgcgggccgggcgccccggcgtacggtggtgcggccgtggttcggtagcgtaggatcctccgtgtccgtggcctggtgtacaataccatgtttcaataaagatgtcgcccgttcggcgcatacaattgtattattagtgggtctgctttgttcatctcgtattttgttcctttttcaagtcgaggtctctgaactcgctctggatgccgcgagcccaatctagcttaattaaaaccaacttcctcttgtttacatctgctctttctgattgtaaccgcataccatgagcacattagag

SEQ ID NO: 956 - DNA, 1075 bp, Setaria italica
gaaaattactgttcgatgactgataaaccacctgaataaggtgaagcgaacaggtcctaaaattttaccccacatacaagccagtcacctatgccagtgcagccggcgggcattttggtaaatgaacccaaagagtacggcagagtccctccggccagagtccgcaccacccccggtgctgcaagaaaaaacatccccaaaagcacacaaccttggctggaggcggcggcagggcgaatctcctcagcctgagataaccccacgcttcccaccacccctttccccactcgccgtcctccctcgcttcccattttcctcccacagcgaatccaaccccatcccccctctctcccctgttacgccacgagccaaacccctagccacctcgctccagaatagctcccctcccctagatctcccattctctcccggctcccgcgctgccgatccggcgatggcgaccaagtcgaagctcggtgagctaatgtgggagcaccggctccaggccgcggccgcggtggcgttcgtggccgcggcggccgtctcgatctccgcggtcgggcccaggctcggcgccgtggtgtcattcttctggccgctcctcgtctccacggggttcctgctcgtggccatcaccgtgctgctccggatctcgccccctcccgcgggcgccgacgagtccggcaaggagctcatcgacttcgtcgccgggtgccgcccggagcacctcgtcccggaggcggcggccgcggcctccgtggaggcgccgccggagccggagatctaacggccggccggccggaggaggaggagccgacgaggaggctgtgacaccattcgagcttcgcggcgcgcggcgtgctccgtcgccggggtgactccacggtagcacggtgggggcaacctgtacgggcccacctgtaagtgccgcgtgggctgccccggccggctcgcgtgcggcgcgcggccgtggctcggtagcgtaggacttctccatgtctgatatctctccctctggtccggtgtaacataccgtggaattcaataatgaatcatggcataaaataaaaaccgc

SEQ ID NO: 957 - DNA, 577 bp, Setaria italica
ggcagggcgaatctcctcagcctgagataaccccacgcttcccaccacccctttccccactcgccgtcctccctcgcttcccattttcctcccacagcgaatccaaccccatcccccctctctcccctgttacgccacgagccaaacccctagccacctcgctccagaatagctcccctcccctagatctcccattctctcccggctcccgcgctgccgatccggcgatggcgaccaagtcgaagctcggtgagctaatgtgggagcaccggctccaggccgcggccgcggtggcgttcgtggccgcggcggccgtctcgatctccgcggtcgggcccaggctcggcgccgtggtgtcattcttctggccgctcctcgtctccacggggttcctgctcgtggccatcaccgtgctgctccggatctcgccccctcccgcgggcgccgacgagtccggcaaggagctcatcgacttcgtcgccgggtgccgcccggagcacctcgtcccggaggcggcggccgcggcctccgtggaggcgccgccggagccggagatctaacggccggccggccggag

SEQ ID NO: 958 - DNA, 1918 bp, Secale cereale
ggctcctccgtgtgtcgtcgtcggggtactcagcgcacgagagagggagggggagggggaggggcggacgggcgtacaagagagagagagagcggggggcgagggggcgagcggcagagggctgcagcaggggcagaagcattagaaggggcagttgtaaccaagtggcagcagtagatagagccatctatctatctccctctacagatcgcggctaggagatcagcgagcacgcccagatttccccctttccccggatcaatctcatccgagaggataataagccgtccgggagcagcaagcaagggaggaggaggaggaggagaagccatgatgctggagggcaaatcctgcctcgtctcgcgctccctgcccagctactgcgacccggagtccgactgggggttcctcctcagcggcagcaagcgccccgcgccggaggacttcggcgcggaagacatggaggaggtagacgccggcggcagcagcagcgggaagcgcagcaagtcgccttccccgcagccgcacacgccggacatcaccgagagccacggctccagccgccatgcctcctcaggcagcggcggaggggagcagcaaggctctggggccaatctcattggcgagattggtcgcgacctctccatcaactgcctcctccggctctccaggtcggactatggctccgtcgcctccctcaacagggacttcaactccctggtgcgcaatggggagatctaccgcctgcggcggcagaatggcatcgccgagcattgggtctacttctcctgcaatgtcctggagtgggacgcctatgacccctacagggagcgctggatccaggtgcccaagatgccaccggatgaatgcttcatgtgctccgacaaggagtccctggctgtgggcaccgagctgcttgtgtttgggatggcacacattgtgttcagatatagcatcctgaccaattcatggacaagggctgatcccatgaactctccccgttgcttgtttggatcaacaagcgtcggtgagaaggcgtatgtcgctggaggcaccgatgcttctggaaagattctgagctctgcagagatgtatgactctgttacacacacctggacaccccttcccagcatgaatagggctaggaagatgtgttctggtgtgttcttggatggcaagttctatgtgatcggtggtgttaccaacaacaaccaggtactgacatgtggtgaggaatatgacttgaatcgggggtcatggagggtcattgagaacatgtctgagggcctcaatggagtgaccggtgctcctccactcattgcagttgtcaacaatcagctctatgcagctgattacagtgagaaggatgtgaagaagtatgacaagctgaataataagtggatcgctcttgggaaattgcccgaacggtctgtgtcgatgaatggatggggccttgctttccgagcctgtggtgaccggctgattgtcattggaggcccaaggacttccattggtggcatcattgagcttaattcatgggttcccgatgagcaaccgcctgtgtggaatttggttgccacacggcaatccgggaacttcgtgtataactgcgccgtgatgggttgctgagtccactgaataaagattggatgcagtggatatttatgaaggatgatagtatgcacaaaggcagactgttcaattgctccagccctgattcttcgtagcgatttatgccttctgcccagttaactggacatctgctgagcggcagcactcatgtaacccttgagttctaatacttctgttttccttgctaatccatttctacatttgcaatttggatcaacagctcgtgatttcaaagatacgagactatgcaaaacagtgttatattaataatctagaaacaacttcc

SEQ ID NO: 959 - DNA, 2559 bp, Secale cereale
cagttgtaaccaagtggcagcagtagatagagccatctatctatctccctctacagatcgcggctaggagatcagcgagcacgcccagatttctccctttccccggatcaatctcatccgagaggataataagccgcccgggagcagcaagcaagggaggaggaggaggaggagaagccatgatgctggagggcaaatcctgcctcgtctcgcgctccctgcccagctactgcgacccggagtccgactgggggttcctcctcagcggcagcaagcgccccgcgccggaggacttcggcgcggaagacatggaggaggtagacgccggcggcagcagcagcgggaagcgcagcaagtcgccttccccgcagccgcacacgccggacatcaccgagagccacggctccagccgccatgcctcctcaggcagcagcggaggggagcagcaaggctctggggccaatctcattggcgagattggccgcgacctctccatcaactgcctcctccggctctccaggtccgactatggctctgtggcctccctcaacagggacttcaactccctggtgcgcaacggggagatctaccgcctgcggcggcagaatggcatcgccgagcattgggtctacttctcctgcaatgtcctggagtgggacgcctatgacccctacagggagcgctggatccaggtgcccaagatgccaccggatgaatgcttcatgtgctccgacaaggagtccctggctgtgggcaccgagctgcttgtgtttgggatggcacacattgtgttcagatatagcatcctgaccaattcatggacaagggctgatcccatgaactctccccgttgcttgtttggatcaacaagcgtcggtgagaaggcgtatgttgctggaggcaccgatgcttctggaaagattctgagctctgcagagatgtatgactctgttacacacacctggacaccccttcccagcatgaatagggctaggaagatgtgttctggtgtgttcttggatggcaagttctatgtgatcggtggtgttaccaacaacaaccaggtactgacatgtggtgaggaatatgacttgaatcgggggtcatggagggtcattgagaacatgtctgagggcctcaatggagtgactggtgctcccccactcattgcagttgtcaacaatcagctctatgcagctgattacagtgagaaggatgtgaagaagtatgacaagctgaataataagtggatcgctcttgggaaattgcccgaacggtctgtgtcgatgaatggatggggccttgctttccgagcctgtggtgaccggctgattgtcattggaggcccaaggacttccattggtggcatcattgagcttaattcatgggttcccgatgagcaaccgcctgtgtggaatttggttgccacacggcaatccgggaacttcgtgtataactgcgctgtgatgggttgctgagtccactgaataaagattggatgcagtggatatttatgaaggatgatagtatgcacaaaggcagactgttcaattgctccagccctgattcttcgtagcgatttatgccttctgcccagttaactggacatctgctgagcggcagcactcatgtaacccttgagttctaatacttctgttttccttgctaatccatttctacatttgcaatttggatcaacagctcgtgatttcaaagatacgagactatgcaaaacagtgttatattaataatctagaaacaacttccagaatgctcgccttccactgttgatgatgaacaacctgttaagcaatacttgctttatcctgggctgcaactagagcatgtttatcaattcaatgctatgcctcttattcatccagtttgcttcatgatatgcttttctgaattgtgttatcagcttgtgagttggtaatgatatgttgttttgctggtcctgaatttgtatgtgctattagatgctggtattgttctagttttagttgtgctggtttgcttgtgggtttgtttgactcagcgttttagttcatgtttccatgtactgatgttttagttagacaactgagccgagtttgagttgttctgtttctgatggagtgtcaaagcaggattagttttcaaaactagatcatttgactggccattttagtgacaagtttcctgggagttgtcgacccttctgcctgtagttgttgctagcctagaagtaagtcttttactggatcattgaattatccttgagagcgagagggcaagaaactctctagctgattgattctgcgtgttctgttctagctatttcagtaaattgatgccatcctctattagcaatgttgcagtaagggaacatatatttctttagtaatgttaaaggaagtgatgcatttgcaactgctgtttattaaaatttttttgagtgagctatctctgtctgaccgaccattttttgaaccatatttgtgatccataggccacacattcttcttctgtttgggcatttagatttgcatacatgcttcttcccgtgtggtagcagtc

SEQ ID NO: 960 - DNA, 2864 bp, Triticum aestivum
ggggctgcagcaggggcagaagcattagaaggggcagttgtaaccaagtggcagcagtagatagagccatctatctatctctctctacagatcgcggctaggagatcagcgagcgcgcccagatttctccctttccggatcagtctcatccgagaagataataagccgagcgggagggggagaggccatgatgctggagggcaaatcctgcctcgtctcgcgctccctgcccagctactgcgacccggactccgactgggcgttcctcctcagcggcagcaagcgccccgcgccggaagacttcggcgcggaagacatggaggaggtagacgccggcggcggcagcgggaagcgcagcaagtcgccttccccgcagccgcacacgccggacatcaccgagagccacggctccagccgccatgcctcctcaggcagcagcggcggtggggagcagcaaggctctggggccaatctcattggcgagattggccgcgacctctccatcaactgcctcctccggctctccaggtcggactatggctccgtcgcctccctcaacagggacttcaactccctggtgcgcaacggggagatctaccgcctgcggcggcagaatggtatcgccgagcattgggtctacttctcctgcaatgtcctggagtgggatgcctatgacccctacagggagcgctggatccaggtgcccaagatgccaccggatgaatgcttcatgtgctctgacaaggagtccctggctgtgggcaccgagctgcttgtgtttgggatggcacacattgtgttcagatatagcatcctgaccaattcatggacaagggctgatcccatgaactctccccggtgcttgtttggatcaacaagcgtcggtgaaaaggcgtatgtcgctggaggcaccgatgcttctggaaagatactgagctctgcagagatgtatgactctgtgacacacacttggacaccccttcccagcatgaatagggctaggaagatgtgttctggtgtgttcttggatggcaagttctatgtgatcggtggtgttaccaacaacaaccaggtactgacatgtggtgaggaatatgacttgaatcggggttcgtggagggtcattgagaacatgtctgagggcctcaatggagtgacgggtgctcctccactcattgcagttgtcaacaatcagctctatgcagctgattacagtgagaaggatgtgaagaagtatgacaagctgaataataagtggatcgctcttgggaaattgcctgaacggtctgtgtccatgaatggatggggccttgctttccgagcctgtggtgaccggctgattgtcattggaggcccaaggacttctattggtggcatcattgagcttaattcatgggttcccgatgagcaaccgcctgtgtggaatttggttgccacacggcaatccgggaacttcgtgtataactgcgccgtgatgggttgctgagtccactgaataaaagattggatgcagtggatatttatgaaggatgatagtatgcacaaaggcagcctgttcaattgctccagccctgattcttcgtagggatttatgccttctgcccagttaactggacatctgctgagcggcagcactcatgtaacccttgagttctaatacttctgttttcctcgctaatccatttctacatttgcaatttggatcaacagctcgtgatttcaaagatacgagactatgcaaaaacagtgttatattaataatctagaaacaacttccagaatgctcgcctttcactgttgatgatgaacaacctgttaagcagtacttgctttatctttggctgcaactagagcatgtttatcaattcactgctatgtttcttattcatccagcttgcttcatgatatgcttttctgaattgtgttatcagcttgtaagttggtaatgatatgttgttttgctggtcgtgaatttgtatgtgctagggatgctggtattgttctagttttagttgtgatggtttgcttgactcaggtgttttagttcatgtttccatgtactgatgttttagttagtcaactgaatcgagtttgagatgttctgtttctgatggattgtcaaagcaggtgtagttttcaaaactagatcattttattggctattttggtgacaagtttcctggaagttgtcacccttctacctgtagttgttgctagcctagaagtaagtctcctcatggttttactggataattgaatcatccccgagagcgagagggcaaaaggctctctagctgagcgtgttctgttatagctgtttcagcgaattgatgtcatcctttattagcaatgttgcaataagggaacatatactatatcattagtaaggttaataggaagtgatgcatttgcaactgctgtttattgtagtctttttgagtgacttatctgaccatttgttcgaaccgtatttgtgatccatagggcatccacattcttctgttttgggcacttagatttgcatacatgcttcttactgtgtggtagcatccatcctacattgcccctggatttctggaatgagagccgaattggtggcgcgctgagtgcagatggcggagcttgctatatgaaaggagcatgtgtaatctgtcgatgtcgacccttgcagacatatatatgtggtaaaaagaaaccttgtagttcctgccatttggagcaagaagcgggttgtgagccgatcagagcactgctgcactcttttatgtgtcatcttgcataatgtggcaaccctttgttcttcttacatgagtgagaaatactccctctgtcctataacgtgtacgttttttgacactacacta

SEQ ID NO: 961 - DNA, 2246 bp, Triticum aestivum
cgagaggcgaatcccaattccccaagtagtacgcacgcacgagagggggcgagggaggagggcagcgcgcacacaccagggcaggggaggggaggggaggaggactacaagagaggagagagaggcggggggcgaggggcagcggcagagggctgcagcaggggcagaagcattagaaggggcagttgtaaccaagtggcagcagtagatagagccatctatctatctctctctacagatcgcggctaggagatcagcgagcacgcccagatttctccctttccggatcagtctcatccgacaagataataagccgagcgggagggggagaagccatgatgctggagggcaaatcctgcctcgtctcgcgctccctgcccagctactgcgacccggactccgactgggcgttcctcctcagcggcagcaagcggcccgcgccggaagacttccgcgcggaagacatggaggaggtagacgccggcggcagcagcagcgggaagcgcagcaagtcgccttccccgcagccgcacacgccggacatcaccgagagccacggctccagccgccatgcctcctccggcagcggcggaggggagcagcaaggctctggggccaatctcattggcgagattggccgcgacctctccatcaactgcctcctccggctctccaggtcggactatggctccgtcgcctccctcaacagggacttcaactccctggtgcgcaacggggagatctaccgcctgcggcggcagaatggcatcgccgagcattgggtctacttctcctgcaatgtcctggagtgggacgcctatgacccctacagggagcgctggatccaggtgcccaagatgccaccggatgaatgcttcatgtgctctgacaaggagtccctggctgtgggcaccgagctgcttgtgtttgggatggcacacattgtgttcagatatagcatcctgaccaattcatggacaagggctgatcccatgaactctccccggtgcttgtttggatcaacaagcgtcggtgaaaaggcgtatgtcgctggaggcaccgatgcttctggaaagatactgagctctgcagagatgtatgattctgtgacacacacttggacaccccttcccagcatgaatagggctaggaagatgtgttctggtgtgttcttggatggcaagttctatgtgattggtggtgttaccaacaacaaccaggtactgacatgtggtgaggaatatgacttgaatcgggggtcatggagggtcattgagaacatgtctgagggcctcaatggagtgacaggtgctcctccactcattgcagttgtcaacaatcagctctatgcagctgattacagtgagaaggatgtgaagaagtatgacaagctgaataataagtggatcgctcttgggaaattgcctgaacggtctgtgtcgatgaatggctggggccttgctttccgagcctgtggtgaccggctgattgtcatcggaggcccaaggacttctattggtggcatcattgagcttaattcctgggttcccgatgagcaaccgcctgtgtggaatttggttgccacacggcaatccgggaacttcgtgtataactgcgccgtgatgggttgctgagtccactgaataaagattggatgcagtggatatttatgaaggatgatagtatgcacaaaggcagcctgttcaattgctccagccctgattcttcgtagggatttatgccttctgcccagttaactggacatctgctgagcggcagcactcatgtaacccttgagttctaatacttctgttttccttgctaatccatttctacatttgcaatttggatcaacagctcgtgatttcaaagatacgagactatgcaaaaacagtgttatattaataatctagaaacaacttccagaatgctcgcctttcactgttgatgatgaacaacctgttaagcagtacttgctttatctttggctgcaactagagcatgtttatcaattcactgccatgtctcttattcatccagtttgcttcatgatatgcttctctgaattgtgttatcagcttgtaagttggtaaagatatgttgttttgctggtcgtgaatttgtatgtgctattagatgctggtattgttctagttttagttgtgctggttcgcttgtgggtttgtttggcttggtgttttagatcatgtttccatgtactgatgtttgagttagtcaactgagtc

SEQ ID NO: 962 - DNA, 1899 bp, Triticum aestivum
gggaggggaggaggactacaagagaggagagagaggcggggggcgaggggcagcggcagagggctgcagcaggggcagaagcattagaaggggcagttgtaaccaagtggcagcagtagatagagccatctatctatctctctctacagatcgcggctaggagatcagcgagcacgcccagatttctccctttccggatcagtctcatccgagaggataataagccgtcgtccgggagcagcgagcaaagggagggggaggagaagccatgatgctggagggcaaatcctgcctcgtctcgcgctccctgcccagctactgcgacccggactccgactgggcgttcctcctcagcggcaccaagcgctccgcgccggaggacttcggcgcggaggacatggaggaggtagacgccggcggcagcagcgggaagcgcagcaagtcgccttccccgcagccgcacacgccggacatcaccgagagccacggctccagccgccatgcctcctcaggcagcggcggaggggaacagcaaggctctggggccaatctcattggcgagattggccgggacctctccatcaactgcctgctccggctctccaggtcggactatggctccgtcgcctccctcaacagggacttcaactccctggtgcgcaacggggagatctaccgcctgcggcggcagaatggcttcgccgagcattgggtctacttctcctgcaatgtcctggagtgggacgcctatgacccctacagggagcgctggatccaggtgcccaagatgccaccggatgaatgcttcatgtgctctgacaaggagtccctggccgtgggcaccgagctgcttgtgtttgggatggcacacattgtcttcagatacagcatcctgaccaattcatggacaagggctgatcccatgaactctccccggtgcttgtttggatcaacaagcgtcggtgaaaaggcgtatgtcgctggaggcaccgatgcttctggaaagatactgagctctgcagagatgtatgactctgtgacacacacttggacaccccttcccagcatgaatagggctaggaagatgtgttctggtgtgttcttggatggcaagttctatgtgatcggtggtgttaccaacaacaaccaggtactgacatgtggtgaggaatatgacttgaatcgggggtcgtggagggtcattgagaacatgtctgagggcctcaatggagtgaccggtgctcctccactcattgcagttgtcaacaatcagctctatgcagctgattacagtgagaaggatgtgaagaagtatgacaagctgaataataagtggatcgctcttgggaaattgcccgaacggtctgtgtcaatgaatggatggggccttgctttccgagcctgtggtgaccggctgattgtcattggaggcccaaggacttctattggtggcatcattgagcttaattcatgggttcccgatgagcaaccgcctgtgtggaatttggttgccacacggcaatccgggaacttcgtgtataactgcgccgtgatgggttgctgagtccactgaataaagattggatgcagtggatatttatgaaggatgatagtatgcacaaaggcagcccgttcaattgctccagccctgattcttcgtagcgatttatgccttctgcccagttaactggacatctgctgagcggcagcactcatgtaacccttgagttctaatacttctgttttccttgctaatccatttctacatttgcaatttggatcaacagctcgtgatttcaaagatacgagactatgcaaaaacagtgttatattaataatctagaaacaacttccagaatgctcgcctttcactgttgatgatgaacaacctgttaagca

SEQ ID NO: 963 - DNA, 2261 bp, Triticum aestivum
tcaatcttatccgagaggataataagccgtcgtccgggagcagcgagcaaagggagggggaggagaagccatgatgctggagggcaaatcctgcctcgtctcgcgctccctgcccagctactgcgacccggactccgactgggcgttcctcctcagcggcaccaagcgctccgcgccggaggacttcggcgcggaggacatggaggaggtagacgccggcggcagcagcgggaagcgcagcaagtcgccttccccgcagccgcacacgccggacatcaccgagagccacggctccagccgccatgcctcctcaggcagcggcggaggggaacagcaaggctctggggccaatctcattggcgagattggccgggacctctccatcaactgcctgctccggctctccaggtcggactatggctccgtcgcctccctcaacagggacttcaactccctggtgcgcaacggggagatctaccgcctgcggcggcagaatggcttcgccgagcattgggtctacttctcctgcaatgtcctggagtgggacgcctatgacccctacagggagcgctggatccaggtgcccaagatgccaccggatgaatgcttcatgtgctctgacaaggagtccctggccgtgggcaccgagctgcttgtgtttgggatggcacacattgtcttcagatacagcatcctgaccaattcatggacaagggctgatcccatgaactctccccggtgcttgtttggatcaacaagcgttggtgagaaggcgtatgtcgctggaggcaccgatgcttctggaaagatcctgagctctgcagagatgtatgactctgtgacacacacttggacaccccttcccagcatgaatagggctaggaagatgtgttctggtgtgttcttggatggcaagttctatgtgatcggtggtgttaccaacaacaaccaggtactgacatgtggtgaggaatatgacttgaatcgggggtcgtggagggtcattgagaacatgtctgagggcctcaatggagtgaccggtgctcctccactcattgcagttgtcaacaatcagctttatgcggctgattacagtgagaaggatgtgaagaagtatgacaagctgaataataagtggatcgctcttgggaaattgcccgaacggtctgtgtcaatgaatggatggggccttgctttccgagcctgtggtgaccggctgattgtcattggaggcccaaggacttctattggtggcatcattgagcttaattcatgggttcccgatgggcaaccgcctgtgtggaatttggttgccacacggcaatccgggaacttcgtgtataactgcgccgtgatgggttgctgagtccactgaataaagattggatgcagtggatatttatgaaggatgatagtatgcacaaaggcagcccgttcaattgctccagccctgattcttcgtagcgatttatgccttctgcccagttaactggacatctgctgagcggcagcactcatgtaacccttgagttctaatacttctgttttccttgctaatccatttctacatttgcaatttggatcaacagctcgtgatttcaaagatacgagactatgcaaaaacagtgttatattaataatctagaaacaacttccagaatgctcgcctttcactgttgatgatgaacaacctgttaagcagtacttgctttatctttggctgcaactagagcatgtttatcaattcactgctatgtttcttattcatccagcttgcttcatgatatgcttttctgaattgtgttatcagcttgtaggttggtaatgatatgttgttttgctggtcgtgaatttgtatgtgctagggatgctggtattgttctagttttagttgtgatggtttgcttgactcaggtgttttagttcatgtttccatgtactgatgttttagttagtcaactgaatcgagtttgagatgttctgtttctgatggattgtcaaagcaggtgtagttttcaaaactagatcattttattggctattttggtgacaagtttcctggaagttgtcacccttctacctgtagttgttgctagcctagaagtaagtctcctcatggttttactggataattgaatcatccccgagagcgagagggcaaaaggctctctagctgagcgtgttctgttatagctgtttcagcgaattgatgtcatcctttattagcaatgttgcaataaggaacatatactatatcatta

SEQ ID NO: 964 - DNA, 1901 bp, Avena sativa
atccccccatttttggatcgatctcagctaggaggagataataataacccgggagcagcggcagcagcaggcatgatgctggaaggccaatcctgcctcgtctcgcgctccctgccgggctgctgcgagccggagcccgactgggcgtacctcgcccacgaggtctccgtcctcggcggcaagcgcccggcgccggacgaagacttcgacctagaagacatggacggcggcggcggcagcagcagcgggaagcgcagcaagtcgccctccccgcagccgcacacgcccgacatcaccgagggccacggctccagccgccacgtctcctcgggtgctgctgctggagaccagcagggctccgggagcaatctcattggcgagattggccgtgacctctccatcaactgcctcctccacctctccaggtccgactatggctccgtcgcctccctcaaccgggacttcaactccctcgtgcgcaacggggagatctaccgcctcaggcggcagaatgggattgcggagcattgggtctacttctcctgcaatgtcctggagtgggacgcctacgacccttaccgccagcgctggatccaggtgcccaagatgccaccggatgaatgcttcatgtgctctgacaaggagtcgctagctgtgggcacacagctgctcgtgtttgggatggcacacattgtcttcagatatagcatcctcaccaattcatggaccagggctgatccgatgaactcaccgcggtgcttgtttggatcaacaagtgtaggtgagaaggcgtatgttgcaggaggcactgatgcctctgggaagatattgagctcagcagagatgtatgactctgaaacacatatttggacacctcttccccctatgcataaggagaggaagatgtgttctggggtgttcatggatggcaagttcttggtgattggtggagttacccataacaacaaggtattgacttgcggtgaggagtatgacctgaagcggcagtcctggagggtcatcgagaacatgtctgagggcctcaatggtgtcaccggtgctcctcccctcgttgcagttgtcaacaatgagctgtatgcagctgattacagtgagaaggatgtgaagaagtatgataagctcaacaataagtggatcactcttggcaaattgcccgagcggtctgtgtcgatgaatggctggggccttgctttccgagcatgtggcgaccggctgattgtcatcggaggtccaaggacctctatcggtggcatgattgagctcaattcatgggtcccggatcagcaaccgcctgtgtggaatttggttgccaggcggccgtccgggaacttcgtgtataactgcgccgtgatgggttgctgagtccactgaaataaaagattcaacgcagtggatatttatgaaggatgatagtatgcacaaagcgcagcctgttcaattgctccagcccctgattcttcgtagcgattctgcccagtttcagaccttaactggacatctgctgagcggcagcagtctcatgtaaccccccccttgagttctaatacttctgtttccctcgctaatccatttctacatttgcatttggatcaacagctcgtgatttcaaagatacgagactatgcaaaaacagtgttatattaataatctagaaacaacttccacaaggcttttcgctgttgttgaaacaacctgttaagaaacacttgattcatctctggcttcaacacgggcatgtttttctgtttacgaataaccatgtacctcatattcattggtacaaattattcttctttgtccaaatttgcctcctggtatgcatttcgccaattgtgttattagcttctgtctgagttggtaatgatgtactattatgctgt

SEQ ID NO: 965 - DNA, 1899 bp, Avena sativa
atccccccatttttggatcgatctcagctaggaggagataataataacccgggagcagcggcagcagcaggcatgatgctggaaggccaatcctgcctcgtctcgcgctccctgccgggctgctgcgagccggagcccgactgggcgtacctcgcccacgaggtctccgtcctcggcggcaagcgcccggcgccggacgaagacttcgacctagaagacatggacggcggcggcggcagcagcagcgggaagcgcagcaagtcgccctccccgcagccgcacacgcccgacatcaccgagggccacggctccagccgccacgtctcctcgggtgctgctgctggagaccagcagggctccgggagcaatctcattggcgagattggccgtgacctctccatcaactgcctcctccacctctccaggtccgactatggctccgtcgcctccctcaaccgggacttcaactccctcgtgcgcaacggggagatctaccgcctcaggcggcagaatgggattgcggagcattgggtctacttctcctgcaatgtcctggagtgggacgcctacgacccttaccgccagcgctggatccaggtgcccaagatgccaccggatgaatgcttcatgtgctctgacaaggagtcgctagctgtgggcacacagctgctcgtgtttgggatggcacacattgtcttcagatatagcatcctcaccaattcatggaccagggctgatccgatgaactcaccgcggtgcttgtttggatcaacaagtgtaggtgagaaggcgtatgttgcaggaggcactgatgcctctgggaagatattgagctcagcagagatgtatgactctgaaacacatatttggacacctcttccccctatgcataaggagaggaagatgtgttctggggtgttcatggatggcaagttcttggtgattggtggagttacccataacaacaaggtattgacttgcggtgaggagtatgacctgaagcggcagtcctggagggtcatcgagaacatgtctgagggcctcaatggtgtcaccggtgctcctcccctcgttgcagttgtcaacaatgagctgtatgcagctgattacagtgagaaggatgtgaagaagtatgataagctcaacaataagtggatcactcttggcaaattgcccgagcggtctgtgtcgatgaatggctggggccttgctttccgagcatgtggcgaccggctgattgtcatcggaggtccaaggacctctatcggtggcatgattgagctcaattcatgggtcccggatcagcaaccgcctgtgtggaatttggttgccaggcggccgtccgggaacttcgtgtataactgcgccgtgatgggttgctgagtccactgaaataaaagattcaacgcagtggatatttatgaaggatgatagtatgcacaaagcgcagcctgttcaattgctccagcccctgattcttcgtagcgattctgcccagtttcagaccttaactggacatctgctgagcggcagcagtctcatgtaaccccccttgagttctaatacttctgtttccctcgctaatccatttctacatttgcatttggatcaacagctcgtgatttcaaagatacgagactatgcaaaaacagtgttatattaataatctagaaacaacttcaagaaggcttttcgctgttgttgaaacaacctgttaagaaacacttgattcatctctggcttcaacacgggcatgtttttctgtttacgaataaccatgtacctcatattcattggtacaaattattcttctttgtccaaatttgcctcctggtatgcatttcgccaattgtgttattagcttctgtctgagttggtaatgatgtactattatgctgt

SEQ ID NO: 966 - DNA, 1935 bp, Oryza sativa
ctgcagatcacggcaaggagattagagagggagcgaaagatctttccttatttttttttgtatcaaaaatctcagaagagcaggaggaaagaggaataaatcgggagcgagggagaaggcatgatgctggaaggcaactcctgcctcatctcgcgctccctgccgagctcctgcgagccggagtcccagtgggcgtacctctcccacgaggtgctcaacggcaagcgcccggcgccggaggatgcggaagccgaggacatggacgaggttgacttcggcggcgggaagcgcagcaagccgccatcgccgcagccgcacacgccggacatatctgagggccatggctccagtcgccatgttgccgcctctggcggcggagaggagcatggcaacgggagcagcctcattggtgcgattggccgtgaccttaccatcaattgcctcctccggctgtcacggtcagactatggctcggtggcctccctgaacaaggacttccggtcgctcgtgcgcaacggggagatctaccgcctgcgtcgccagagtggggtggcagagcactgggtctacttctcctgtaacgtcctcgagtgggacgcttacgacccatatcgcgagcgctggatccaagtgcccaagatgccaccagatgaatgcttcatgtgttctgacaaggaatcacttgctgtgggcactgaacttcttgtgtttgcgatggcacacattgtgttcagatatagcattctaaccaattcatggacacgggctgatccgatgatctcaccacggtgcttgtttgggtcaacaagtgttggggcaaaggcatatgttgctgggggcactgattcttctggcaggatattgagctctgcagaaatgtacgactcggagacacattcttggacaccccttcccagcatgaatcgggcaaggaagatgtgctccggggtgttcatggatggcaagttctatgtggttggtggtgttgccagcaacaacaaggtgttgacatgcggtgaggaatatgacctgaagaggcgatcttggagggtgatcgaaaacatgtctgagggtctcaacggagtgactggtgctcctccacttattgctgttgttaacaatgagctttatgctgctgattatagtgaaaaggatgtgaagaagtatgacaagcaaaacaataaatggatcactcttggtaagttgcctgaacggtctgtgtcaatgaatgggtggggccttgctttccgagcatgtggtgatcggttgattgtcatcggcggcccaaggacttctattggtggtacgattgagcttaattcatggaccccggatgagcggccgcctgtgtggaatttgattgccaggcggccatctgggaacttcgtgtataattgtgctgtgatgggctgttgaatccactgaataaagattcaatatggtggattatttatgaaggatggtatgcacaaaggcagcctgttcaattgcttcagtcctgatgctccgtagcgatttctgccttctgtccagtttcagattcaactgggcatctgctgagtggcagcagtcatgtaaccccctgagttcttctaatacttctgttttcctcgctaatccatttcaacatttgcatttggatcaactgctcgtgatttgaaagatacgagactatgcaaaacagtgttatattaataatctaggaacagctttcagaaggcttttcactattgatgaacaacctgttaagcaatactcgattcatatgtggctgcaacaaagatattcatcaattatgaacaccatgccttatgtttgctggtataattttcttttatcaactttacttgcttcatgatgtgcttgtctttcatgaagttttttactagcaacaacgatatgtttcatcctagttgtgacttttgtttgtaaaaa

SEQ ID NO: 967 - DNA, 2854 bp, Oryza sativa
ggaggggaggcgatggatggagacgcatacgccgtgtctgtacagccagcggaggctgcacagaatccacctaagcttcaggtgagctggccctggccggtggccgcttgccttttctatttctgaggccctgcccggtttctaatttcaacgagccaaaacagacggagagcagcagcagcagagagaaggagaagaaaaaaaatggaggaataaaaagggcaagacagagagagagaaaaaaaaagaaaggcaagagaggagagaatcccaattccccaagtacacgagaggggagaggagagcagagcgcactacaagagaggagagagagagagagggtgtgaggaggagagaggggcagccagcagcaggggcagaagcattagaagcgggcagcagtagatagagccatctatctgtacagatcacggcaaggagattagagagggagcgaaagatctttccttatttttttttgtatcaaaaatctcagaagagcaggaggaaagaggaataaatcgggagcgagggagaaggcatgatgctggaaggcaactcctgcctcatctcgcgctccctgccgagctcctgcgagccggagtcccagtgggcgtacctctcccacgaggtgctcaacggcaagcgcccggcgccggaggatgcggaagccgaggacatggacgaggttgacttcggcggcgggaagcgcagcaagccgccatcgccgcagccgcacacgccggacatatctgagggccatggctccagtcgccatgttgccgcctctggcggcggagaggagcatggcaacgggagcagcctcattggtgcgattggccgtgaccttaccatcaattgcctcctccggctgtcacggtcagactatggctcggtggcctccctgaacaaggacttccggtcgctcgtgcgcaacggggagatctaccgcctgcgtcgccagagtggggtggcagagcactgggtctacttctcctgtaacgtcctcgagtgggacgcttacgacccatatcgcgagcgctggatccaagtgcccaagatgccaccagatgaatgcttcatgtgttctgacaaggaatcacttgctgtgggcactgaacttcttgtgtttgcgatggcacacattgtgttcagatatagcattctaaccaattcatggacacgggctgatccgatgatctcaccacggtgcttgtttgggtcaacaagtgttggggcaaaggcatatgttgctgggggcactgattcttctggcaggatattgagctctgcagaaatgtacgactcggagacacattcttggacaccccttcccagcatgaatcgggcaaggaagatgtgctccggggtgttcatggatggcaagttctatgtggttggtggtgttgccagcaacaacaaggtgttgacatgcggtgaggaatatgacctgaagaggcgatcttggagggtgatcgaaaacatgtctgagggtctcaacggagtgactggtgctcctccacttattgctgttgttaacaatgagctttatgctgctgattatagtgaaaaggatgtgaagaagtatgacaagcaaaacaataaatggatcactcttggtaagttgcctgaacggtctgtgtcaatgaatgggtggggccttgctttccgagcatgtggtgatcggttgattgtcatcggcggcccaaggacttctattggtggtacgattgagcttaattcatggaccccggatgagcggccgcctgtgtggaatttgattgccaggcggccatctgggaacttcgtgtataattgtgctgtgatgggctgttgaatccactgaataaagattcaatatggtggattatttatgaaggatggtatgcacaaaggcagcctgttcaattgcttcagtcctgatgctccgtagcgatttctgccttctgtccagtttcagattcaactgggcatctgctgagtggcagcagtcatgtaaccccctgagttcttctaatacttctgttttcctcgctaatccatttcaacatttgcatttggatcaactgctcgtgatttgaaagatacgagactatgcaaaacagtgttatattaataatctaggaacagctttcagaaggcttttcactattgatgaacaacctgttaagcaatactcgattcatatgtggctgcaacaaagatattcatcaattatgaacaccatgccttatgtttgctggtataattttcttttatcaactttacttgcttcatgatgtgcttgtctttcatgaagttttttactagcaacaacgatatgtttcatcctagttgtgacttttgtttgtataaacatgtctgggctgagagctgaccttgcttggtattgttttagtttagttgtttctcataagtttgtcgtatcactgatgatccgcagaaactctgacggattcatttcattgattcctttttagtaaaccactaatggaatatcattctctatcctgggttattactaagcttttattagtaatgccctatagtgaaaaaccacagtggtgtaccactgcccgttttatatcataatcttttgaaaggcttggggtcttttttacgtgactgcatgcaaacttattttgcatgggtaactctcagtaattctaaattctgtgataattaactaattggtaaaacttttttttaataatagcttcttccgttacttgtcaagtgacttgcatatatgtgctggtgcatgtggtgatcttcgcattagtagtaatagcagtgttgattgaagaactgtcaaatatcgcatgaattgaactggagtagggcactggaagac

SEQ ID NO: 968 - DNA, 2252 bp, Oryza sativa
aacgagccaaaacagacggagagcagcagcagcagagagaaggagaagaaaaaaaatggaggaataaaaagggcaagacagagagagagaaaaaaaaagaaaggcaagagaggagagaatcccaattccccaagtacacgagaggggagaggagagcagagcgcactacaagagaggagagagagagagagggtgtgaggaggagagaggggcagccagcagcaggggcagaagcattagaagcgggcagcagtagatagagccatctatctgtacagatcacggcaaggagattagagagggagcgaaagatctttccttatttttttttgtatcaaaaatctcagaagagcaggaggaaagaggaataaatcgggagcgagggagaaggcatgatgctggaaggcaactcctgcctcatctcgcgctccctgccgagctcctgcgagccggagtcccagtgggcgtacctctcccacgaggtgctcaacggcaagcgcccggcgccggaggatgcggaagccgaggacatggacgaggttgacttcggcggcgggaagcgcagcaagccgccatcgccgcagccgcacacgccggacatatctgagggccatggctccagtcgccatgttgccgcctctggcggcggagaggagcatggcaacgggagcagcctcattggtgcgattggccgtgaccttaccatcaattgcctcctccggctgtcacggtcagactatggctcggtggcctccctgaacaaggacttccggtcgctcgtgcgcaacggggagatctaccgcctgcgtcgccagagtggggtggcagagcactgggtctacttctcctgtaacgtcctcgagtgggacgcttacgacccatatcgcgagcgctggatccaagtgcccaagatgccaccagatgaatgcttcatgtgttctgacaaggaatcacttgctgtgggcactgaacttcttgtgtttgcgatggcacacattgtgttcagatatagcattctaaccaattcatggacacgggctgatccgatgatctcaccacggtgcttgtttgggtcaacaagtgttggggcaaaggcatatgttgctgggggcactgattcttctggcaggatattgagctctgcagaaatgtacgactcggagacacattcttggacaccccttcccagcatgaatcgggcaaggaagatgtgctccggggtgttcatggatggcaagttctatgtggttggtggtgttgccagcaacaacaaggtgttgacatgcggtgaggaatatgacctgaagaggcgatcttggagggtgatcgaaaacatgtctgagggtctcaacggagtgactggtgctcctccacttattgctgttgttaacaatgagctttatgctgctgattatagtgaaaaggatgtgaagaagtatgacaagcaaaacaataaatggatcactcttggtaagttgcctgaacggtctgtgtcaatgaatgggtggggccttgctttccgagcatgtggtgatcggttgattgtcatcggcggcccaaggacttctattggtggtacgattgagcttaattcatggaccccggatgagcggccgcctgtgtggaatttgattgccaggcggccatctgggaacttcgtgtataattgtgctgtgatgggctgttgaatccactgaataaagattcaatatggtggattatttatgaaggatggtatgcacaaaggcagcctgttcaattgcttcagtcctgatgctccgtagcgatttctgccttctgtccagtttcagattcaactgggcatctgctgagtggcagcagtcatgtaaccccctgagttcttctaatacttctgttttcctcgctaatccatttcaacatttgcatttggatcaactgctcgtgatttgaaagatacgagactatgcaaaacagtgttatattaataatctaggaacagctttcagaaggcttttcactattgatgaacaacctgttaagcaatactcgattcatatgtggctgcaacaaagatattcatcaattatgaacaccatgccttatgtttgctggtataattttcttttatcaactttacttgcttcatgatgtgcttgtctttcatgaagttttttactagcaacaacgatatgtttcatcctagttgtgacttttgtttgtataaacatgtctgggctgagagctgaccttgcttggtattgttttagttt

SEQ ID NO: 969 - DNA, 2495 bp, Sorghum bicolor
cgagccaaaacagacggacgcacaaagcgaaaggcagagagagagagagagagagagagagagggagggaggcagggcagagcaggagagagaaattcgaggggaataaaaagggaaagaaataaagtgagagaggggagagtcccatttccccaagtacacgagagagagagagagagagcagaggagcacgctacgagagagagaagggaggtcgagggaggcagcaggggctgcaacagaggccagaagcattagaagcggcagtcgtaaccaagtggcatcagtagatagagccagccatctatctatccatctatctagctctacaggtataaatcctcacgcatcggtaggagggcgagaggggggggcgaggggggacgggagaggccgcctgccaccaggccaactaccaagtgggggacgaggaccgggaaccggaggagaggggatttctcggggccggagtggcggccaggacctgattgggctccagggcgcgatctttgagcgcagatttggtgcccgcgatctgccatggatttgatttaagatttggggagatcggttgggttcgcgctgcaagattcgatttttatgcctgttttgttcacgagattaggaggaggggaaataaagcaacaatagaaagatttttggggggagaaggcatgatgctggaagggaagtcctaccttgtgtcgcgctccctgccgagctcctgcgagccagagacggagtgggcgtacctcgcccacgaggtcctcagcggcaagcgcccgacgccggaagacgtcgaggtcgaagacctcgacgaagctgacggcggcggcaagcgcagcaagccgccgtctccacagccgcacacgccggacatctgcgagggccacggctccagccgccatgcctccggttgcggagagcagcagggcactgggagcaaccccatgaattcaatcggtcgtgacctgaccatcaattgcctcctccggctatcccggtccgactacggctcggtcgcctcgctcagccgggacttccgcgccatggtccgcagtggggagatctaccgcctgcggcgccagagtggggtggccgagcactgggtatacttctcctgcaatgttcttgaatgggatgcctatgacccatatcgagagcgctggatccaagtgcccaagatgccgcctgatgaatgcttcatgtgctctgacaaggaatcacttgcagtgggcactcaactgcttgtgtttgcgatggcgcatattgtgttcagatacagcatcctaaccaattcatggaccatggctgatccaatgaactctccacggtgcctgtttgggtcaacaagtgttggggaaaaggccttcgttgctggaggcactgattctggtggcaacatactgagctctgcagagatgtatgactctgagacacatacctggacgcccctcccaagcatgaatagggcgaggaagatgtgttctggggttttcatggatggcaagttctatgtgataggtggtgtggccaacaacaacagagtgctgacttgtggggaggagtatgacttgaagaggcgttcttggaggataatcgagaacatgtctgaaggcctcaatggagtgactggtgctcctccccttattgcagttgtcaacaatgagctctatgccgctgattacagcgagaaggatctcaagaagtatgacaagaagaacaataggtggatcacccttggaaaactgcctgaacggtctgtatcaatgaatgggtggggccttgctttccgagcgtgcggtgaccgcttgattgtcatcggaggtccaaggacctatactggtggtactattgagctcaactcatggatcccagatgagcggccgcctgtgtggaatttgattgccaggcggccatctgggaacttcgtgtataactgtgccgtgatgggttgctgagtccactgaataaaagataagtgcagtggatatttatgaaggatgctatgcacagaggcagcctgtccaattgcttcagcccttattcttcgtagcgatttctgccgtctgcccagttccggaattaactggacatcagctgattgtcagcagtctcatgtaacccttgagttctaatactcctgtttccctgctaatccatttctacatttgcatttgaatcaactgctcgtgatttcaaagatacgagattatggaaaacaaatgtcatattaataatctagaaacaacttcgagatgttttttatctattgatgaggaagctgttaagaaatacttgattcgcctgtagctgcaagaaatgctaattcttttcgttcatcttgcctgtttcataatgtgcatatctttcttgatgttatgagccaccaagttggtgcttggtggtgacatgtgtgaactgctgtttagaattttcatgttgcatatgctggatccacttgggtctaaaatgacatatattatattggtatt

SEQ ID NO: 970 - DNA, 3942 bp, Sorghum bicolor
gcggtactagcaccgtagcagaatactgtactcctagtagttcacataaaaaaacaaggttctactgctgccaatcagcgtcggatgaaaagaaattgaaaggatacgcgaaagacgtacgccgtcgggtgtacagtgctagagtggagcggaagatgcgaagcgcagagaaaatccacctcagcttcaggtgagctggccggtggccgcttccgcccttttctatttctgaggcctgcgcggtttccaattccgacgagccaaaacagacggacgcacaaagcgaaaggcagagagagagagagagagagagagagagggagggaggcagggcagagcaggagagagaaattcgaggggaataaaaagggaaagaaataaagtgagagaggggagagtcccatttccccaagtacacgagagagagagagagagagcagaggagcacgctacgagagagagaagggaggtcgagggaggcagcaggggctgcagcagaggccagaagcattagaagcggcagtcgtaaccaagtggcatcagtagatagagccagccatctatctatccatctatctagctctacaggtataaatcctcacgcatcggtaggagggcgagaggggggggcgaggggggacgggagaggccgcctgccaccaggccaactaccaagtgggggacgaggaccgggaaccggaggagaggggatttctcggggccggagtggcggccaggacctgattgggctccagggcgcgatctttgagcgcagatttggtgcccgcgatctgccatggatttgatttaagatttggggagatcggttgggttcgcgctgcaagattcgatttttatgcctgttttgttcacgagattaggaggaggggaaataaagcaacaatagaaagatttttggggggagaaggcatgatgctggaagggaagtcctaccttgtgtcgcgctccctgccgagctcctgcgagccagagacggagtgggcgtacctcgcccacgaggtcctcagcggcaagcgcccgacgccggaagacgtcgaggtcgaagacctcgacgaagctgacggcggcggcaagcgcagcaagccgccgtctccacagccgcacacgccggacatctgcgagggccacggctccagccgccatgcctccggttgcggagagcagcagggcactgggagcaaccccatgaattcaatcggtcgtgacctgaccatcaattgcctcctccggctatcccggtccgactacggctcggtcgcctcgctcagccgggacttccgcgccatggtccgcagtggggagatctaccgcctgcggcgccagagtggggtggccgagcactgggtatacttctcctgcaatgttcttgaatgggatgcctatgacccatatcgagagcgctggatccaagtgcccaagatgccgcctgatgaatgcttcatgtgctctgacaaggaatcacttgcagtgggcactcaactgcttgtgtttgcgatggcgcatattgtgttcagatacagcatcctaaccaattcatggaccatggctgatccaatgaactctccacggtgcctgtttgggtcaacaagtgttggggaaaaggccttcgttgctggaggcactgattctggtggcaacatactgagctctgcagagatgtatgactctgagacacatacctggacgcccctcccaagcatgaatagggcgaggaagatgtgttctggggttttcatggatggcaagttctatgtgataggtggtgtggccaacaacaacagagtgctgacttgtggggaggagtatgacttgaagaggcgttcttggaggataatcgagaacatgtctgaaggcctcaatggagtgactggtgctcctccccttattgcagttgtcaacaatgagctctatgccgctgattacagcgagaaggatctcaagaagtatgacaagaagaacaataggtggatcacccttggaaaactgcctgaacggtctgtatcaatgaatgggtggggccttgctttccgagcgtgcggtgaccgcttgattgtcatcggaggtccaaggacctatactggtggtactattgagctcaactcatggatcccagatgagcggccgcctgtgtggaatttgattgccaggcggccatctgggaacttcgtgtataactgtgccgtgatgggttgctgagtccactgaataaaagataagtgcagtggatatttatgaaggatgctatgcacagaggcagcctgtccaattgcttcagcccttattcttcgtagcgatttctgccgtctgcccagttccggaattaactggacatcagctgattgtcagcagtctcatgtaacccttgagttctaatactcctgtttccctgctaatccatttctacatttgcatttgaatcaactgctcgtgatttcaaagatacgagattatggaaaacaaatgtcatattaataatctagaaacaacttcgagatgttttttatctattgatgaggaagctgttaagaaatacttgattcgcctgtagctgcaagaaatgctaattcttttcgttcatcttgcctgtttcataatgtgcatatctttcttgatgttatgagccaccaagttggtgcttggtggtgacatgtgtgaactgctgtttagaattttcatgttgcatatgctggatccacttgggtctaaaatgacatatattatattggtatttcagtttgattgaattgatgtttggactactcatagtgtgaatccataagtctgatggagtcttgtgttgtttcacaattggtatttgaacatattagaaacgaaaggtatttattcgattggtgtcatcagtcttgaagtcatgttgcagtactgtatttcttcccctggagtttatggttccactcttgatgtttatatatatggttacccaccatcgctttgactcacaagcttattgtgccacaaaataattcgtgaaaaccatcaagctgtttgattttgcatgatccgttttagtaatttcacctgctagatgtcattctgaagtagtagatgcaaaaagagaatacaaggaattcattagaaacttcctaactcctatgagtgtgctcttctgcagtactgcttgcctgacatgtttcaaatttgaatttgtgagctacagaattcctttggatgagtaaattcaaatggtagttcttgctgtataaaagtgtggttgtgttacctgttgatgtcagccaggtttctacactttttaccaaatgaacagttgccggattaatctagttacatccagactgaaagcagttgcctgattaatctagatacacatttgtgtggagtaagtcgccctttagtctggggcttatgaaactcaagctttgtggaacagagagtgaaatttaaatactcatgtgctacttaatttaagtatgtagctagagtggtgaatgcatattagctgggaaatgtacggttcaagtatcatgtctattgcaattctttctaagttggatataattccgctacttggataaccatatacagtgcttgattagttaccatagtgtctaaatctgctttctgtcaactttgccagtaacacaggatggcaaaaatatggcgcggagcttacttgcacatactagaattaccagtggcctattttcagtcattctggttgtcatcctgcctatttagagtctatataatagtagcaagtgtgatttgctgaaacaaatcttgctttttatgagtagagtgtgatgctaagaagcttaaccttgcatcaattgctatctttgcttcttgactatcattggttccttgcatgtaatagatagctccatactgaaaccactgccgtctttatcttgtatttgactgagccatgctcacattttc

SEQ ID NO: 971 - DNA, 1887 bp, Panicum virgatum
ggagaggccgccaccaggccaactaccaagtgggggaggaccgggccggaggtggggggatttctcgggggaggagtgcccgggaggacctgattgggggctccgggccgccatctctgagcgcagatttggtgcctgcgatctgccatggattcgatttagtcgtagaagaagaggagcaaataaagcaacaggaggaagaatttctcggggtgggcaaagggagaaggcatgatgctggaagggcagtcctacctcgtctcgcgctccctgccgagctcctgcgagccggagacggagtgggcgtacctcgcggaccaagtcctcagcggcaagcgccccgctccggaagatgtcgaggaagctgacggcggcggcaagcgcagcaagccgccgtctccgcagccgcacacgccggacatcaccgagggccacggctccagccgccatgcctccggtggtggggagccgcagggcactgggagcaaccccattaattctatcggccgtgacctgaccatcaattgcctcctccggctatcccggtcggactacggctcggtggcctccctcagccgcgacttccgctccctggtccgcagtggggagatctaccgcctgcggcgccagaatggggtggcggaacattgggtctacttctcctgcaatgttcttgaatgggatgcatatgacccatatcgagatcgctggatccgagtgcccaagatgccgccagatgaatgcttcatgtgctctgacaaggaatcactagcagtcggcactgagctgcttgtgtttgggatggcgcgtattgtgttcagatacagcatcctaaccaattcatggacgagggctgatgcaatgaactccccccgctgcctgtttgggtcaacaagtgttggggagaaggccttcgtagctggaggcactgattctatgggcaccatactgagctctgcagagatgtatgactctgagtcacatacctggacgcctctccccagcatgaatagggcaaggaagatgtgttctggggttttcatggatggcaagttctatgtaataggtggcgtagccaacaacaacaaagtactgacttgcggggaggagtatgacttgaagaggcggtcttggaggatcatcgagaacatgtctgaaggcctcaacggagtgactggtgctcctccccttattgcagttgtcaacaatgagctctatgctgctgattatagtgagaaggatctcaagaagtatgacaagaagaacaataagtggatcactcttggaaagctgcctgaacggtctgtctccatgaatgggtgggggcttgctttccgagcatgtggtgaccgattgattgtcatcggaggcccgaggacctatactggtggtactattgagctcaactcatggatcccaaatgatcagccgcctgtgtggaatatgattgccagacggccatctgggaactttgtgtataactgcgccgtgatgggttgctgagtccactgaataaaagatgaatgaagtggatatttatgaaggattgtatgctcagaggcggcttgtccaattgcttcagcccttattcttcgtagcgatttctgccttctgcccagttctggaattaactggacatcagctgattgtcagcagtctcatgtaacccttgagttctaatacttctatttccctgctaatccatttccacatttgcatttggatcaactgctcgtgatttcaaagatacgagactaggcaaaacaaatgtcatattaataatctagaaaaaaactttcagagggtttttatctattgatgtgaggaacctgttaagaaatacttgattcgcctgcagttgcaacaaatgctaattctttttcatcc

SEQ ID NO: 972 - DNA, 2118 bp, Saccharum officinarum
ggagcagaggagagcacgctacgagaggggagagaagagagagggaggtcgagggaggcagcaggggctgcagcagaggccagaagcattagaagcggcagtcgtaaccaagtggcatcagtagatagagccagccatctatctatccatctatctaactctacaggtataaatcctcacgcatcggtaggagggcgagaggtgggacgagggggggacgggagaggccgcctgccaccaggccaactaccaagtgggggaggaccgggaactggaggaggggatttctcgggtgcggagtggcggccaggacctgattgggctccagggcgcgatctttgagcgcagatttggtgcccgcgatctgccatggatttgatttaagatttggggagatcggtcgggctcgagctgcaagattcgatttttatgcctgttttattcacgagattaggaggaggaaataaagcaacaatagaaagattttttggggagaaggcatgatgctggaagggaagtcctaccttgtgtcgcgctccctgccgagctcctgcgagccggagacggagtgggcgtacctcgcccacgaggtcctcagcgggaagcgcccggcgccggaagacgtcgaggtcgaagacctggacgaagctgacggcggcggcaagcgcagcaagccgccgtctccgcaaccgcacacgccggacatctgcgagggccacggctccagccgccatgcctccggttgcggagagcagcagggcactgggagcaaccccatgaattcaatcggtcgtgacctgaccatcaattgcctcctccggctatcccggtccgactacggctcggtggcctccctcagccgggacttccgcgccatggtccgcagcggggagatctaccgcctgcggcgccagaatggggtggccgagcattgggtatacttctcctgtaatgttcttgaatgggatgcctatgacccatatcgagagcgctggatccaagtgcccaagatgccgcctgatgaatgcttcatgtgctctgacaaggaatcacttgcagtgggcactcaactgcttgtgtttgggatggcgcgtattgtgttcagatacagcatcctaaccaattcatggaccagggctgatccaatgaactctccacggtgcctgtttgggtcaacaagtgttgggggaaaggccttcgttgctggaggcactgattctattggcaacatactgagctctgcagagatgtatgactctgagacacttacctggacacccctcccaagcatgaatagggcgaggaagatgtgttctggggttttcatggatggcaagttctatgtgataggtggtgtggccaacaacaacagagtgctgacttgtggggaggagtatgacttgaagaggcgttcttggaggataatcgagaacatgtctgaaggcctcaatggagtgactggtgctcctccccttattgcagttgtcagcaatgagctctatgccgctgattacagcgagaaggatctcaagaagtatgacaagaagaacaataggtggatcacccttggaaaactgcctgaacggtctgtgtcaatgaatgggtggggccttgctttccgagcgtgcggtgaccgcttgattgtcattggaggtccgaggacatatactggtggtactattgagctcaactcatggatcccaaatgagcggccacctgtgtggaatttgattgccaggcggccatctgggaacttcgtgtataactgcgccgtgatgggttgctgagtccactgaataaaagataagtgcagtggatatttatgaatgatgctatgcacagaggcagcctgtccaattgcttcagcccttattcttcgtagcaatttctgccgtctgcccagttctggaattaactggacatcagctgattgtcagcagtctcatgtaacccttgagttctaatactcctgtttccctgctaatccatttctacatttgcatttgaatcaactgctcgtgatttcaaagatacgagactatgcaaaacaaatgttatattaataatctagaaacaacttcgagatggtttttatctattgatgaggaacctgttaag

SEQ ID NO: 973 - DNA, 1881 bp, Setaria italica
gagagagaggagagagggagaggggaagggagggggcagcaggggctgcagcagaggccagaagcattagaagcggcagtggtaaccaagtggcatcagtagatagagccagccatctatccatccatctatctgcagatcgcagcaacgagtctcgattgctaagcaagctaagatttcctttttctagatcaatcgtaaaagaagaggagcaaataaagcagcaagaggaagaatttcgggggtgagcaagggagaaggcataatgctggaagggaagtcctacctcgtgtcgcgctccgtgccgagctcctgcgaggcggagacggagtgggcgtacctagcgaacgaggtcctcagcggcaagcgcccggcgccggaagatgtcggggtcgaaggcctcgacgaagctgacggcggcggcaagcgcagcaagccgccgtctccgcagccgcacacgccggacatcaccgagggccacggctccagccgccatgcctccggtggcaaagagcagcaggccactgggagcaaccccattcattctatcggccgtgacctgaccatcaattgcctcctccggctatcccggtcggactacggctcggtggcctccctcagccgcgacttccgctccctggtgcgtagcggggagatctaccgcctgcggcgccagaatggggtggcggagcattgggtctacttctcttgcaatgttcttgagtgggatgcatatgacccatatcgagaccgctggatccgggtgcccaagatgccgccggatgaatgcttcatgtgctctgacaaggaatcacttgcagttggcactgaactgcttgtgtttgggatggcgcgcattgtgttcagatacagcatcctaaccaattcatggtccagggctgatgcaatgaactatccccgctgcctgtttgggtcaacgagtgttggggagaaagccttcgttgctggaggcactgattctttgggcaccatactgagctctgcagagatgtatgactctgagaatcatacctggacactcctccccagcatgaatagggcaaggaagatgtgttctggggttttcatggatggcaagttctatgtgataggtggtgtggccaacaacaacaaagtgctgacttgtggggaggagtatgacctgaagaggtgttcttggaggatcatcgagaacatgtctgaaggcctcaaaggagtgactggcgctcctccccttattgcagttgtcaacaatgagctgtatgctgctgactacagtgagaaggatctcaagaagtatgacaagaagaacaataagtggatcactcttggaaaacttcctgaacggtctgtgtcaatgaatgggtgggggcttgctttccgagcatgtggcgaccggttgattgtcatcggaggcccaaggacctatactggtggtactattgagctcaactcatggatcccaaatgatcggccgcctgtgtggaatttgattgccagacggccttctgggaacttcgtgtataactgcgccgtgatgagttgctgagtccactgaataaaagataagtgcagtggatatttatgaaggatggtatgcacagaggcagcctatccaattgcttcagcccttattcttcgtagcgatttctgccttctgcccagtttcgcaattaactggacatcagctgattgtcagcagtctcatgtaacccttgagttctaatacttctgtttccctgctaatccatttctacatttgcatttggatcaactgctcgtgatttcaaagatacgagactatgcaaaaaaatgtcatattaataatctagaaaaaacttccagagggttgttttatctattgatgaggaacctgttaag

SEQ ID NO: 974 - DNA, 2849 bp, Setaria italica
gcggaggagagagaaacggagggggaataaaaaggtaaagaaataaagtgagggggaggggagagtcccatttccccaagtactacgcgagagagagagagagaggcgtggtgggaggaggagcagagccggccagcagctgcagcccagcacactacgagagagaggagagagggagaggggaagggagggggcagcaggggctgcagcagaggccagaagcattagaagcggcagtggtaaccaagtggcatcagtagatagagccagccatctatccatccatctatctagctctacaggtataaatcctcacgcatcggtaggagggcgagaaggtggggaggaggggacgggcagcggccgccaccaggctaactacctagtgtgggggaggaccggcggtgggggatttctcgggggcggagtggccgggaggacctgattggggggcttccgggggcgatctctgagcgcagatttggtgcctgcgatctgccatggattcggtttaggtttggggagatcggccgggttctcgccgcgagattcgatttttgcgcctgttttattcgcgagatcgcagcaacgagtctcgattgctaagcaagctaagatttcctttttctagatcaatcgtaaaagaagaggagcaaataaagcagcaagaggaagaatttcgggggtgagcaagggagaaggcataatgctggaagggaagtcctacctcgtgtcgcgctccgtgccgagctcctgcgaggcggagacggagtgggcgtacctagcgaacgaggtcctcagcggcaagcgcccggcgccggaagatgtcggggtcgaaggcctcgacgaagctgacggcggcggcaagcgcagcaagccgccgtctccgcagccgcacacgccggacatcaccgagggccacggctccagccgccatgcctccggtggcaaagagcagcaggccactgggagcaaccccattcattctatcggccgtgacctgaccatcaattgcctcctccggctatcccggtcggactacggctcggtggcctccctcagccgcgacttccgctccctggtgcgtagcggggagatctaccgcctgcggcgccagaatggggtggcggagcattgggtctacttctcttgcaatgttcttgagtgggatgcatatgacccatatcgagaccgctggatccgggtgcccaagatgccgccggatgaatgcttcatgtgctctgacaaggaatcacttgcagttggcactgaactgcttgtgtttgggatggcgcgcattgtgttcagatacagcatcctaaccaattcatggtccagggctgatgcaatgaactatccccgctgcctgtttgggtcaacgagtgttggggagaaagccttcgttgctggaggcactgattctttgggcaccatactgagctctgcagagatgtatgactctgagaatcatacctggacactcctccccagcatgaatagggcaaggaagatgtgttctggggttttcatggatggcaagttctatgtgataggtggtgtggccaacaacaacaaagtgctgacttgtggggaggagtatgacctgaagaggtgttcttggaggatcatcgagaacatgtctgaaggcctcaaaggagtgactggcgctcctccccttattgcagttgtcaacaatgagctgtatgctgctgactacagtgagaaggatctcaagaagtatgacaagaagaacaataagtggatcactcttggaaaacttcctgaacggtctgtgtcaatgaatgggtgggggcttgctttccgagcatgtggcgaccggttgattgtcatcggaggcccaaggacctatactggtggtactattgagctcaactcatggatcccaaatgatcggccgcctgtgtggaatttgattgccagacggccttctgggaacttcgtgtataactgcgccgtgatgagttgctgagtccactgaataaaagataagtgcagtggatatttatgaaggatggtatgcacagaggcagcctatccaattgcttcagcccttattcttcgtagcgatttctgccttctgcccagtttcgcaattaactggacatcagctgattgtcagcagtctcatgtaacccttgagttctaatacttctgtttccctgctaatccatttctacatttgcatttggatcaactgctcgtgatttcaaagatacgagactatgcaaaaaaatgtcatattaataatctagaaaaaacttccagagggttgttttatctattgatgaggaacctgttaagaaatactggattcgcctgtagctgcaacaaatgctaattcattttcatccatctcgcctgtttcataatgtgcatatcttgatgttatgagctaccatgttggtacttggtgatgatatatgcgaactgctggttgttaattttcatgtggcttatgctcgatccatttggctcaattgataataaaatgatccctgacaacctcgaagctgtttcatttgcttggttcgttttagtaattttgcctgctagatatcattatcaattagtagctgcaataagagaatatgaggattccattagaatctttgatggtaatttacatttgttctctatccttttgctgtgctcttctgcttgcttgagatgcttgaacagtatttggaaacatgagactacagaattcctttggataactgatgctaattgcgaaacatatgttgcgcacctatgaagaaattccaactaaatggttgtgttacctgtcgatgccatttgccagccttacacgtccatgacttgtcaaa

SEQ ID NO: 975 - DNA, 2205 bp, Zea mays
cccatttccccaagtacgagagagagagagagagagagcagaggagcacgctacgctacgtgaggggagagaagagagagggaggtcgagggagggaggcagcaggggttgcagcagaggccagaagcattagaagcggcagtcgtaaccaagtggcatcagtagatagagccagccatctatctatccatctatctagctctacaggtataaatcctcacgcatcggtaggagggcgagaggggggccgacgggggacgggagaggccgcctgccagcaggccaactaccgagtgggggaggaccgggaaaccggaggaggggatttctcggggagcggagggtcggccaggacctgattgggctccagggcgcgatctttgagcgcagatttggtgcccgcgatctgccatggatttgatttaagatttagggagatcggtcgtgttcgcgtcgcgctgcgagattcgattttttatgcctgttttattcacgagattgcaagaacgggactgctaagcaagctaaggtttcatatttttctggatcaatttcaaattaggatttaggaggaggaaataaagcaagaatagaaagcttttttttggggtgaagccatgatgctggaagggaagtcctaccttgttccgcgctccctgctgagctcctgcgagacggagacgcagtgggcgtacctcgctcacgaggtcctcggcggcaagcgcccggcgccggaagacgtcgaggtcgaagacctcgacgaagctgacggcggcggcaagcgcagcaagccgccgtctccgcagccgcacacgccggacatctccgagggtcgcggctccagccgccatgcctccggttgcggagagcagcagggcactgggagcaaccccatgaattcaatcggccgtgacctgaccctcaattgcctcctccggctatctcggtccgactacggctcggtggcctccctcagccgggacttccgatccatggtccgcagcggggagatctaccgcctgcggcgccagaatggggtggccgagcattgggtctacttctcctgcaacgttcttgaatgggatgcctatgacccatatcgagagcgctggatccaagtgcctaagatgccgcctgatgaatgcttcatgtgctctgacaaggaatcacttgcagtgggcactgaactgcttgtgtttgggatggcacgtattgtcttcagatacagcatcctaaccaattcatggaccagggctcatccaatgaactctccgcggtgcctgtttggttcaacaagtgttggggaaaaggccttcgttgctggaggcactgattctattggcaacatactgagctctgcagagatgtatgactctgagacacatacctggacgcccctcccaagcatgaatagggcaaggaagatgtgttctggggttttcatggatggcaagttctatgtgataggtggtgtggctaacaacaacaaattgctgacttgtggggaggagtatgacttgaagaggcgttcctggaggataatcgagaacatgtctgaaggcctcaatggagtgactggtgctcctccccttattgcagttgtcagcaacgagctatacgccgctgattacagcgagaatgacctcaagaagtatgacaagaagaacaacaggtggatcacccttggaaaactgcctgaacggtctgtgtcaatgaatggttggggccttgctttccgagcctgcggtgactgcctgattgtcatcggaggtccgaggacctacactggccgtactattgagctcaactcatggaccccaaacgagcggccgcctgtgtggaatttgattgccaggcggccatctgggaacttcgtgtacaactgcgccgtgatgggttgctgagttccactgaataaaagataagtgcagtggatatttatgaaggatggtatgcacagaggtagcctgtcccaattgcttcggcccttattcttcgtagtagcggtttctgccgtctggcccagttccggaattatgtggacatcagctgattgtcagcagtctcatgtaacccttgagttctgatactcctgtttccctgctaatccatttctacatttgcatttgaatcaactgctcgtgatttcaaagatacgagactatgcaaaacaaatgtcatattaataatctagaaacagcttcg

SEQ ID NO: 976 - DNA, 2550 bp, Zea mays
cgacgagccaaaacagacggacgcacacaaaagcgaaagggaggagagagaggggcagggcagagcaggagagagaaattcgatagggttcccatgccccttccccaccggccaccacttgccaagcgaaagcgggagtgaaggaggggagagtcccatttccccaagccctacacgagagaaagagagagaggggggagcagaggagcacgctacgagagagggaggtcgagggagacagcagaggctgcagcagaggccagaagcattagaagcggcagttgtaaccaagtggcatcagaagatagagccagccatccgtctatccatctatctagctctacaggtataaatcctcgcgcatcggtagggggcgaggggaggaccgggaaccggaggggatttctcgggggtggagtggcggccaggacctctgattgggctccagtgcgcgatctttgaacgcagatttggtgcccgcaatctgccatggatttggtttaagatttggtgagatcggtcgggttcgcgctgcaagattagatttttgtgcctgttttattcacgagatcgcaacaacgatattgctaagcaagataagatttcaactttttttcccctggatcgatctcagattaggaggagcaaataaagcaagaatagaaagatttttgggggagaaggcatgatgctggaagggaagtcctaccttgtgtcacgctccgtgccgagctcctgcgagccggaggcggagtgggagtacctcgcccacgcggtcctcagcggcaagcgcccggcgccggaagatgacgtcgaggtcgaagacccggacgaaactggcagcggcggcaagcgcagcaagccgccatctccgcagccgcacacgccggacatctgcgagggccacggctccaaccgccacgcaaccggttccggagagcagcggatcaccgggagcaaccccatgacttcgatcggtcgtgacctgaccctcaattgcctcctccggctatctcggtccgactacggctcggtggcctccctcagccgggacttccgctccatggtccgcagcggggagatctaccggctgcggcgccagaacggggtggccgagcattgggtctacttctcctgcaacgttctcgaatgggatgcctacgacccataccgggagcggtggatccaagtgcccaagatgccgcctgatgaatgcttcaagtgctccgacaaggaatcgcttgcggtgggcactgagctgcttgtgttcgggatggcgcgtatcgtcttccgatacagcatcctgaccaactcatggagcagggctgatccgatgaactctccgcggtgcctgttcgggtcaacgagtgtcggcgggaaggccttcgtcgccggaggcactgattgtgtcggcaacatactgagctctgcagagatgtatgactctgagacacatacctggacgcccctcccgagcatgaacacggcgaggaagatgtgttctggggtgttcatggatggcaagttctacgtgataggtggtgtggccaacagcaacagagtgctgacctgcggggaggagtacgacttgaagaggggttcttggaggacaatcgagaacatgtctggaggcctcaatggagtgaccggtgctcctccccttattgcggttgtcagcaacgagctctacgccgccgattacggcgagaaggatctcaagaagtatgacaagaagaacaacaggtggatcaccctcggaaaactgcctgagcggtccgtgtcaatgaatgggtgggggcttgccttccgagcgtgcggtgaccgcttgattgtcatcggaggtccgaggacctataccggtggtaccatcgagctcaactcgtggatcccagatgagcggccgcccgtgtggaatttgattgccaggcggccatctgggaacttcgtgtataactgcgccgtgatgggttgctgagtccactgaataaagatacaagtgaagtggacttcctcgtatttatgaaggatgctatctatgcacagaggcagcagcctgtccaattgcttcagcccttattcttcttcatagcgatttctgccgtctgcgcggttccggaattaactggacatcggctgattgtcagcagtctcatgtaaccattacgttctaatactcctgtttccctgctaatccattcctacattttgcattttcatcagctgatcgtgattccaaagatacgagactgtgcaaaaaaaatgtcatattaataatctagaaacaacctcgaggtggtttttatctattgatgaggaacctgttaagaaatgctactacttcttttccgttcatcttgcatgttccaaactgtgcatatctttcatgatgttatgagccactaagctggtgctgaagccatgttgcaatagcctgtatttcttcagctggagtctatggttctactcttgatgtttatagtttataatggttacccaccatcgcttaacgtgccacaaaatgatccgtgaaaaccatgatgaagctgtttg

SEQ ID NO: 977 - DNA, 1813 bp, Pennisetum glaucum
catttctgggcctgttttattcgcgaggtccggcctcctcagatctcgagtgggacgggctgcggccaactacctggtgcggggaggagggctccggcggtgggggatttctggggggcggagtggccgggaggacctgacttccgggcgcgatctctgaagcgcagatttgctgcccgcgatctgccatgggctcggtttagatcaatcgaagaagaagaggagcaaataaagcagcaagaggaagaaattcggggggtgaaccaagggaggagaaggcatgatgctggaagggaagtcgtacctcgtgtcccgctgcctgccgagctcctgcgaggcggagacggagtgggcgtacctcgccaacgaggtcctcagcggcaagcgcccggcgccggaagatgtcggggtcgaaggcttcgacgaagccgacggcggcggcaagcgcagcaagccgccgtctccgcagccgcacacgccggagatcaccgagggccacggctcctgccgccatgcctctggtggcaaagagcagcaggacaccgggagcaaccccatccattctatcggccgtgacctgaccatcaattgcctcctccggctatcccggtcggactatggctcggtggcctccctcagccgggacttccgctccctggtacgtaccggggagatctaccgcctacggcgacagagtggggtggcggagcattgggtctacttctcttgcaatgttcttgaatgggatgcttatgacccatatcgagaccgctggatccgggtgcccaagatgccgccggatgaatgcttcatgtgctctgacaaggaatcgcttgcagttggcactgaactccttgtgtttgggatggcgcgtattgtgttcagatacagcatcctaaccaattcatggtccagggctgatccaatgaactatccccgctgcctgtttgggtcaacaagtgttggagagaaggcctttgttgctggaggcaccgatcctttgggcaacatactgagctctgctgagatgtatgactctgagaatcatacctggacactactccccagcatgaatagggcaaggaagatgtgttctggggttttcatggatggcaagttctatgtggtaggtggtgtggccaacaacaacaaagtactgacttgtggggaggagtatgacctgaagaggcgttcttggaggatcatcgagaacatgtctgaaggcctcaaaggagtgactggtgctcctccccttattgcagttgtcaacaatgagctttatgcggctgactacagtgagaaggatctcaagaagtatgacaagaagaacaataaatggatcactcttggacggtccgtgtcaatgaatgggtgggggcttgctttccgagcatgtggtgaccggttgattgtcatcggaggcccaaggacctatactggtggtactattgagcttaactcatggatcccaaatgatcgtccgcctgtgtggaatttgattgccagacgaccatctggaaatttcgtgtataactgcgccgtgatgagttgctgagtccactgaataaaagataagtgcagtggatatttatgaaggatggtatgcacagaggcagcctgtccaatttgcttcggtattcttcgtagcgatttctgccctctgcccagtttcgcaattaactggacatcagctgattgtcagcagtctcatgtaacccttgagttctaatacttctgtttccctgctaatccatttctacatttgcatttgaatcaactgctcgtgatttcaaagatacgagactatgcgaaa

SEQ ID NO: 978 - DNA, 1735 bp, Triticum aestivum
atcttcttccattccaaggcagccatggattccctcctctggttcgtggaactcctctctctcctttgcttcttcgtcttctactaccgccacctccagtccaagaaaataagcaaggcggagccgaccgaatggccaatcctgggccatcttttcggcatggtcgccaacctgtcccacttccatgactgggccaccggcatcctggccggcacgcgctacaacttcgaagctcgcgccgggatcaccggcgtccgcttcttcgtcacctgcgaccccgccaacgtgcgccacatcttcacctccaacttcgccaactaccccaagggcgacgagttcgccgagatcttcgacgtcttcggcgacggcatcttcaacgccgacggcgactcctggcgccgccagcgtgccaagtcacagctcatcatggcgggccctcgcttccgcgccttctcggcgcgctacagccgcgacaaggtggagaggagcctcctgcctttcctcgcccacgccgccgaggccgggtccacaccctgcgacctgcacgacgtgttcctgcgcctgacgttcgacatgacctgcaacctcgtcttcggcgtcgaccccgggtgcctgcagattgacctccccgtggtgcccttcgcgcgcgccatggacgacgtgctcgagacgctcttcctccgccacatcatctcgcccgcgtgctggaagctcatgtaccggtatgaggtcggcaccgagaggaagatggccgcggctcgtaggaccatcgaccggttcgccgcggacaccatcgcgaaacgcagggccgaccacaagctcggcgacgagggcgtcaccgactcgtccgacatgctctcgtccttcatctgcaacggtgacgcgagcgagtacagcgacgacttcttgcgtgacaccacggtgaacctcctcctcgccggccgggacaccaccggcgcggcgctgtcctggttcttctacctgctctccaagaacccacgcgtcgagcagaagatcctggacgaactggcgccgatcgcttcccggaagaagcagctggcgggcgacgacggcatggcggtgttcgacgtgagcgagctgagcggcatggtgtacctgcacgcggcgctgtgcgagtgcctgaggctgtacccgtccgtgcccttcgagcacaaggcggcggtggccgacgacgtgctccccagcgggcacgagatgaaggccggcgacaagatactcatcttctcctactgcatggcgaggatggagggcgtgtggggcaaggactgcatggagttcaggccggagaggtgggtcaccgccgacgggaagctgaggtacgagccgtcctacaagttcatctccttcaacgccggacccaggacctgcctcggcaaggagatggcgttcgtgcagatgaagaccgccgcggcggccgtgctctggaacttcgcagtcaagaccgtgcctggccacgtcgtcgagccgaagctgtccatcattctccacatgaagaacgggctcgccgtcacggtcaagaggaggaacgtcgcgggcgtgcatggctagctagtacgtacctacgtgcctactacctacatgtctcggccacaaagtatacgggccgtatatatgtaacgtagctacacgtacgtacatgtacacgtattatatgtatgcaaaaagagtggcatgtgtgcttactaatagtgtaatggtgttccatactacaaga

SEQ ID NO: 979 - DNA, 1830 bp, Pseudoroegneria spicata
  misc_feature (1816)..(1816): n is a, c, g, or t
tggattccttctactggtgcgtggagctcctctccctcctttgcttcttcgtcttctactaccgccatctccagtccaagaaaataagcaaggaggagccgaccgaatggccaatactgggccatcttttcggcatggtcgccaacttgtcgcacttccatgactgggccaccggcatcctcaccggcacgcgctacaacttcgaagcgcgcgcggggatcaccggcgtccgcttcttcgtcacctgcgaccccgccaacgtgcgccacatcttcacctccaacttcgccaactaccccaagggcgaggagttcgccgacatcttcgacgtcttcggcgacggcatcttcaacgccgacggcgagtcctggcgccgccagcgcgccaagtcccagctgatcatgtccggccctcgcttccgcgccttctcggccaggtacagccgcgacaaggtggagaggagcctcctgcctttcctcctcgcccacgccgccgacgcgggcaccccgtgcgacctgcacgacgtgttcctgcggctcacgttcgacatgacctgcaacctcgtcttcggcgtcgaccccggatgcctgcagatcggcctccccgtggtgcccttcgcgcgcgccatggacgacgtgctggagacgctcttcctccgccacatcatctcgcccgcgtgctggaagctcatgtaccgctatgaggtcggcaccgagaggaagatggccgcggctcgcaggaccatcgaccggttcgccgcggacaccatcgcccaacgcagggccgaccacaagctccgcgacgaggtcgtcagcgactcgtccgacatgctgtcgtccttcatctgcaacggtgacgcgagcgagtacagcgacgagttcctgcgtgacaccacggtgaacctcctgctcgccggccgggacaccaccggcgcggcgctgtcgtggttcttctacctgctctccaagaacccgcgcgtcgagcagaagatcctggacgagctggcgcccgtcgcttcccggaagaagaagaagcaggccggggacgacgacgacgacgacatggtggtgttcgacgtgagcgagctgagcggcatggtgtacctgcacgcggcgctgtgcgagtgcctgaggctgtacccgtccgtgcccttcgagcacaaggcggcggtggccgacgacgtgctcccgagcgggcacgagatgaaggccggcgacaagatactcatcttctcctactgcatggcgaggatggagggcgtgtggggcaaggactgcatggagttcaggccggagaggtgggtcaccgccgacgggaagctgaggtacgagccgtcctacaagttcatctccttcaacgcggggccaaggacctgcctcggcaaggagatggcgttcgtgcagatgaagaccgccgcggcggccgtgctctggaacttcgccgtcgaggccgtgcccggccacgtcgtggagccgaagctgtccatcattctccacatgaagaacgggctcgccgtcacggtcaagaggaggaacgcagcgcccgtgcatggctagctagtacgtacgtgcgtgcctactgcatacacgtctcggccgaaaggcatacggggcgcacgtagctacacgtacgtacatgtacgtattatatgtgtatatgcaagagtggcatgtgtgcttagtaatagtgtaatggtgttccatactacaagaataaaaatataagaaaaatagatgtgtgtgttccctaaatagaaaatggaggcatgggcaccagcttggatgcatgatctatacaggttggcttggatccacgnctattttcgcaaaa

SEQ ID NO: 980 - DNA, 2078 bp, Brachypodium distachyon
cgtagtcttgcactggtaatcctgcatcctttccaaaagttagccatggatcccctatactggctcgtggagctgctctccctcctctgctgcttcatcttctactaccgccacctccaatccaagaaaatcagcaagagggagccaacggaatggccggtactgggccatctcttcggcatgatcgcccacaagaacgacttccacgactgggccacgggcatcctggccggcacgcgctacaacttcgaggcccgtgccggggtcaccggcgtccggttcttcgtcacctgcgacccggccaacgtgcgccacatcttcacctcaaacttcgcaaactacccgaaaggcgacgagttcgcggagatcttcgacgtcttcggcaacggcatcttcaacgcggacggcgagtcctggcgccgccaaagggcgaaatcccagcttctcatggcagggccacgtttccgggccttctcggcagagtacagccgcgacaaggtggagaagagcctcctgcctttcctcgaacacgctgcggacgccggcacggcatgtgatctgcacgatgttttcctgaggttaacgttcgacatgacgtgtaacctggtcttcggggtcgaccccgggtgcctggccatcgggttgcccgagatccccttcgcgagagccatggacgacgtgctggagacgctcttcctccggcacctcatctcgcccgcctgctggaagctcatgtaccggctggagctcggcccggagaagaagatggccgtggctcgcaggaccatcgaccgcttcgccgccgagaccatcgccaagcgcagggccgacagtcacgagacgtctgccgcccacggcgcagacatgctttcctccttcatcggccaagacgaccacacgggcgagtacagcgacgagttcttgcgagacaccaccgtgaacctcctgctagccggccgcgacaccacgggcgccgcgctagcttggttcttctacctcctctcccagaacccgcgcgtcgagcagaagatcctggccgagctcgcgccgatcgcttcccagaagaagaaagccatggacggcgatggtgacacggacactggcaacatggtggtgttcgacgtgagcgagctgagcaacatggtgtacctccacgcggcgctgtgcgagtgcctgaggctgtacccgtcagtgcccttcgagcacaaggcggcagtggccagcgacgtgctcccgagcgggcacgagatgaaggccggcgacaagatcctcatcttctcctactgcatggggaggatggagggcgtgtggggaaaggactgcgcggagttcaggcccgagcggtgggtgagcgaggacgtcgacgggaagaagaggctgaggtacgagccgtcttacaagttcatctccttcaacgccgggcccaggacgtgcctcggcaaggagatggccttcgtgcagatgaagactgctgccgcggccgtgctgtggaactttgtggtccgggcggttccgggccacgtcgtggagcctaagctgtccatcatacttcacatgaagaacgggctcgccgtcacggtcaagaggaggaccggactgcatggtggcgcctaagctagtttcttgactggaacgtataggtacgtatgtacgtacgtggacgacacgtctcggccagccgcaagaaggtatacgggcgtagctacacgtagcagacacgtacatgcaacgtacgtatagaaatgtgtgtactcataagtgtcacgtatacgtgctagttaatgctggttcattctatcggaataaaacaaaacgtagacgtgtagtgtgtgtgtagtgtttacttaagtgtgtgtttgtgttgtgatgcaagctgtgtgcatgtgcatgtgtagcacgcgtgcgtgctcccctggaatagataatggacgtatgggcatatatacatgtacgtatatagatctaataatgttctatatacaggttggcggtgcatgtatatgttttgtttagcttgcactgtatgtatgtttctttacaaaccatatactgcgtatatatctgcggaagttccagta

SEQ ID NO: 981 - DNA, 2245 bp, Brachypodium distachyon
ttagataaaaatcggattgatggcctgaccatgaatgacccaccctaatcatcttactgtaaactgacgtgagacgcctcacctacctatgagcacacatatatcaaccggtcacgcatgcatgcgagagtgcgttgcatataaggagcccgtagtcttgcactggtaatcctgcatcctttccaaaagttagccatggatcccctatactggctcgtggagctgctctccctcctctgctgcttcatcttctactaccgccacctccaatccaagaaaatcagcaagagggagccaacggaatggccggtactgggccatctcttcggcatgatcgcccacaagaacgacttccacgactgggccacgggcatcctggccggcacgcgctacaacttcgaggcccgtgccggggtcaccggcgtccggttcttcgtcacctgcgacccggccaacgtgcgccacatcttcacctcaaacttcgcaaactacccgaaaggcgacgagttcgcggagatcttcgacgtcttcggcaacggcatcttcaacgcggacggcgagtcctggcgccgccaaagggcgaaatcccagcttctcatggcagggccacgtttccgggccttctcggcagagtacagccgcgacaaggtggagaagagcctcctgcctttcctcgaacacgctgcggacgccggcacggcatgtgatctgcacgatgttttcctgaggttaacgttcgacatgacgtgtaacctggtcttcggggtcgaccccgggtgcctggccatcgggttgcccgagatccccttcgcgagagccatggacgacgtgctggagacgctcttcctccggcacctcatctcgcccgcctgctggaagctcatgtaccggctggagctcggcccggagaagaagatggccgtggctcgcaggaccatcgaccgcttcgccgccgagaccatcgccaagcgcagggccgacagtcacgagacgtctgccgcccacggcgcagacatgctttcctccttcatcggccaagacgaccacacgggcgagtacagcgacgagttcttgcgagacaccaccgtgaacctcctgctagccggccgcgacaccacgggcgccgcgctagcttggttcttctacctcctctcccagaacccgcgcgtcgagcagaagatcctggccgagctcgcgccgatcgcttcccagaagaagaaagccatggacggcgatggtgacacggacactggcaacatggtggtgttcgacgtgagcgagctgagcaacatggtgtacctccacgcggcgctgtgcgagtgcctgaggctgtacccgtcagtgcccttcgagcacaaggcggcagtggccagcgacgtgctcccgagcgggcacgagatgaaggccggcgacaagatcctcatcttctcctactgcatggggaggatggagggcgtgtggggaaaggactgcgcggagttcaggcccgagcggtgggtgagcgaggacgtcgacgggaagaagaggctgaggtacgagccgtcttacaagttcatctccttcaacgccgggcccaggacgtgcctcggcaaggagatggccttcgtgcagatgaagactgctgccgcggccgtgctgtggaactttgtggtccgggcggttccgggccacgtcgtggagcctaagctgtccatcatacttcacatgaagaacgggctcgccgtcacggtcaagaggaggaccggactgcatggtggcgcctaagctagtttcttgactggaacgtataggtacgtatgtacgtacgtggacgacacgtctcggccagccgcaagaaggtatacgggcgtagctacacgtagcagacacgtacatgcaacgtacgtatagaaatgtgtgtactcataagtgtcacgtatacgtgctagttaatgctggttcattctatcggaataaaacaaaacgtagacgtgtagtgtgtgtgtagtgtttacttaagtgtgtgtttgtgttgtgatgcaagctgtgtgcatgtgcatgtgtagcacgcgtgcgtgctcccctggaatagataatggacgtatgggcatatatacatgtacgtatatagatctaataatgttctatatacaggttggcggtgcatgtatatgttttgtttagcttgcactgtatgtatgtttctttacaaaccatatactgcgtatatatctgcggaagttccagtacgtgcaagattttactt

SEQ ID NO: 982 - DNA, 823 bp, Triticum aestivum
gagaccgaccgaaacgcaccggcgtcggagcggctaggcgaaggcggggcccaacgccggcgagcggcggcagcgtgctcgccgccatggacgagcaggagttccggcgcatgctcgacctcttccccgtcgtccgatcccgcgactactgcaaggatgaagtggaatcatcaagcgaaggcaccacacagcaaacacgagctcaggagataaaaggaaccaaaaagaatgctgcagaagctctattcctgcggaaattgaagatggctgctgagaaaaaggttggagcaacaaaggcagaactattctgcaagacattcgaagaagctcacgagaaacttgtttacaaagaactggatctggatgctgctcaaaggttcctgaatgcctacaagagctgatgatgagctgttgctagatgcctagaagatttggtttttattcatcggaaactgctgaagatgtgatgatgttaagatttctgatatttcctttgtggttctcatcttctgcgaaaccatgtagacagccctggtcaatcagctacattattcagatgtactgtgttatccttaacatagaccacatgtatttttcttccagctgcgatctgttcgccctgttcttcagagatagaactagcatgtttcttctgtttccaatgacaaaaagtctgaaccggcaaaaaaatatacacaaattgccgcgacgttgcagatggtacagttttaactagggattatttttttcaaatttgccgtgatgttgaacccgatgccaccatatacggatgtacagcatcttggaacaaaacaattatatc

SEQ ID NO: 983 - DNA, 801 bp, Triticum aestivum
gcacaagcgcggcgcagtcgtctcgggtggactccgtcgtctcctctgagctcgagaccgaccgaaacgcaccggcgtcggagcggctaggcgaaggcggggcccaacgccggcgagcggcggcagcgtgctcgccgccatggacgagcaggagttccggcgcatgctcgacctcttccccgtcgtccgatcccgcgactactgcaaggatgaagtggaatcatcaagcgaaggcaccacacagcaaacacgagctcaggagataaaaggaaccaaaaagaatgctgcagaagctctattcctgcggaaattgaagatggctgctgagaaaaaggttggagcaacaaaggcagaactattctgcaagacattcgaagaagctcacgagaaacttgtttacaaagaactggatctggatgctgctcaaaggttcctgaatgcctacaagagctgatgatgagctgttgctagatgcctagaagatttggtttttattcatcggaaactgctgaagatgtgatgatgttaagatttctgatatttcctttgtggttctcatcttctgcgaaaccatgtagacagccctggtcaatcagctacattattcagatgtactgtgttatccttaacatagaccacatgtatttttcttccagctgcgatctgttcgccctgttcttcagagatagaactagcatgtttcttctgtttccaatgacaaaaagtctgaaccggcaaaaaaatatacacaaattgccgcgacgttgcagatggtacagttttaactagggattatttttt

SEQ ID NO: 984 - DNA, 636 bp, Secale cereale
ggactcgtcgtctcgtctgagttcgagaccgaccgagacgcaccggcgtcggagcggctaggcgaaggcagggcccaacgccggcgaacggcggcagcgtgctcgccaccatggacgagcaggagttccggcgcatgctcgagctcttccccatcgtccgatcccgcgactactgcaaggatgaagtggaatcatcaagcgaaggcaccacacagcaaacacgagctcaggagataaaaggaaccaaaaaagaaggctgcagaagctctattcctgcggaaattgaagatggctgctgagaaaaaggttggagcaacaaaggcagaactattctgcaagacattcgaagaagctcacgagaaacttgtttacaaagaactggatctcgatgctgctcaaaggttcctgaatgcctacaagagctgacgatgaactgttgctagatgcctagaagatttggttttatcatcgggaactgctgaagatgtgatgatgttacgatttctgatgtttcttttgtggttctcatcttctgcgaaaccatgtagacagccctggtcaatcagctacattattcagaatcagatgtactgtgttatccttaacattgaccacagaagaaaatgcatttttctt

SEQ ID NO: 985 - DNA, 642 bp, Secale cereale
acgcaccggcgtcggagcggctaggcgaaggcggggcccaacgccggcgaacggcggcagcgtgctcgccgccatggacgagcaggagttccggcgcatgctcgagctcttccccgtcgtccgatcccgcgactactgcaaggatgaagtggaatcatcaagcgaaggcaccacacagcaaacacgagctcaggagataaaaggaaccaaaaagaaggctgcagaagctctattcctgcggaaattgaagatggctgctgagaaaaagattggagcgacaaaggcagaactattctgcaagacattcgaagaagctcacgagaaacttgtttacaaagaactggatctcaatgctgctcaaaggttcctgaatgcctacaagagctgatgatgaactgttgctagatgcctagaagatttggttttcattcatcggaaactgctgaagatgtgatgatgttaggatttctgatgtttcctttgtggttctcatcttctgcaaaaccatgtagacagccctggtcaatcagctacattattcagaatcagatgtactgtgttatccttaacattgaccacagaagaaaatgcatttttcttgcagctgcgatctgttccgcctattcttaagagatagaacta

SEQ ID NO: 986 - DNA, 650 bp, Avena sativa
gagaccaaatcgcaccggcgtcggagcggcacgaaacctagggggctaaggcgtagtcccggccgaacgccggcgagaggcggaggcagcgcgctcctcaccatggacgagcaggagttccggagcatgctcgagctcttccccgtcgtccgatcccgcgactactgcaaggctgaattggaatcatcaagcaaaggcaccacacagcaagcacaggctcaggagacaaagggaacaaaaaaggagccatctgctgcggaagatctattcttgcggaaattgaagatgtctgctgcgaaaaaggttggagcaacaaaggcggaactgttctgcaagacatttgaagaagcccacaacaaactagtttacaaagaactgaatttggatgctgctcaaagattcctggatgcctacaagaactgatgataaactgtcgcggatgctgctgagaggataagtctagaagtgccaatggttgacggacctggttttatgattggaaactgccgacaatgttaagatttttgatctgctttactagttcttatcttgtgggaagacgacagtgacatgtgttgtttgttggctacactactcagatgtactgtcttgtcttgacacagacaatgagaaatcaaatgcattttttc

SEQ ID NO: 987 - DNA, 655 bp, Avena sativa
gagaccaaatcgcaccggcgtcggagcggcacgaaacctagggggctaaggcgtagtcccggccgaacgccggcgagaggcggaggcagcgcgctcctcaccatggacgagcaggagttccggagcatgctcgagctcttccccgtcgtccgatcccgcgactactgcaaggctgaattggaatcatcaagcaaaggcaccacacagcaagcacaggctcaggagacaaagggaacaaaaaaggagccatctgctgcggaagatctattcttgcggaaattgaagatgtctgctgcgaaaaaggttggagcaacaaaggcggaactgttctgcaagacatttgaagaagcccacaacaaactagtttacaaagaactgaatttggatgctgctcaaagattcctggatgcctacaagaactgatgataaactgtcgcggatgctgctgagaggataagtctagaagtgccaatggttgacggacctggttttatgattggaaactgccgacaatgttaagatttttgatctgctttactagttcttatcttgtgggaagacgacagtgacatgtgttgtttattggctacactactcagatgtactgtcttgtcttgacacagacaatgagaaatcaaatgcattttttccttgc

SEQ ID NO: 988 - DNA, 689 bp, Brachypodium distachyon
ggtcgtctcgggtggactcctcgtcgtctctcctgcgagttccacaccaaatcgaaccggccggagcggcggcaccgaagccctaccaacgccggcggcgagcgacggctgactactcgtagtctgccatggacgagcaggagttccggcgcatgctagacctcttccccgtcgtccggtcccgcgactactgcaagcctgaatcggaatcatcaagcaaaggcacaacacagcaagcacgatctctgcagatagaagggcccaaaaaggagccatctgctgcggaagatctattcctgcggaaattgaagctggctgctgagaaaaaggttggagcaacaaaggcggaattgttctgcaagacatttgaagaagctcatgagaaacttgtctacaaagaactgaatcttgatgctgctcaaaggttcctggatgcctacaagagctgatgatgaaccatcgccagatgctgctcagaaatctgcaagtgctgtttttttaaatgtaaactgctaacgatgtcaatattttttatgttgcattttgtggctccattttctgtgaaggcgagtgaggattagctacactcagatgtacgctgtacgcctgtaccgtgccgtccttccagacatacatacatgagaaatcagatgcatttttctggtaattaattacagttcgcgggtttc

SEQ ID NO: 989 - DNA, 1593 bp, Brachypodium distachyon
aaagtgcacgagggcccggccgccgcgtggtcgtctcgggtggactcctcgtcgtctctcctgcgagttccacaccaaatcgaaccggccggagcggcggcaccgaagccctaccaacgccggcggcgagcgacggctgactactcgtagtctgccatggacgagcaggagttccggcgcatgctagacctcttccccgtcgtccggtcccgcgactactgcaagcctgaatcggaatcatcaagcaaaggcacaacacagcaagcacgatctctgcagatagaagggcccaaaaaggagccatctgctgcggaagatctattcctgcggaaattgaagctggctgctgagaaaaaggttggagcaacaaaggcggaattgttctgcaagacatttgaagaagctcatgagaaacttgtctacaaagaactgaatcttgatgctgctcaaaggttcctggatgcctacaagagctgatgatgaaccatcgccagatgctgctcagaaatctgcaagtgctgtttttttaaatgtaaactgctaacgatgtcaatattttttatgttgcattttgtggctccattttctgtgaaggcgagtgaggattagctacactcagatgtacgctgtacgcctgtaccgtgccgtccttccagacatacatacatgagaaatcagatgcatttttctggtaattaattacagttcgcgggtttctcctggagtgtgtgcaattcaaatcaagcggagatgaggcagtatattctctttatcttatctgagctgcttgattttctgggaattgctggcttcactaaggagcagaagaaccataccccatatctgcggaagggattctaccttctttggggttgggatatgttcaattccatgttgtctactgacccaaatctcttgagagtgcgaaccaaaataaaccctaaagatggagtatacatcggatccagatatctaacgaagtaagaaacatacatgcgcgcagccagcaaaaaggaaaaatatgggcagcaatttagccgagacaagttcaccaaatagcatcacgacaaagagttgcaacaattatatcaagttcatgatgttcctctgagcaaaaatctaacgacaccataaaacggagtcctatttcaaagcttatccgatagcatcgaaactcttgacatcttgtcttgcagtgatgacttcccggtgacccaaatcactcatggagggtacccagtatgtcattctctctgaagaggaggtactctttctcagcaccaagcttgacttcaagtcctccatactcaggcaggagaacatggtcaccttccttgaaaccaacagggatcagcttgccatccttatcgcggtcaccaggcccaacagccacgactttgccagagttcagctagatccacaggaacattctcaagtcatgggctgattcaaatttcaaaatatgaagacaaccctgatctactgatgattcctattctcaaatataatgtggcatcattcggcagcgccaataggactaagagagacaattacagacttcacagtacaactacacctagcaatcagtacaga

SEQ ID NO: 990 - DNA, 653 bp, Avena sativa
gagaccaaatcgcaccggcgtcggagcggcacgaaacctacctaggaggctaaggcgtaggcgcggcccaacgccggcgagaggcggcggcagcgtgctcctcaccatggacgagcaggagttccggagcatgctcgagctcttccccatcgtccgatcccgcgactactgcaaggctgaactggaatcatcaagcaaaggcaccacacagcaagcacgggctcaggagacaaagcgaacaaaaaaggagccatctgctgcggaagatctattcttgcggaaattgaagatgtctgctgcgaaaaaggttggagcaacaaaggcagaattgttttgcaagacatttgaagaagcccacaacaaactagtttacaaagaactcaatctggatgcggctcaaagattcctggatgcctacaagaactgatgatgaactgtcgcggatgctgctgagagataagtctgcaggtgccaatggacaacagacctggttttatgattggaaactgccgacggtgttaagatttctgatctgctttcctggttcttatcttgtgggaagacgatagtgacgtgtgttgtttattggctacactactcagatgtactgtcttgtcttgacacatacaatgagaaatcaaatgcattttttc

SEQ ID NO: 991 - DNA, 656 bp, Festuca arundinacea
  misc_feature (602)..(602): n is a, c, g, or t
  misc_feature (615)..(615): n is a, c, g, or t
ggcacgaggcggaaacctacctagtcggctaaggcgtaggcggggcccaacaccggcgaggggcggcggcggcggcggcgtgctcgtcgccatggacgagcaggagttccggagcatgctcgatctcttccccgtcgtccgatcccgcgactactgcaaggctgaattggaatcatcaagcaaaggcactgcacagcaagcacaagctcaggggacaaaaggaacaaacaaggagccatctgctgcggaagatgtcttcctgagaaaattgaagatggctgctgcgaaaaaggttggagcaacaaaggcagaattgttctgcaagacatttgaagaagcccacaacaaacttgtttacaaagaactgaatctggatgcggctcaaagattcctgaatgtctacaagaactgatgatgaactgtcgcgcatactgctgagcattccacaagtgccaatcgacctgcttttatctttggaaactgctggtgatgttaggatttctgatttgcttttctggttctcatcttgtgtgaaggtggtagagaaatccattgttgattagctgcctttctctgatgtactgtcttgtcttgacacatancattggaaatcanatgcaatatttcctggcatcacaatttgatatgtttcctct

SEQ ID NO: 992 - DNA, 2101 bp, Secale cereale
ccccttcccttgtacgtttgcaacctgctccgatccaaaagccagggaggagacacccgcaccgcaccgcatcaggcgtggtatataacctcacctcgcgcggcggcacacgcaccggcaccaccgccaccacgcacgctaccctacgcccacgcacgcaccggcgaacaatccgagctggctcttttggccacaggcacagcggatcattacccaatcacggatctctagcctcgccaccgcccgctgctccgctctgcctgctcataatctctctcgcctcgcctcgccaccgtcgcccgctgcttcttgtgtgctgccgccgcggcgagtaggcggaggaggtggaggagggggcgatgaaggagatgatggtggggtcggtggcgccggtgggcccggtcgggaggtggggggcggcgccgccgcaggagctgctggagcggatgaaggactacggccaggagggcgccttcgcgctctgggacgagctctcgcccgaggaccgcgacctcctcgtccgggacatcgagagtctagatctttcgaggattgaccggatcattcgacgctctatgggatcagaaggctatgtggcgcccgccgaacccgtgccggaatccagcgtctcgagggtggaggagaggtctccggaggacaaagaacggtggtggaagaaggggctgagagccatctccgaggggaggctggccgttgttctcttggctggtggtcaggggactcggcttggtagctcagatcctaaggggtgcttcagtattggacttccatctggaaaatcacttttccaactccaagcggaacgcattttgtgtattcaaaagttggctgctcagtccagtgatagtccaagaaatactttaccaatccactggtacataatgaccagccccttcaccgatgatgtcacacgcaaattcttcgaaagccgtaaatattttggcttagaggctgaccaggtgacctttttccaacaaggcacccttccatgtgtttctgacgatggcagatttattatggagacgccatacaaggtagccaaggcacctgatggaaatggaggagtttatgccgctctgaagtctaagaagttgcttgacgatatgtcttcacggggtgtaaagtatgtagattgctacggagttgataacgtattggttcgtgttgcggatccaacgttcctagggtactttatagaaaagggtgtatcttctgctgcgaaggttgttaggaaggcttatccacaagagaatgttggagtatttgttcaaagaggtcgtggtggacctctttccgtggtcgagtatagtgaaatggatgcggctatgactactgaaattaatcaatcaacaggacgccttcgttattgttggagcaatgtatgcttgcatatgttcagtttggaatttctgaatcaagtcgcaaacagccttgaaaaggacagtgtgtatcatcttgcgcagaagaagataccttcaattcatgggtatacaatgggtctgaagcttgagcagttcatattcgatgcattcaattactccccgtccacgacactttttgaggtgctacgcgaagaggagtttgctccagtgaagaacgcgaatggctcagcctacgacacccccgatagcgccaaactgatgctgctccgactccacagcagatgggtagtcgctgctggcggcttcctgacccattccgtgcccttgtacatgacaggcgtcgaggtttctccgctcagctcctacgccggggaaaacctggaggcgatctgccgcgggcggacattccacgcgcccagcgagatctcgttctaggcgcatcggttcgtgacagcggcagcagatggaggaagcagtactgcacagggattgcaaggtcgaacgaatgcctcgcggtttgggccattggttgtattgagctgagctctttgagctgttggcattagggtttcaggtactggccagactgttgtatcttttgtgagtaattggcccggattctgaatgcgtcttggcttttgccgtttgtaactctttttggctgttgctgcccctttagatgagcatcttcaactgtg

SEQ ID NO: 993 - DNA, 2051 bp, Secale cereale
agctggctcttttggccacaggcacagcggatcattacccaatcacggatctctagcctcgccaccgcccgctgctccgctctgcctgctcataatctccctcgcctcgcctcgcctcgccaccgtcgcccgctgcttcttgtgtgctgccgccgcggcgagtaggcggaggaggtggaggagggggcgatgaaggagatgatggtggggtcggtggcgccggtgggcccggtcgggaggtggggggcggcgccgccgcaggagctgctggagcggatgaaggactacggccaggagggcgccttcgcgctctgggacgagctctcgcccgaggaccgcgacctcctcgtccgggacatcgagagtctagatctttcgaggattgaccggatcattcgacgctctatgggatcagaaggctatgtggcgcccgccgaacccgtgccggaatccagcgtctcgagggtggaggagaggtctccggaggacaaagaacggtggtggaagaaggggctgagagccatctccgaggggaggctggccgttgttctcttggctggtggtcaggggactcggcttggtagctcagatcctaaggggtgcttcagtattggacttccatctggaaaatcacttttccaactccaagcggaacgcattttgtgtattcaaaagttggctgctcagtccagtgatagtccaagaaatactttaccaatccactggtacataatgaccagccccttcaccgatgatgtcacacgcaaattcttcgaaagccgtaaatattttggcttagaggctgaccaggtgacctttttccaacaaggcacccttccatgtgtttctgacgatggcagatttattatggagacgccatacaaggtagccaaggcacctgatggaaatggaggagtttatgccgctctgaagtctaagaagttgcttgacgatatgtcttcacggggtgtaaagtatgtagattgctacggagttgataacgtattggttcgtgttgcggatccaacgttcctagggtactttatagaaaagggtgtatcttctgctgcgaaggttgttaggaaggcttatccacaagagaatgttggagtatttgttcaaagaggtcgtggtggacctctttccgtggtcgagtatagtgaaatggatgcggctatgactactgaaattaatcaatcaacaggacgccttcgttattgttggagcaatgtatgcttgcatatgttcagtttggaatttctgaatcaagtcgcaaacagccttgaaaaggacagcgtgtatcatcttgcgcagaagaagataccttcaattcatgggtatacaatgggcctgaagcttgagcagttcatattcgatgcattcaattactccccatccacgacactttttgaggtgctacgcgaagaggaatttgctccagtgaagaacgcgaatggctcagcctacgacacccccgatagcgccaaactgatgctgctccgactccacagcagatgggtagtcgctgctggcggcttcctgacccattccgtgcccttgtacatgacaggcgtcgaggtttctccgctcagctcctacgccggggaaaacctggaggcgatctgccgcgggcggacattccacgcgcccagcgagatctcgttctaggcgcatcggttcgtgacagcggcagcagatggaggaagcagtactgcacagggattgcaaggtcgaacgaatgcctcgcagtttgggacattggttgtattgagctgagctctttgagctgtcggcattagggtttcaggtactggccagactgttgtatcttttgtgagtaattggcccggattctgaatgcgtcttggcttttgccgtttgtaactcttttggctgttgctgcccctttagatgagcatcttcaactgtactactaatttggtgccccatttatccgcgatcacgtttaggcagtgttcgctctgaaccccatttatctgtgcacgcagccttgtcctatcaaattgcctggacacatatataattggcgg

SEQ ID NO: 994 - DNA, 1941 bp, Secale cereale
cgcaccggcgaacaatccgagctggctcttttggccacaggcacagcggatcattacccaatcacggatctctagcctcgccaccgcccgctgctccgctctgcctgctcataatctccctcgcctcgcctcgcctcgccaccgtcgcccgctgcttcttgtgtgctgccgccgcggcgagtaggcggaggaggtggaggagggggcgatgaaggagatgatggtggggtcggtggcgccggtgggcccggtcgggaggtggggggcggcgccgccgcaggagctgctggagcggatgaaggactacggccaggagggcgccttcgcgctctgggacgagctctcgcccgaggaccgcgacctcctcgtccgggacatcgagagtctagatctttcgagggttgaccggatcattcgacgctctatgggatcacaaggctatgtggcgcccgccgaacccgtgccggaatccagcgtctcgagggtcgaggagaggtctccggaggacaaagaacggtggtggaagaaggggctgagagccatctccgaggggaggctggccgttgtccttttggctggtggtcaggggactcggcttggtagctcagatcctaaggggtgcttcagtattggccttccatctggaaaatcacttttccaactccaagcggaacgcattttgtgtattcaaaagttggctgctcagtccagtgatagtccaagaaatactttaccaatccactggtacataatgaccagccccttcaccgatgatgtcacacgcaaattcttcgaaagccgtaaatattttggcttagaggctgaccaggtgacctttttccaacaaggtacccttccatgtgtttctgacgatggcagatttattatggagacgccatacaaggtagccaaggcacctgatggaaatggaggagtttatgccgctctgaagtcgaagaagttgctcgacgatatgtcttcacggggtgtaaagtatgtagattgctacggagttgataacgtattggttcgtgttgcagatccaacgttcctagggtactttatagaaaagggtgtatcttctgctgcgaaggttgttaggaaggcttatccacaagagaatgttggagtatttgttcaaagaggtcgtggtggacctctttccgtggtcgagtatagtgaaatggatgcggctatgactactgaaattaatcaatcaacaggacgccttcgttattgttggagcaatgtatgcttgcatatgttcagtttggaatttctgaatcaagtcgcaaacagccttgaaaaggacagtgtgtatcatcttgcgcagaagaagataccttcaattcatgggtatacaatgggcctgaagcttgagcagttcatattcgatgcattcaattactctccctccacgacactttttgaggtgctgcgcgaagaggaatttgctccagtgaagaacgcgaatggctcagcctacgacacccccgacagcgccaaactgatgctgctccgactccacagcagatgggtggtcgctgctggcggcttcctgacccattccgtgcccttgtacatgacaggcgtcgaggtttctccgctcagctcctacgccggggaaaacctggaggcgatctgccgcgggcggacattccacgcgcccagcgagatctcgttctaggcgcatcggctcgtgacagcggcagcagatggaggaagcagtactgcacaggcattgcaaggtcgaacgaatgctcgcagtttgggacattggttgtattgagctgagctctttgagctgtcggcattagggtttcaggtactggccagactgttgtatcttttgtgagtaaattggcccggattctgaatgcgtcttggcttttgccgtttgtaactcttttggctgttgctgcctctttagatgagcatctt

SEQ ID NO: 995 - DNA, 1964 bp, Triticum aestivum
cgaggaggaggagatgaaggagatgatggtggggtcggtggcgccggtgggcccggtcgggaggtggggcgcggcgccgccgcaggagctgctggagcggatgaaggactacggccaagagggcgccttcgcgctctgggacgagctctcgcccgaggaccgcgacctcctcgtccgggacatcgagagtctggatctttcgaggattgaccggatcattcgacgctctatgggatcacaaggaggctatctggcgcccgccgagcccgtgccggaatccagcgtgtcgagggtggaggagaggtctccggaggacaaagaacggtggtggaagaaggggctgagagccatctcggaggggaggctggccgttgtccttttggctggtggtcaggggactcggcttggtagctcagatcctaaggggtgtttcagtattggccttccatctggaaaatcacttttccaactccaagcggaacgcattttgtgtattcaaaagttggctgctcagtccagtgacagtccaagaaatactttaccaatccactggtacataatgaccagccccttcaccgatgatgtcacacgcaaattctttgaaagctgtaaatattttggcttagaggctgaccaggtgacctttttccaacaaggcacccttccatgtgtttctgacgatggcagatttattatggagacgccatacaaggtagccaaggcacctgatggaaatggaggagtttatgccgctctgaagtctaagaagttgcttgacgatatgtcttcacggggtgtaaagtatgtagattgctacggagttgataacgtattggttcgcgttgcagatccaaccttcctagggtactttatagaaaagggtgtatcttctgctgcgaaggttgttaggaaggcttatccacaagagaatgttggagtatttgttcaaagaggccgtggtggacctctttccgtggtcgagtatagtgaaatggatgcggctatgactactgaaattaatcaatcaacaggacgccttcgttattgttggagcaatgtatgcttgcatatgttcagtttggaatttctgaatcaagtcgcaaacagccttgaaaaggacagcgtgtatcatcttgcacagaagaagataccttcgattcatgggtatacaatgggcctgaagcttgagcagttcatattcgatgcattcaattactccccgtccacgacgcttttcgaggtgctacgcgaagaggaatttgctccagtgaagaacgcgaatggctcagcctacgacacccccgatagcgccaaactgatgctgctccgactccacagcagatgggtagtcgctgctggcggcttcctgacccattctgtgcccttgtacatgacaggcgtcgaggtttctccgctcagctcctacgccggagaaaacctggaggcgatctgccgcggacggacattccacgcgcccagcgagatctcgttctaggcgcatcagttcacgacagtggcagcaaatggaggaagcagtattgcacagggattgcaaggtcgaacgaatgctcgcagttgacattggttgtattgagctgagctctttgagctattggcattagggttttcaggtactgggcagactgttgtatcttttgtgagtaaattggcccagattctgaatgcgtcttggcttttgccatttgtaactcttttcgctgttgctgcccctttagatgagcatcttcaactgtactaatttggtgccccatttatctgctgtcacgttcgaacaaaaagaaaagtcactgcacgtctcgtcggtttcgattaacccccccgttacgaccgtacgggacccgttaaacctccgtaaacgtacgaaacggtaacgtccgaccccgaaaacggggaccaaaccggtaaccggtaaagggggaacgttaaggggccgctccccccca

SEQ ID NO: 996 - DNA, 2005 bp, Triticum aestivum
gcggcccacgcccacgcacgcaccggcgaacagtccgagctggctcttttggcctggccataggcacagcggatcattacccaatcacggatctctagcctcgcctcgccaccgcccgctgctccgctctcctctgcctgctcataatctccctcgcgtcgccaccgtccgccgcttcttgcgtgctgccgccgcggcgaggaggaggagatgaaggagatgatggtggggtcggtggcgccggtgggcccggtcgggaggtggggcgcggcgccgccgcaggagctgctggagcggatgaaggactacggccaagagggcgccttcgcgctctgggacgagctctcgcccgaggaccgcgacctcctcgtccgggacatcgagagtctggatctttcgaggattgaccggatcattcgacgctctatgggatcacaaggaggctatctggcgcccgccgagcccgtgccggaatccagcgtgtcgagggtggaggagaggtctccggaggacaaagaacggtggtggaagaaggggctgagagccatctcggaggggaggctggccgttgtccttttggctggtggtcaggggactcggcttggtagctcagatcctaaggggtgtttcagtattggccttccatctggaaaatcacttttccaactccaagcggaacgcattttgtgtattcaaaagttggctgctcagtccagtgacagtccaagaaatactttaccaatccactggtacataatgaccagccccttcaccgatgatgtcacacgcaaattctttgaaagctgtaaatattttggcttagaggctgaccaggtgacctttttccaacaaggcacccttccatgtgtttctgacgatggcagatttattatggagacgccatacaaggtagccaaggcacctgatggaaatggaggagtttatgccgctctgaagtctaagaagttgcttgacgatatgtcttcacggggtgtaaagtatgtagattgctacggagttgataacgtattggttcgcgttgcagatccaaccttcctagggtactttatagaaaagggtgtatcttctgctgcgaaggttgttaggaaggcttatccacaagagaatgttggagtatttgttcaaagaggccgtggtggacctctttccgtggtcgagtatagtgaaatggatgcggctatgactactgaaattaatcaatcaacaggacgccttcgttattgttggagcaatgtatgcttgcatatgttcagtttggaatttctgaatcaagtcgcaaacagccttgaaaaggacagcgtgtatcatcttgcacagaagaagataccttcgattcatgggtatacaatgggcctgaagcttgagcagttcatattcgatgcattcaattactccccgtccacgacgcttttcgaggtgctacgcgaagaggaatttgctccagtgaagaacgcgaatggctcagcctacgacacccccgatagcgccaaactgatgctgctccgactccacagcagatgggtagtcgctgctggcggcttcctgacccattctgtgcccttgtacatgacaggcgtcgaggtttctccgctcagctcctacgccggagaaaacctggaggcgatctgccgcggacggacattccacgcgcccagcgagatctcgttctaggcgcatcagttcacgacagtggcagcaaatggaggaagcagtattgcacagggattgcaaggtcgaacgaatgctcgcagttgacattggttgtattgagctgagctctttgagctattggcattagggttttcaggtactgggcagactgttgtatcttttgtgagtaaattggcccagattctgaatgcgtcttggcttttgccatttgtaactcttttcgctgttgctgcccctttagatgagcatcttcaactgtactaatttggtgccccatttatctgctgtcacgttccgacagtgtccgctctga

SEQ ID NO: 997 - DNA, 1987 bp, Triticum aestivum
ctacgcggcccacgcccacgcacgcaccggcgaacaatccgagctggctcttttggcctggccataggcacagcggatcattacccaatcacggatctctagcctcgccaccgcccgctgctccgctctgcctgctcataatctccctcgcctcgccaccgtcgcccgctgcttcttgcgtgctgccgccgcggcgaggaggaggaggacgagcggatgaaggagatgatggtggggtcggtggcgccggtgggcccggtcgggaggtggggggcggcgccgccgcaggagctgctggagcggatgaaggactacggccaggagggcgccttcgcgctctgggacgagctctcgcccgaggaccgcgacctcctcgtccgggacatcgagagtctggatctttcgaggattgaccggatcattcgacgctctatgggatcacaaggaggctatctggcgcccgccgagcccgtgccggaatccagcgtgtcgagggtggaggagaggtctccggaggacaaagaacggtggtggaagaaggggctgagagccatctccgaggggaagctggccgttgtccttttggctggtggtcaggggactcggcttggtagctcagatcctaaggggtgtttcagtattggacttccatccgggaaatcacttttccaactccaagcggaacgcattttgtgcattcaaaagctggctgctcagtccagtgatagtccaagaaatactttaccaatccactggtacataatgaccagcccctttactgatgatgtcacacgcaaattctttgaaagccgtaaatattttggcttagaggctgaccaggtgacctttttccaacaaggcactcttccatgtgtttctgatgatggcagatttattatggagacgccatacaaggtagccaaggcacctgatggaaatgggggagtttatgccgctctgaagtctaagaagttgcttgacgatatgtcttcacggggtgtaaagtatgtagattgctacggagttgataacgtattggttcgtgttgcagatccaacgttcctagggtactttatagaaaagggtgtatcttctgccgcgaaggttgttaggaaggcttatccacaagagaatgttggagtatttgttcaaagaggtcgtggtgggcctctttccgtggtcgagtatagtgaaatggatgcggctatgactactgaaattaaccaatcaacaggacgccttcgttattgttggagcaatgtatgcttgcatatgttcagtttggaatttctgaatcaagtcgcgaacagccttgaaaaggacagtgtgtatcatcttgcacagaagaagataccctcgattcatgggtatacaatgggcctgaagcttgagcagttcatattcgatgcattcaattactccccgtccacgacactttttgaggtgctacgtgaagaggaatttgctccagtgaagaacgcgaatggctcagcgtacgacaccccggatagcgccaaactgatgctgctccgactccacagcagatgggtagtcgctgctggcggcttcctgacccattctgtgcctttgtacatgacaggcgtcgaggtttctccgctcagctcctatgccggagaaaacctggaggcgatctgccgcggacggacattccacgcgcccagcgagatctcgttctaggcgcatcggttcgtgacagcggcagcagatggaggaagcagtttgggacagcggcacagggattgcaaggtcgaatcgaatgcctcgcagtttgggacattggtggtgtattgagcggagctctttgagctgttggcattagggttttcaggcactggccagactgttgtatcttttgtgagtaattggcccagattctgaatgcgtcttggcttttgccatttgtaactcttttggctgttgctgcccctttagatgagcattttcaattgtactaatttggtgcccc

SEQ ID NO: 998 - DNA, 1856 bp, Triticum aestivum
cggatctctagcctcgcctcgccaccgcccgctgctccgctctcctctgcctgctcataatctccctcgcgtcgccaccgtccgccgcttcttgcgtgctgccgccgcggcgaggaggaggagatgaaggagatgatggtggggtcggtggcgccggtgggcccggtgggaggtggggcgcggcgccgccgcaggagctgctggagcggatgaaggactacggccaagagggccccttcgcgctctgggacgagctctcgcccgaggaccgcgacctcctcgtccgggacatcgagagtctggatctttcgaggattgaccggatcattcgacgctctatgggatcacaaggaggctatctggcgcccgccgagcccgtgccggaatccagcgtgtcgagggtggaggagaggtctccggaggacaaagaacggtggtggaagaaggggctgagagccatctccgaggggaagctggccgttgtccttttagctggtggccaggggactcggcttggtagctcagatcctaaggggtgtttcagtattggacttccatccgggaaatcacttttccaactccaagcggaacgcattttgtgcattcaaaagctggctgctcagtccagtgatagtccaagaaatactttaccaatccactggtacataatgaccagcccctttactgatgatgtcacacgcaaattctttgaaagccgtaaatattttggcttagaggctgaccaggtgacctttttccaacaaggcactcttccatgtgtttctgatgatggcagatttattatggagacgccatacaaggtagccaaggcacctgatggaaatgggggagtttatgccgctctgaagtctaagaagttgcttgacgatatgtcttcacggggtgtaaagtatgtagattgctacggagttgataacgtattggttcgtgttgcagatccaacgttcctagggtactttatagaaaagggtgtatcttctgctgcgaaggttgttaggaaggcttatccacaagagaatgttggagtatttgttcaaagaggtcgtggtgggcctctttccgtggtcgagtatagtgaaatggatgcggctatgactactgaaattaaccaatcaacaggacgccttcgttattgttggagcaatgtatgcttgcatatgttcagtttggaatttctgaatcaagtcgcgaacagccttgaaaaggacagtgtgtatcatcttgcacagaagaagataccctcgattcatgggtatacaatgggcctgaagcttgagcagttcatattcgatgcattcaattactccccgtccacgacactttttgaggtgctacgtgaagaggaatttgctccagtgaagaacgcgaatggctcagcctacgacacccccgatagcgccaaactgatgctgctccgactccacagcagatgggtagtcgctgctggcggcttcctgacccattctgtgcccttgtacatgacaggcgtcgaggtttctccgctcagctcctacgccggagaaaacctggaggcgatctgccgcggacggacattccacgcgcccagcgagatctcgttctaggcgcatcagttcacgacagtggcagcaaatggaggaagcagtattgcacagggattgcaaggtcgaacgaatgctcgcagttgacattggttgtattgagctgagctctttgagctattggcattagggttttcaggtactggccagactgttgtattcttttgtagtaagttaaattaggacccagattctgaatgcgtcttgcttgctattgtaacttctttcgcttgttgctcgtcccttagatgagtc

SEQ ID NO: 999 - DNA, 1933 bp, Brachypodium distachyon
cagaggaagagaacgatccgagctggctctctctgccactgccagccactgagcatcattacccaatcacggatctctcgtcccctctcttcttgcagctgctctgctgccgccgctgcttctcttccaattcttcttgttgtgtttgcggttgaagagggagaggatgaaggagatgctggtgggttcggcgtcgccggtggggcctgtgggtaggtggggggcggcgccgccgcaggcgctgctggagaggatgaaggactacgggcaggagggcgcgttcgcgctctgggacgagctcttgcccgaggaacgggacctcctcgtccgggacatcgagagtctagatctttcaaggattgatcggatcattcgacgctcccttggatcacaaggctttttactgcccgcgatcgagcccgtgccggaatccagtgtctcgagggtggaggagaggtctccagaggacaaagaacggtggtggaagagggggctgagagccatttcagaggggaagctggccattgtacttttggctggtggtcagggaactcggcttggaagctccgatcccaagggatgtttcaatattggacttccatctggaaaatcacttttccaactccaagctgaacgcattttgtgtgttcaaaagttggctgctcaatctagcgatactcctggtaacattttaccaatccactggtatataatgaccagccccttcactgatgatgtcacacgcaaattcttcgagagccgtaaatattttggcttagaggctgaacaagtgacatttttccaacaaggcacccttccatgcatttctgctgatggcagatatattatggagacgccatacaaggtagcaaaggctcctgacggcaatggaggagtttattccgccctgaagtctaagaagttgcttgaagatatgtctgcacggggtgtaaaatatgtagattgctacggagttgataacgcactggttcgtgttgcagatccaacattcctaggctacttcatagaaaaaggtgtatcttctgctgcaaaggttgttaggaaggcttatccacaagagaatgtaggagtgtttgttcaacggggtcgtggcggacctctttctgtggtagagtatagtgaaatggatgcggctatgactacggaaattaatcaatcaacaggacgccttcgttattgttggagcaacgtgtgcttgcatatgttcacgttggactttctgaatcaagtggcaaacagccttgaaaaggacagtgtttaccatcttgccgagaagaagataccttccattcatgggtgcacaatgggcctgaagcttgaacagttcatatttgacgccttcacttactccccatccacaacacttttcgaggtttcgcgtgaagaggaatttgcaccggtgaagaacgctaacggtgcaacttatgacacccctgatagcgccaaactaatgctgcttcgtctccaaagcagatgggtagttgctgctggcggcttcctgacgcattcagtgcccttgtatatgacaggcgtggaggtttctccgctgagctcctacgccggcgaaaacctggaggcgatctgccgagggcggacattccacgcgcccagtgagatctcattctagatgtaagcgttcaacaagagctccggcaaacggaggaattatatctggggatttcctcagtctagatgcaagtgttcaacgacagctcctacaaacggaggaattagatctgggatttgcacgtatagttgagtggagggagttagtgcctgcctgggagttgcgtgtatattgtcgagatggttggaacgacatatatacattatttatccctgtattactggactggtaaatgaataacatgcaaggatgaataattagttgatgaatatatgcggtttcatc

SEQ ID NO: 1000 - DNA, 2299 bp, Brachypodium distachyon
gtccgtttgtatctacgccaaggctaccagctccaatcaagaatccagggagaaagagacacctgccctgccccggatgccgcgccgcacacagcacaggcatcacgcacgcgcccatggtatataacccgcgggcggcccacactccggcgaccagaccagaccaccagaggaagagaacgatccgagctggctctctctgccactgccagccactgagcatcattacccaatcacggatctctcgtcccctctcttcttgcagctgctctgctgccgccgctgcttctcttccaattcttcttgttgtgtttgcggttgaagagggagaggatgaaggagatgctggtgggttcggcgtcgccggtggggcctgtgggtaggtggggggcggcgccgccgcaggcgctgctggagaggatgaaggactacgggcaggagggcgcgttcgcgctctgggacgagctcttgcccgaggaacgggacctcctcgtccgggacatcgagagtctagatctttcaaggattgatcggatcattcgacgctcccttggatcacaaggctttttactgcccgcgatcgagcccgtgccggaatccagtgtctcgagggtggaggagaggtctccagaggacaaagaacggtggtggaagagggggctgagagccatttcagaggggaagctggccattgtacttttggctggtggtcagggaactcggcttggaagctccgatcccaagggatgtttcaatattggacttccatctggaaaatcacttttccaactccaagctgaacgcattttgtgtgttcaaaagttggctgctcaatctagcgatactcctggtaacattttaccaatccactggtatataatgaccagccccttcactgatgatgtcacacgcaaattcttcgagagccgtaaatattttggcttagaggctgaacaagtgacatttttccaacaaggcacccttccatgcatttctgctgatggcagatatattatggagacgccatacaaggtagcaaaggctcctgacggcaatggaggagtttattccgccctgaagtctaagaagttgcttgaagatatgtctgcacggggtgtaaaatatgtagattgctacggagttgataacgcactggttcgtgttgcagatccaacattcctaggctacttcatagaaaaaggtgtatcttctgctgcaaaggttgttaggaaggcttatccacaagagaatgtaggagtgtttgttcaacggggtcgtggcggacctctttctgtggtagagtatagtgaaatggatgcggctatgactacggaaattaatcaatcaacaggacgccttcgttattgttggagcaacgtgtgcttgcatatgttcacgttggactttctgaatcaagtggcaaacagccttgaaaaggacagtgtttaccatcttgccgagaagaagataccttccattcatgggtgcacaatgggcctgaagcttgaacagttcatatttgacgccttcacttactccccatccacaacacttttcgaggtttcgcgtgaagaggaatttgcaccggtgaagaacgctaacggtgcaacttatgacacccctgatagcgccaaactaatgctgcttcgtctccaaagcagatgggtagttgctgctggcggcttcctgacgcattcagtgcccttgtatatgacaggcgtggaggtttctccgctgagctcctacgccggcgaaaacctggaggcgatctgccgagggcggacattccacgcgcccagtgagatctcattctagatgtaagcgttcaacaagagctccggcaaacggaggaattatatctggggatttcctcagtctagatgcaagtgttcaacgacagctcctacaaacggaggaattagatctgggatttgcacgtatagttgagtggagggagttagtgcctgcctgggagttgcgtgtatattgtcgagatggttggaacgacatatatacattatttatccctgtattactggactggtaaatgaataacatgcaaggatgaataattagttgatgaatatatgcggtttcatcatgcgtatgcatcctcctgcggcaatgcccttgcaaaatgcaaactgtggaattatatgttttgctatgcttgtgctgggtggagagtttgatgcagtagtgaaatgtgtgataaacatctgcaataatcgatactacaagagataaggataaatatgcaactatatgtatgcacaaataatcagggattttttccgac

SEQ ID NO: 1001 - DNA, 2157 bp, Oryza sativa
cttgtgctttcgatgtcagcgaggagagaagagaagcaaaattagctgaacaccgcacgcaatcagaggaggtatataaagggcgcgaacacgcgcacacgccggcggcgatccaagaacaatccatccatccgattcgccgttcgtccgagttggcattcctccatctcttctcctcttcttgcgcagcgcgccattgctgcagtcacagatctctctctagtcccaccattttctttcttgggtgaggagaagggagggggagggatgaaggagatagtggttgggtcggtggcggcggcggcggcggtggggaggtggggagcggcgccgccgcaggcgatgctggagaggatgaaggattacgggcaggagggcgcgttcgcgctctgggacgagctctcgcccgaggaccgggagctgctcgtcagggacatcgagagcctggatctttcaaggattgatcggatcatccggcgctcccttggatcacaaggattcactttgcccaccgtcgagccggtgccggagtccagcgtgtccaaggtggaggagaggttgccggaggacaaagaacggtggtggaagaaggggctgaaggccatttcggaggggaagctagccgtcgtccttttagccggtggtcaggggactcggcttggtagctctgatcctaaaggatgtttcagtatcggacttccgtctggaaagtcgcttttccaactccaagctgaacggattttgtgtgttcaaaagcttgctgctcaatcaagtgatagtccaaataacaccgtacctattcattggtatataatgaccagccccttcaccgatgacatcactcgcaaattcttcgaaagccgtaaatactttggcttagaggcagaccaagtgacatttttccaacaaggcacccttccatgtgtttctgctgatggcagatttattatggagacaccatacaaggtagcaaaggctcctgatggcaatggtggagtttatgctgccctcaagtccagaaggttgctggaagatatgtcttcacggggtgtaaagtatgtagattgctacggggttgacaatgcactggtccgcgttgctgatccgacgttcctaggttacttcatagacaaagctgtatcttctgctgcaaaggttgttaggaaggcttacccacaagagaatgttggagtatttgttcgacgaggacgtggtggacctctctctgtagttgagtatagtgaaatggacgcagctatggctactgaaattaatcagtcaacgggacgccttcgttattgttggagcaatatttgcttgcatatgttcactttggattttttgaatcaagtagcaaacagccttgagaaggacagtacttatcatcttgctgagaagaagatcccttccatccatgggtacgcaatgggcttgaagcttgaacagtatatattcgacgcgttcagttactccccatccacagcactttttgaggttttgcgggaggaggaatttgcgcctgtaaagaatgcgaatggcgcgtcttatgatacccctgatagcgcaaagctgatgctgcttcgtctccatagtagatgggtagttgctgctggtggcttcttgacccattctgtcccattgtacatgacaggtgtggaagtttctccacttagctcctatgctggagaaaacttggaagccatttgccgcggacggacattccatgcgccgagtgagatttccttctaggtgacctgtgacacaaacagctctgtaacttcaaatttgtggaacagtggcagagaaaggattgcaggatttcatctcaaacagaaaaaaaaaaaagatcacagggtttccattttccctatgtcatgggatgaatggatgctgtacagttcagtgagctcctcagatattggccgggttgttttatgttgtgtcatctgtgagtattgtaatgtagcccccaaaattctaaggccatcttgattttcacacaaaaacatttgtgtggcagtgccattttggtttctcctgtagtcctgtgttgctcccatgtaatctgtagatgttttttcccccttcaaaacaatatagatctttgaatgcccatgatttcatttcagagaaacatgcatttgaactgtccaactc

SEQ ID NO: 1002 - DNA, 2035 bp, Oryza sativa
atgtgggcccattccagggtgctgctgctggggagtcacgaggggtttgacactgtttgctggtgcctgaacccgtgtgaccgacagtctcgcgccattgctgcagtcacagatctctctctagtcccaccattttctttcttgggtgaggagaagggagggggagggatgaaggagatagtggttgggtcggtggcggcggcggcggcggtggggaggtggggagcggcgccgccgcaggcgatgctggagaggatgaaggattacgggcaggagggcgcgttcgcgctctgggacgagctctcgcccgaggaccgggagctgctcgtcagggacatcgagagcctggatctttcaaggattgatcggatcatccggcgctcccttggatcacaaggattcactttgcccaccgtcgagccggtgccggagtccagcgtgtccaaggtggaggagaggttgccggaggacaaagaacggtggtggaagaaggggctgaaggccatttcggaggggaagctagccgtcgtccttttagccggtggtcaggggactcggcttggtagctctgatcctaaaggatgtttcagtatcggacttccgtctggaaagtcgcttttccaactccaagctgaacggattttgtgtgttcaaaagcttgctgctcaatcaagtccaaataacaccgtacctattcattggtatataatgaccagccccttcaccgatgacatcactcgcaaattcttcgaaagccgtaaatactttggcttagaggcagaccaagtgacatttttccaacaaggcacccttccatgtgtttctgctgatggcagatttattatggagacaccatacaaggtagcaaaggctcctgatggcaatggtggagtttatgctgccctcaagtccagaaggttgctggaagatatgtcttcacggggtgtaaagtatgtagattgctacggggttgacaatgcactggtccgcgttgctgatccgacgttcctaggttacttcatagacaaagctgtatcttctgctgcaaaggttgttaggaaggcttacccacaagagaatgttggagtatttgttcgacgaggacgtggtggacctctctctgtagttgagtatagtgaaatggacgcagctatggctactgaaattaatcagtcaacgggacgccttcgttattgttggagcaatatttgcttgcatatgttcactttggattttttgaatcaagtagcaaacagccttgagaaggacagtacttatcatcttgctgagaagaagatcccttccatccatgggtacgcaatgggcttgaagcttgaacagtatatattcgacgcgttcagttactccccatccacagcactttttgaggttttgcgggaggaggaatttgcgcctgtaaagaatgcgaatggcgcgtcttatgatacccctgatagcgcaaagctgatgctgcttcgtctccatagtagatgggtagttgctgctggtggcttcttgacccattctgtcccattgtacatgacaggtgtggaagtttctccacttagctcctatgctggagaaaacttggaagccatttgccgcggacggacattccatgcgccgagtgagatttccttctaggtgacctgtgacacaaacagctctgtaacttcaaatttgtggaacagtggcagagaaaggattgcaggatttcatctcaaacagaaaaaaaaaaaagatcacagggtttccattttccctatgtcatgggatgaatggatgctgtacagttcagtgagctcctcagatattggccgggttgttttatgttgtgtcatctgtgagtattgtaatgtagcccccaaaattctaaggccatcttgattttcacacaaaaacatttgtgtggcagtgccattttggtttctcctgtagtcctgtgttgctcccatgtaatctgtagatgttttttcccccttcaaaacaatatagatctttgaatgcccatgatttcatttcagagaaacatgca

SEQ ID NO: 1003 - DNA, 1851 bp, Setaria italica
cttgtcggcgccagggcgaccggcgatccgagaacaatccgtcgtccgagttggcatctttggccaaatcagtatcattgcccaatcacagatctcttctctccctctctaatctctctctcctcctccctctcatctcccactacctgctcctgctgctttgcttgtgcgcttcgagggaagagaggagacgagatgaaggaggagatggtggtgggcttgtcggcgccggggccggtggggaggtggggcgccgcgccgccgcaggcgctgctggagaggatgaaggactacggccaggagggcgccttcgcgctctgggacgatctctcgcccgaggaccgggagctcctcgtccgggacatcgagagtatagacctttcaaggatcgatcggatcattcgacgctcacttggatcacaaggcatgccgctgcctgccgtggagcccgtgccggaatccagtgtctccaaggtggaggacaggtctccggaggacaaagaaagatggtggaagaaggggctgaaagccatctcggaggggaagctggctgttgtccttttggccggtggtcagggcacacgacttggaagctcagatcctaagggatgtttcaatattggacttccatctggaaagtcacttttccaactccaagctgaacggattttgtgtgttcaaaagctggctgctcaatctagtgaaagtccgagtaacactgtgccaatccactggtatataatgacaagcccctttacggatgctgccactcgcaaattctttgaaacccgtagatattttggcttagacgctgaccaagtgacatttttccaacaaggcacacttccatgcatttctgctgatggtagatttattatggagacaccatataaggtagcaaaggctcctgatggcaatggtggagtttatgctgcactgaagtccaaaaagttgatggaagatatggctgcacgtggtgtgaaatatgtagattgctacggagtagacaatgcactggttcgtgttgcagatccaacattcttagggtacttcattgacaaaggtgtatcctctgctgctaaagtggttaggaaggcttatccacaagagaacgtaggggtatttgttcaacgaggtcgtggtggacctctctctgtggttgagtacagtgaaatggatgcagctatgactactgaaattaatcaatcaacagggcgccttcgctattgttggagcaatatctgcctgcatatgttcactttggactttttgaaccaagtggcaaacagccttgaaaaggacagtgtatatcatctagctgagaagaagattccttccatccatgggtatacaacaggcctgaagcttgaacagtttatattcgatgctttcacttactccccatccacagcactttttgaggtcatgcgggaagaggaatttgcaccagtaaagaatgccaacggcgcaacatatgacacccctgatagtgcgaaactcatgctgctccgtctccatagtagatgggtcgtcgctgctggcggcttcttgacacattctgtgcccttgtatatgacaggcgtcgaagtttctccgctttcctcctacgctggagagaacctggaagcaatctgccgtgggcgaacattccatgcgccaagtgagatatcgttttaggtagggctgttcatgacagcaagagctgtgtaactgcaaagcgaatttaaaggattgcaggatgtgcatgttccctttctaggcaagagatgggtgtggatggacaggttgttgtatacttgtatgtcatgtaatgtagcccccgaattccgaattcatcgtgagttttctccc

SEQ ID NO: 1004 - DNA, 2012 bp, Panicum virgatum
tgctcgcgtccaaattaatccagaggtatgagatgagagtgaggctgatacatacacagggatcacgcgccgtatataaacgcgccgcgcaggcggcccacccaccgccggcgatccgagaacaatccgttgtccgagttggcatctttggccaaacccaaaccagtatcattgcccaatcacagatctctccccctctctctaatctcactttctcgccttctccctctcatctcccactacctgctcctgctgctttgcttgtgcgctgcgagaggagagaagagacgggatgaaggaggagatggtggtgggcttgtcggcgccggggcccgtggggaggtggggcgccgcgccgccgcaggcgctgctggagaggatgaaggactacgaccaggaaggcgccttcgcgctctgggacgatctctcgcccgaggaccgggagctcctcgtccgggacatcgagagtatagatctttcaaggatcgatcggatcattcgacgctcacttggatcacaaggcatgccgcttccggccgtggagcccgtgccagaatccagtgtctccaaggtggaggacaggtctccagaggacaaagaaagatggtggaagaaggggctgaaagccatctccgaggggaagctggccgttgtccttttagccggtggtcagggcactcgacttggaagctcagatcctaagggatgtttcaatattgggcttccatctggaaagtcacttttccaactccaagctgaacggattttgtgcgttcaaaagctggctgctcaatctagtgaaagtccaagtaacactatgccgatccactggtatataatgacaagcccctttacggatgctgccactcgcaaattctttgaaacccgtagatattttggcttagacgctgatcaagtgacatttttccaacaaggcacacttccatgtgtttcggctgatggtagatttattatggagacaccatatagggtagcgaaggctcctgatggcaatggtggagtatatgctgctttgaagtccaaaaagttgatggaagatatggctgcacgaggtgtgaaatatgtagattgctatggagttgacaatgcactggttcgtgttgcagatccgacattcctagggtacttcattgacaaaggtgtatcctctgcagctaaagtggttaggaaggcctatccacaagagaatgttggggtattcgttcaacgaggtcgcggtggacctctctctgtagttgagtacagtgaaatggatgcagctatgactactgaaattaatcaatcaacagggcgcctccgttattgttggagcaatatctgcctgcatatgttcactttggactttttgaaccaagtggcaaacagccttgaaaaggacagtgtatatcatctagctgagaagaagattccttccatccatgggtatacaacgggcctgaagcttgaacagtttatattcgatgctttcacttactccccatccacagcactttttgaggtcttgcgggaagaggaatttgcaccagtaaagaatgccaacggcgcaacatatgacactcctgatagcgtgaaactcatgctgctccgtctccatagcagatgggttgttgctgcaggcggcttcttgacgcattctgtgcccttgtatatgacaggcgttgaagtttctccactttcctcctacgctggggagaacctggaagccatatgccgtgggcgaacattccatgcgccgagcgagatatcattttagatagggctgttcatgacagcaaaagccgaatgcaaaggattgatgtggatggccaggttgttgtacacttgtatgttttgtgtgttgtgtaacgtagcccttggatttcgaactcatcgcgagttttcccccgcatactttttgtagtgccagctcatggccagggacctgctgatcatagtccctgttcaaaacaggacgaccgtatacatttcacaggctgatcagcaatttgcac

SEQ ID NO: 1005 - DNA, 1867 bp, Pennisetum glaucum
gtgggccactaagagaaatcgcaagatttagctcaacgggcgatccaagaacaatccgtcgtccgagttggcatctttggccaaatcagtatcattgcccaatcacagatctcttctctcctcctcctccctctcatctcccactacctgctcctgctgctttgcttgtgcgctgcgaggggagagaggagacgagatgaaggaggagatggtggtgggcttgtcggcgcccgggccggtggggaggtggggcgccgcgccaccgcaggcgctgctggagaggatgaaagactacggccaggagggcgccttcgcgctctgggacgatctctcgccggaggaccgggagctcctcgtccgggacatcgcgagtatagatctttcgaggatcgatcggatcattcgacgctcacttggatcacaaggcatgccgctgcctgccgtggagcccgttccggaatccagtgtctccaaggtggaggacaggtctccggaggacaaagaaagatggtggaagaaggggctgaaagctatctcagaggggaagctagctgttgtccttttggccggtggtcagggcacacgacttggaagctccgatcctaaggggtgttttaatattggacttccatctggaaagtcacttttccaactccaagctgaacggattttgtgtgttcaaaagctggctgctcaatctagtgaaagtccaagcaacactgtgccaatccactggtatataatgacaagcccctttacagatgctgccactcgcaaattctttgaaactcgtagatattttggcttagatgctgaccaagtgacatttttccaacaaggcacacttccatgcatttctgctgatggtagatttattatggagacaccatatcaggtagcaaaggctcctgatggcaatggtggagtttatgctgcattgaagtccaaaaagttaatggaagatatggctgcacggggtgtgaaatatgtagattgctatggagtagacaatgcactggttcgtgttgcagatccgacattcttagggtacttcattgagaaaggtgtatcctctgctgctaaagtggttaggaaggcttatccacaagagaacgtaggggtatttgttcaacgaggtcgtggtggacctctctctgtggtcgagtacagtgaaatggatgcagctatgactactgaaatcaatcaatcaacagggcgccttcgttattgttggagcaatatctgcctgcatatgttcactttggactttttgaaccaagtggcaaacagtcttgaaaaggacagtgtatatcatctagctgagaaaaagattccttcgatccacgggtatacaacaggcctgaagcttgaacagtttatattcgacgctttcacttactctccatccactgcactttttgaggtcatgcgggaagaagaatttgcaccagtaaagaatgccaacggcgcaacatatgacacccctgatagttcgaaactcatgctgctccgcctccacagcagatgggttgtcgctgctggtggcttcttgacgcattctgtgcccttgtacatgacaggcgttgaagtttctcctctttcctcctacgctggagagaacctggaagcaatctgccgtgggcgaacattccatgcgccgagtgagatatcattttaggtaggcttgttcatgacagcaagagctgtgtaagcgcaaaaaaggatgtaaaggattcaggatgtgcatgtttcctttctaggccagagatgggtgtggatggacaggttgttgtatatttgcatgttgtctgtatgtcgtgtaatgtagccctcgaatgccgaattcatcgtgagtttctctcaaaaa

SEQ ID NO: 1006 - DNA, 2254 bp, Zea mays
acaacacaagccttgtggtgcgtgcctgaacctcaagtctgcagatttgaccactgcagccgtggagcagagcggcctgaattcttcttctgaagttccaccgcaaattaatccaggagagtgtgagactgactgacacacatgcacagggatcacgccaggtatataaacgcgcaggcggccggccggcccacccaccggcgacggcgatccgagaacaaaccgtcgtccgagttggcatctttggccaaacccagtatcattgcccaatcacagatctcctccccccgagaccccccctctctttctaatccctctttcttcccctctctctctctctctctctctctctctctctctctctctctctctctctctctctctcccgcattacccactacctgcttctgctgcttgcttgtgcggtggacgctgcggtgcgggcggtgcggagcggagaggtgaaagaaggggatgaaggaggagatggtggtcggcctgtcggcgccggggccggtggggaggtggggcgccgcgccgccgcaggcgatgctggagaggatgaaggactacggccaggagggcgccttcgcgctctgggacgatctctcgcccgaggaccgagagctcctcgtccgggacatcgagagtctagacctttcaaggatcgatcggatcatccggcgctcccttggatcgcaaggcatcccgttgcctgccgtcgagcccgtgccggaatctagtgtatccaaggtggaggacaggtctcctgaggacaaggaaagatggtggaagaaggggctcaaagccatctctgaggggaagctggctgttgtccttttggctggtggtcagggtactcgtctgggaagctcagatcctaagggatgtttcaatattggacttccatctggaaagtcacttttccaactccaagctgaacggatcttgtgcgttcagaagctggctgctcaatccagtgaaagcccgagtaacactgtgctgatccactggtatataatgacaagccccttcacagatgcttccactcgcaaattcttcgaaacccgtagatactttggcctagaccctgaccaagtgacatttttccaacaaggcacacttccatgcgtctctgccgatggtagatttattatggagacaccatatagggtagcgaaggctcctgacggcaacggtggagtttatgctgcgctgaagtccaagaagctgatggaagacatggctgcgcggggagtgaaatacgtagactgctacggagtcgacaacgcgctggttcgagttgcggatcctacgttcttagggtacttcatcgacaagggtgtgtcttctgccgccaaggtggtgaggaaggcttacccgcaagagaatgtcggggtgtttgttcaacgaggccgcggtggacctctctccgtggttgagtacagcgaaatggacgcagctatgactactgagatcaatcagtcgacagggcgactccgttactgctggagcaacatctgcctgcacatgttcactctggacttcttgaaccaagtggcgaacagcctcgagaaggacagtgtataccatctagctgagaagaagatcccttccatccatgggttcacaacgggcctgaagctggaacagtttatattcgacgccttcacttactccccatccacagagcttttcgaggtcatgcgggaggaggaattcgcgccggtaaagaacgccaacggcgcgacatacgacacccccgatagcgcgaagctcatgctgctccgcctccacagcagatgggtggtcgccgccggtggcttcttgacgcactccgtgcccttgtatatgacaggcgtcgaagtttccccgctttcctcctacgccggagagaacctggaagcgatctgccgcgggcgaacgttccatgcacccagcgagatatcgttttaggatatcgttttgtgtaactgtggactgaacggaaagggttgcaagattgtgcatgtttacttcgaggcgtgagatgggtgtcgggttgatgtgttgcttgtattctctgagtgttgtgatgtagcatctccaactccaaattcatctcgagttttctcccccatctccttggactactgccatttttaatgacaatgggtcaggttcggatcaggctccgtgtactcgcggatacattttttacatgtgcaattgtttatcttttaagaagcacaactttttttcaatcaaacacgaa

SEQ ID NO: 1007 - DNA, 2019 bp, Sorghum bicolor
cagggatcacgcccggtatataaacgcgcaggcgcaggcggcccacccaccggcgacggcgatccgagaacaatccgtcgtccgagttggcatctttggccaaaccagtatcattgcccaatcacagatctcctctccctctctctctcatttcccactacctgctcttgctgctgcttgtgcggtgggcgctgcgggcggtgaggaggagcggagcagagaggtgaaaggggatgaaggaagagatggtggtcggcctgtcggcgccggggccggtggggaggtggggcgccgcgccgccgcaggcgatgctcgagaggatgaaggactacggccaggagggcgccttcgcgctctgggacgatctctcgcccgaggaccgggagctcctcgtccgggacatcgagagtctagacctttcaaggatcgatcggatcatccggcggtcccttggatcacaaggcatcccattgcctgctgtcgagcccgtgccagaatctagcgtctccaaggtggaggacaggtctcctgaggacaaagaaagatggtggaagaaggggctgaaagccatctcggaggggaagctggctgttgtccttttggccggtggtcagggtactcgactgggaagctcagatcctaagggatgtttcaatattggacttccatctggaaagtcacttttccaactccaagctgaacgtattttgtgtgttcaaaagctagctgctcaatctagtgaaagtccgagtaacactgtgccgatccactggtacataatgacaagcccctttacagatgctgtcactcgcaaattctttgagacccgtagatattttggcttggaccctgaccaagtgacatttttccaacaaggcacacttccatgtgtttctgctgatggtagatttattatggagacaccatatagggtagcaaaggctcctgatggcaatggtggagtttatgctgcgctgaagtccaaaaagttgttggaagatatggctgcacggggtgtaaaatatgtagattgctacggagttgacaatgcactggttcgagttgcagatcctacattcttaggtacttcattgacaaaggtgtatcttctgctgccaaagtggttaggaaggcttatccacaagagaatgttggggtatttgttcaacgaggtcgtggtggacctctctcggtggttgagtacagtgaaatggatgcagctatgactactgaaattaatcaatcaacagggcgacttcgttattgttggagcaatatctgtctgcacatgttcaccctggactttttgaatcaagtggcaaacagccttgagaaggacagtgtatatcatctagctgagaagaagattccttccatccatgggtttacaacaggcctgaagcttgaacagtttatattcgatgctttcacttattccccatccacggcactttttgaggtcatgcgggaggaggaattcgcaccagtaaagaatgccaatggcgcaacatatgacacccctgatagcgcaaagctcatgctactccgcctccatagcagatgggtagtcgccgctggtggcttcttgacgcattctgtgcccttgtatatgacaggcgtcgaagtttctccactttcctcctatgctggagagaacctggaagcaatctgccgtgggcggacattccatgcgccaagtgagatatcattctaggtaggcctgtccatggcagcagctgagcagcagttgtgtaactgtaaaacaaacggaaaggattgcagggtgcgtatattttcttgtaggcgtgagatggatgtggatgggcgggttgttgtgtacttgtatgttctgtgcgtgttgtaatgtagcatctcgaactccaaattcatcttgagttttctcctcatctccttgcagttcaatttttttgcttcacctgtgttgctccagtgtagtgtagatggttttgaggccgtgtggaatcaacgaagtcttgttcatttggctgataagccgtg

SEQ ID NO: 1008 - DNA, 1869 bp, Saccharum officinarum
tcgtccgagttggcatctttggccaaaccagtatcattgcccaatcacagatctcctctccctctctttctaatccctctctttctccctcatttcccactacctgctcctgttgcttgcttgtgcggtgggcgctgcgggcggtgagaagcggagcaggaaggtgaagccgtgaaggggatgaaggaggagatggtggtcggcctgtcggcgccggggccggtggggaggtggggcgccgcgccgccccaggcgatgctcgagaggatgaaggactacggccaggagggcgccttcgcgctctgggacgatctctcgcccgaggaccgggagctcctcgtccgggacatcgagagtctagacctttcaaggatcgatcggatcatccggcggtcccttggatcacaaggcatcccattgcctgctgtggaacccgtgccggaatctagtgtgtccaaggtggaggacaggtctcctgaggagaaagaacgatggtggaagaaggggctgaaagccatctcggaggggaagctggctgttgtccttttggctggtggtcagggtactcgactgggaagctcagaccctaagggatgtttcaatattggacttccatctggaaagtcacttttccagctccaagctgaacggattttgtgtgttcaaaagctggcttctcaatccagtgaaagtccgagtaacactgtgccgatccactggtatataatgacaagcccctttacagatgctgccactcgcaaattctttgaaacccgtagatattttggcttagaccctgagcaagtgacatttttccaacaaggcacacttccatgcgtttctgctgatggtagatttattatggagacaccatatagggtagcaaaggctcctgacggcaatggtggagtttatgctgcgctgaagtccaaaaagttgttggaagatatggctgcacggggtgtgaaatatgtagattgctatggagttgacaacgcactggttcgagttgcagatcctacattcttagggtacttcattgacaaaggtgtatcttctgccgccaaagtggttaggaaggcttatccacaagagaatgttggggtatttgttcaacgaggtcgtggtggacctctctcagtggttgagtacagtgaaatggatgcagctatgactactgaaattaatcaatcaacagggcgacttcgttattgttggagcaatatctgtctgcacatgttcactctggactttttgaatcaagtggcaaacagccttgagaaggacagtgtgtatcatctagctgagaagaagattccttccatccatgggtttacaacaggcctgaagcttgaacagtttatattcgatgctttcacttattccccatccacggcactttttgaggtcatgcgggaggaggaatttgcaccagtaaagaatgccaacggcgcaacatatgacacccctgatagcgcgaagctcatgctgctccgcctccatagcagatgggtagtcgccgctggtggcttcttgacgcattctgtgcccttgtatatgacaggcgtcgaagtttctccgctttcctcctacgccggagagaacctggaagcaatctgccgtgggcgaacattccatgcgccgagtgagatatcgttttaggtaggcctgttcatggcagcagctgagcagcagttgtgtaactgtaaaacaaacggaaaggattgcaggatgcgcatgttttcttctaggcgtgagatggatgtggatgggcaggttgttgtgtacttgtatgttctatgcgtgttgtaatgtagcatctcgaactccaaattcatcttgagttttctcctcatctccttgcagttc

SEQ ID NO: 1009 - DNA, 2218 bp, Zea mays
acagggatcacgccaggtatataaacacgcaagtggcccacccaccggcgacggcttcgatccgagaacaatccgtcgtccgagttggcatctttggccagaccagtatcattgcccaatcacggatctctcggatctctccctcctctttctaatctctctctctctctctctcacacacacatttcccactacctgctcctgcttcttgcctgttcggtgtgcgctgcgcgaggtgaggagcggagcagggaggtgaaggggatgaaggaggagatgatggtcggcctgtcggcgccggagccggtggggaggtggggcgccgcgccgccgcaggcgatgctggagaggatgaaggactacggccaggagggcgccttcgcgctctgggacgatctctcgcccgaggaccaggagctcctcgtccgggacatcgagagcctagacctctcaaggatcgatcggatcatccggcgctcccttggatcacaaggcatcccattgcctgctgtcgagcccgtgccggaatctagtgtctccaaggtggagggcaggtctgcagaggacaaagaaagatggtggaagaaggggttgaaagccatctcggaggggaagctggccgttgtccttttggccggtggtcagggtactcgactgggaagctcagatcctaagggatgtttcaatatcggacttccatcaggaaagtcacttttccagctccaagctgaaaggattctgtgcgttcaaaagctggctgctcaatctagcgaaagcccgagtaacactgtgccgatccactggtacataatgacaagcccctttacagatgctgccaccgccaaattctttgaaacccgtagatattttggcttagaccctgaccaagtgacatttttccaacaaggcacacttccatgcgtttctgccgatggtagatttattatggagacaccatatagggtagcaaaggctcctgatggcaacggtggagtttatgctgcactgaagtccaagaagttgatggaagatatggccgcgcggggtgtgaaatacgtagattgctacggagttgacaacgcgctggttcgagttgcagatcctacgttcttagggtacttcattgacaagggcgcatcttctgccgccaaagtggttaggaaggcttatccgcaagagaacgttggggtgttcgttcaacgaggccgtggtggaccgctctcggtggttgagtacagcgaaatggatgcggctatggctaccgaaatgaatcagtcgacagggcgactccgttactgttggagcaacatctgcctgcacatgttcactctggacttcttgaaccaagtggcaaacagccttgagaaggacagtgtataccatctagctgagaagaagatcccttccatccatgggttcacgacgggcctgaagcttgaacagtttatattcgacgccttcacatactccccgtccacggcacttttcgaggtcatgcgggaggaggaattcgcgccggtaaagaacgccagcggcgcaacgtatgacacccctgatagcgcgaagctcatgctgctccgcctccacagcagatgggtagtcgctgctggcggcttcttgacgcactctgtgcccttgtatatgacaggcgtcgaagtttctccgctctcctcctacgccggagagaacctggaagccatctgccgtgggcgaacgttccatgcgccgagcgagatctcgttttaggaggtagacctgttcatgggactggagtagcagttgtgtgtcatctgtaaaacgagcgtaaaggatgggcaggctgttgtgtactgcgtgttgtagatgtaacatctcggacggacaccaaattcatctcgagttttctctccatctctgtgttgctcccccgtaggctgtagatcgtttcgacttttgagtcaccctgttaaaaacagaaagaccgttcgtccaatttaatttgctaggctgaccagcaagttgaaacaagtcatacgagaggattgcagattggcaggtacaaatgatgaagaaccgtaaagcttcgttctcccatttcagcacatgatagtgttgacgtatgatcttaaacacagcgagaaacataacgaatcggtaaaactaatacaaggatcggccaaatcaacattgacccaattcttcgtcagtaagctctcgaatactactttctagaaagacc

SEQ ID NO: 1010 - DNA, 2861 bp, Oryza sativa
cacgcacaaacgctaatgacgacccaatcagcagcagcagcctctctcctactaataatctccccaagattggatcatactctcatctcatcatagtctccgcccatccgccatcgctcgcagatctctctcgctctcgctctagctctcgctcgaggaggagatggcggagatcgtggtggcgccgcgggcgccggcgccggcggggaggtggggcgccgcgccgccgcaggagctggtcgagaggctcaaggactacggccaggagggcgccttcgcgctctgggacgagctcgcccccgaggagcgcgacttcctcgtccgggacatcgagagcctagatcttgctaggattgaccggatcgtccgatgctcgctcagatcacaaggtgttcctttgccagccgtcgagcctgtgccggagtcgagtgtctcgaccgtcgaagatagaactcctgaggacaagcagaggtggtggaagaggggcttgaaagccatttcagaggggaaattggctgttgtccttttggctggtggtcagggaacaaggcttggcagttctgatcctaagggatgcttcagcatcgggcttccatctggaaagtcacttttccaacttcaagctgaacgaattttgtgcatacagaagctggctgctcagtccactgatggtactccacaaatacactggtatataatgactagcccctttactgatgaagcgactcgaaaattttttgaaagccacagatattttggcttagagcctgaccaagtaacatttttccagcaaggtactatcccatgtgtctcagctgatggaaggtttattatggaaacaccatacaaggtagcaagggctcctgatggcaatggtggagtgtatgctgctctaaaatctcaaaggttgctggacgatatggctggaagaggtgtgaaatatgtagattgctatggagttgacaatgtattggtccgtgttgctgatccaacattcctaggatatttcattgacaagggcgtgtctgctgctgcaaaggtcgtaaggaaggcatatccacaggagaaagttggagtgtttgttcagcgtggcaggggtgggcctctttctgtagttgagtacagtgaaatggatgcagctatgactactgaaataaatcaaggcacagggcgccttcgttattgttggagcaatgtatgcctgcatatgtttactttggattttcttaatcaagtaacaaatagtcttgaaaaggacagcatttaccatttagcagagaagaagattccttcaatccatgggtacacggcaggcttaaagcttgaacagtttatatttgacgtgttcacctattctccatcaacagctctttttgagattttgagggaggaggaatttgcaccagtaaagaatgctaatggtgcaacttatgatactcctgatagtgccagattaatgctgctccgccttcacagccgatgggtggtagctgcaggtggctttttgactcattccgtgcccttgtatatgacaggtgttgaagtttctccacttagctcttatgcgggagagaacctggaagccatatgccgtggacggacattccatgcaccgagtgagatttcattttaggaatagtgtctgtcgaaagcaacagtctcagacccagctaaaaagcatctgtctcaagaagagaatggcaggatccctcaattttcattgggacatgagatgagatagttggacttgagctcttgcagttagaatgttgatattagtcagcttgttgtaatgccagtaattgtaattcaacaattggagttggctccctttccatgtaccatttttgtgctgctcaaatgtagatgatcaaacaatggctaaatcttctgtaaaaaataatacatctctgtaagactggtctatgcacaattgttaattcaacgtgctctaaagtgagaagaaaaagaaaacaaagaatggagtacacattttcctttttcaagtttgcaatacaattaatgcctatgtttggttgcttcaagcagatatcagtgaatcacagtatggctttagccatctgtctccgtcaataaaagaagtgttcaggtaaggcaaaacctgcacatcactaagcttctgagcatatggcactctatctgataagtttgcaccatcacccgtgcacctgtactctccatagaacacagtcctgacaattcaaacattacaaatattaatgctaatttacctttttgtcatgcaggtaacaattgacactgaatagagagaggatgcatactggtctcttgaaggatcattccaatcattccatccttcagaggcaatgatgtctgacattgaagtgtaggcgaagacgactgtggaatatggtctccatgctctccccagccatatcctgccggtgccgccaatgctgcaattgacaaaagagtagccagtgttgtcgtctacagattcccgggcatgcgcagtgactgaacctgtgatggttctcacccctgcaggaacaggatctgctatggaaatcaccctgcaattctgggaagtgcacaggtggaagcagtcagtgacaaagtgtatttttgttgtcttccaatctttggattatggttttactcacttcatagagtgacctggcatctccaaagataaagtcaatggaaccctggatgaagcattccttgaagtaatgccggccacgatcatcgtgaagcgtatcttgcgcaccaaagaagccgcaaccccagaatgctgcctggtcaccgccgatcctcagtgctaccgcctgagcaccgacatcaccgggtcttgggattggtgccacattctggtttca

SEQ ID NO: 1011 - DNA, 1957 bp, Oryza sativa
tactaataatctccccaagattggatcatactctcatctcatcatagtctccgcccatccgccatcgctcgcagatctctctcgctctcgctctagctctcgctcgaggaggagatggcggagatcgtggtggcgccgcgggcgccggcgccggcggggaggtggggcgccgcgccgccgcaggagctggtcgagaggctcaaggactacggccaggagggcgccttcgcgctctgggacgagctcgcccccgaggagcgcgacttcctcgtccgggacatcgagagcctagatcttgctaggattgaccggatcgtccgatgctcgctcagatcacaaggtgttcctttgccagccgtcgagcctgtgccggagtcgagtgtctcgaccgtcgaagatagaactcctgaggacaagcagaggtggtggaagaggggcttgaaagccatttcagaggggaaattggctgttgtccttttggctggtggtcagggaacaaggcttggcagttctgatcctaagggatgcttcagcatcgggcttccatctggaaagtcacttttccaacttcaagctgaacgaattttgtgcatacagaagctggctgctcagtccactgatggtactccacaaatacactggtatataatgactagcccctttactgatgaagcgactcgaaaattttttgaaagccacagatattttggcttagagcctgaccaagtaacatttttccagcaaggtactatcccatgtgtctcagctgatggaaggtttattatggaaacaccatacaaggtagcaagggctcctgatggcaatggtggagtgtatgctgctctaaaatctcaaaggttgctggacgatatggctggaagaggtgtgaaatatgtagattgctatggagttgacaatgtattggtccgtgttgctgatccaacattcctaggatatttcattgacaagggcgtgtctgctgctgcaaaggtcgtaaggaaggcatatccacaggagaaagttggagtgtttgttcagcgtggcaggggtgggcctctttctgtagttgagtacagtgaaatggatgcagctatgactactgaaataaatcaaggcacagggcgccttcgttattgttggagcaatgtatgcctgcatatgtttactttggattttcttaatcaagtaacaaatagtcttgaaaaggacagcatttaccatttagcagagaagaagattccttcaatccatgggtacacggcaggcttaaagcttgaacagtttatatttgacgtgttcacctattctccatcaacagctctttttgagattttgagggaggaggaatttgcaccagtaaagaatgctaatggtgcaacttatgatactcctgatagtgccagattaatgctgctccgccttcacagccgatgggtggtagctgcaggtggctttttgactcattccgtgcccttgtatatgacaggtgttgaagtttctccacttagctcttatgcgggagagaacctggaagccatatgccgtggacggacattccatgcaccgagtgagatttcattttaggaatagtgtctgtcgaaagcaacagtctcagacccagctaaaaagcatctgtctcaagaagagaatggcaggatccctcaattttcattgggacatgagatgagatagttggacttgagctcttgcagttagaatgttgatattagtcagcttgttgtaatgccagtaattgtaattcaacaattggagttggctccctttccatgtaccatttttgtgctgctcaaatgtagatgatcaaacaatggctaaatcttctgtaaaaaataatacatctctgtaagactggtctatgcacaattgttaattcaacgtgctctaaagtgagaagaaaaagaaaacaaagaatggagtacacattttcctttttcaa

SEQ ID NO: 1012 - DNA, 1612 bp, Triticum aestivum
ttgaccggatcattcgacgctctatgggatcacaaggaggctatctggcgcccgccgagcccgtgccggaatccagcgtgtcgagggtggaggagaggtctccggaggacaaagaacggtggtggaagaaggggctgagagccatctccgaggggaagctggccgttgtccttttggctggtggtcaggggactcggcttggtagctcagatcctaaggggtgtttcagtattggacttccatccgggaaatcacttttccaactccaagcggaacgcattttgtgcattcaaaagctggctgctcagtccagtgatagtccaagaaatactttaccaatccactggtacataatgaccagcccctttactgatgatgtcacacgcaaattctttgaaagccgtaaatattttggcttagaggctgaccaggtgacctttttccaacaaggcactcttccatgtgtttctgatgatggcagatttattatggagacgccatacaaggtagccaaggcacctgatggaaatgggggagtttatgccgctctgaagtctaagaagttgcttgacgatatgtcttcacggggtgtaaagtatgtagattgctacggagttgataacgtattggttcgtgttgcagatccaacgttcctagggtactttatagaaaagggtgtatcttctgccgcgaaggttgttaggaaggcttatccacaagagaatgttggagtatttgttcaaagaggtcgtggtgggcctctttccgtggtcgagtatagtgaaatggatgcggctatgactactgaaattaaccaatcaacaggacgccttcgttattgttggagcaatgtatgcttgcatatgttcagtttggaatttctgaatcaagtcgcgaacagccttgaaaaggacagtgtgtatcatcttgcacagaagaagataccctcgattcatgggtatacaatgggcctgaagcttgagcagttcatattcgatgcattcaattactccccgtccacgacactttttgaggtgctacgtgaagaggaatttgctccagtgaagaacgcgaatggctcagcgtacgacaccccggatagcgccaaactgatgctgctccgactccacagcagatgggtagtcgctgctggcggcttcctgacccattctgtgcctttgtacatgacaggcgtcgaggtttctcctctcagctcctatgccggagaaaacctggaggcgatctgccgcggacggacattccacgcgcccagcgagatctcgttctaggtgcatcggttcgtgacagcggcagcagatggaggaagcagtttgggacagcggcacagggattgcaaggtcgaatcgaatgcctcgcagtttgggacattggtggtgtattgagcggagctctttgagctgttggcattagggttttcaggcactggccagactgttgtatcttttgtgagtaattggcccagattctgaatgcgtcttggcttttgccatttgtaactcttttggctgttgctgcccctttagatgagcattttcaattgtactaatttggtgccccgtttatccgtggtaacgtttggagaaggtcagct

SEQ ID NO: 1013 - DNA, 1984 bp, Brachypodium distachyon
caaaaacaaaacacgcggctgacgatccaatcggaacaccatcatcatcatccatcacaccccagcccagctgggctcgagatcggatcgctgcccagtccgtcgcagatctcctctcccgcgcggccctgatccgcaagttccttctttggcggaagatacatggcggagctggtggtggcagcggctgcgccggcgccggcggggaggtggggcgccgcgccgccgcaggagctgctcgagaggctcaaggactacggccaggagggcgccttcgcgctctgggacgagctcgcgcccgaggagcgcgacttcctcgtccgggacatccagagcatagatcttgccaggatcgaccggatcgttcgatgttcactcagatcgcaaggtggtcctgtgccggttgttcagcctgtgccggagtcaagtgtggcgacagtggatgatagaagccctgaggacaaagaaaggtggtggaggaggggtttgaaagccattgcagagggaaagttggctgtcgtacttttggctggtggtcagggaacacgccttggcagttctgatcctaagggatgtttcagtattgggcttccatctggaaagtcacttttccaacttcaagctgaacgaattttgtgtgttcaaaagctggctgctcaatccactgatgctccaggcaacactccgcagatccactggtatataatgaccagtcccttcactgatgaaaccacccgcaaattctttgaaagccgtcgatattttggcttagagcctgaccaagtgacctttttccagcaaggcacactcccgtgtgtttctcctgatggaaggtttatcatggagacaccatataaggtggcaagagccccggatggcaatgggggagtatatgctgctctaaaatctaaaaggttgctcgatgatatgtctgcaagaggtgtgaaatatattgattgctatggagttgataatgtgttggtccgtgttgcagatccaacattcctaggatacttcattgacaagggtgtgtctgctgctgcgaaggttgtaaggaaggcatacccacaggagaaagttggggtatttgttcagcgtggtaggggtggacctctctctgtggttgagtacagtgaaatggatgcatctatgactactgaaatcaatcaaacaacaggacgccttcgttattgttggagcaatgtgtgcttgcatatgttcagtttggaatttctcaatcaagtaaccaatagtcttgagaaggatagcgtttatcatctagcagacaagaagattccttcaattcatgggtacacagcaggcctaaagcttgaacagtttatattcgacgtgttcacctattctccatcgacagctctttttgaggtcatgagggaagaggaatttgcaccagtaaagaatgctaacggtgcgacctacgacactcctgatagcgccagattaatgctacttcgccttcacagccgatgggttgttgctgcaggtggctttttgacgcattccgtgcccttgtatatgacaggtgttgaagtttctcccatgtgctcttatgctggagaaaacctagaagccatatgccgtggacgaacattccatgcaccaagtgagatctcactctaggcggaggttgttccaaggagcagttgcatacaagaacggcaaagtctgtgaatttttgttaggacatgggatcaagatggcaggacctgagcactttcaattagagtgtcaatattagtcagcctgttgtatgctgtgtgagtacagagtattgtaatgcaacacttgaggctatcttttccccccttttggtgatatttatcatttgttgctcaaaatgtagattgatcagagggcacaattcaatctttatcaaaatcaatgtatttctgaaattttgaatactgttctttgcacaattgatttaatgtgagaaaatccaaagaatggattctactagttt

SEQ ID NO: 1014 - DNA, 3839 bp, Brachypodium distachyon
gcagagatgagatgcaacagcagcgcgctgacagacaaaaacaaaacacgcggctgacgatccaatcggaacaccatcatcatcatccatcacaccccagcccagctgggctcgagatcggatcgctgcccagtccgtcgcagatctcctctcccgcgcggccctgatccgcaagttccttctttggcggaagatacatggcggagctggtggtggcagcggctgcgccggcgccggcggggaggtggggcgccgcgccgccgcaggagctgctcgagaggctcaaggactacggccaggagggcgccttcgcgctctgggacgagctcgcgcccgaggagcgcgacttcctcgtccgggacatccagagcatagatcttgccaggatcgaccggatcgttcgatgttcactcagatcgcaaggtggtcctgtgccggttgttcagcctgtgccggagtcaagtgtggcgacagtggatgatagaagccctgaggacaaagaaaggtggtggaggaggggtttgaaagccattgcagagggaaagttggctgtcgtacttttggctggtggtcagggaacacgccttggcagttctgatcctaagggatgtttcagtattgggcttccatctggaaagtcacttttccaacttcaagctgaacgaattttgtgtgttcaaaagctggctgctcaatccactgatgctccaggcaacactccgcagatccactggtatataatgaccagtcccttcactgatgaaaccacccgcaaattctttgaaagccgtcgatattttggcttagagcctgaccaagtgacctttttccagcaaggcacactcccgtgtgtttctcctgatggaaggtttatcatggagacaccatataaggtggcaagagccccggatggcaatgggggagtatatgctgctctaaaatctaaaaggttgctcgatgatatgtctgcaagaggtgtgaaatatattgattgctatggagttgataatgtgttggtccgtgttgcagatccaacattcctaggatacttcattgacaagggtgtgtctgctgctgcgaaggttgtaaggaaggcatacccacaggagaaagttggggtatttgttcagcgtggtaggggtggacctctctctgtggttgagtacagtgaaatggatgcatctatgactactgaaatcaatcaaacaacaggacgccttcgttattgttggagcaatgtgtgcttgcatatgttcagtttggaatttctcaatcaagtaaccaatagtcttgagaaggatagcgtttatcatctagcagacaagaagattccttcaattcatgggtacacagcaggcctaaagcttgaacagtttatattcgacgtgttcacctattctccatcgacagctctttttgaggtcatgagggaagaggaatttgcaccagtaaagaatgctaacggtgcgacctacgacactcctgatagcgccagattaatgctacttcgccttcacagccgatgggttgttgctgcaggtggctttttgacgcattccgtgcccttgtatatgacaggtgttgaagtttctcccatgtgctcttatgctggagaaaacctagaagccatatgccgtggacgaacattccatgcaccaagtgagatctcactctaggcggaggttgttccaaggagcagttgcatacaagaacggcaaagtctgtgaatttttgttaggacatgggatcaagatggcaggacctgagcactttcaattagagtgtcaatattagtcagcctgttgtatgctgtgtgagtacagagtattgtaatgcaacacttgaggctatcttttccccccttttggtgatatttatcatttgttgctcaaaatgtagattgatcagagggcacaattcaatctttatcaaaatcaatgtatttctgaaattttgaatactgttctttgcacaattgatttaatgtgagaaaatccaaagaatggattctactagtttcctcctttttttctgttacacgatgttggataactgtagactgagcatctatgatttcttttcttcaagcagatatcagtgagtcacagtatggtttcagccatcggtctccgtcgatgtaagatgtgttcaagtaaggcaatgcttgctcatcactgagcttcaaagaatatggcactctacctgccaggtttgcaccatcacctgtacacttgtactctccataaaatacactcctgtcaatgcaaataaaacaaaagctgatgttagtaagctttctgcaataatctcaataattaacaccgacagtgaaggaggcatactgatctcttgaaggatcattccaatcattccatccttcagaggcgatgatgtctgacatcaaagtgtatgcaaagacgacacgggagtaaggtctccatgctcgcccaagccatatcctacctgtgccgccgatgctacagttgacaaatgagtaaccggtgttgtcaccatcagattctcgggcatgcgctgtaattgcaccggtgatggttctcacccctgcaggcacagggtctgctatggaaatcaatctgcaattctgacaagtacaaaagtggaagcagttagtgaactcagcacttttcggttttgcgttcccgtccttgagatattatagtgtcttttactcacttcatacagtgacctggcatctccaaagatgaaatcaatggagccctgaatgaaacattccttgaagtaatgccggcctcgatcatcgtgaagcgtatcttgcgcaccgaaaaagccgcagccccagaatgctgcctggtcaccaccgatcctgagagcgactgcctgagcatcaacagcgccaggtcttgggataggtgctacattctgttgtcaaaatggttaagagagttacattggtactcaaggttcacctgtgtgacttaacagaaacttgatgtgcagcgtccatgattacaatgaagctaatgttctttgcgacaaaccctgccgcgaagacagtgaccgaagcgctatagaaggtgccatgcgacgagttggcggtgtcattccacgcaatcgccgtcaggtcaaatccctgcccctgaaatgtgatgttgggcttggttgcagggactgtcaccttctcgctgtaacaatgcagcttcagtaaccacactattattacttctgtacttttggcaactgggtactggaagcctgatcaaagcaagatttcttacaagtagatgcccttgttgatccacacaacattcctcttgtggctggatcttgggacagcatctaccgcatcctgcaccttggtgaaatcgcagcagccgttggggtcgacgcagaagattgatgtctccgccatgtcaggaggtgggaagtccggcgggaaatcgtcacaaagcgggttgtattcatcggggaggcaatgatcattggagaaatagccaactgtgagcaaatgaaatggaagggaaggtgttgcaagatcaagcaaggctctcaggaacgaagtgtgtgggttattcagatgagcaaacaatagcagaacgacaggtatcaggccagagagggaaatgactttggggctcatttgtattgcggaaaagctttcactgtttcatggggaatatgagatgactttggtgccttttaacaggataaaatgcactttaagaagacgcttaacttgcttcccttgcaaacaaccaatctcgtttcttcaagcttgagacgcggcgcaagtcagcagtctgccagaggcaatcatgcaaaacaatgaaacacccgtgaatgaaaagagtattcacgtc

SEQ ID NO: 1015 - DNA, 2432 bp, Setaria italica
ctgcgccgagcagatcacctcctctcctctcatcctcgtgccacgctgacacgatccaatcacgacgctaatcagcgaagcctcctcccccctccgttctaattaatcggccgctccagatcggatcgtacccgtcggacaccatcactgcccagtcgcagatctctctctctctctctctctctctctctctctctctgctggtggggttgctgctgctgccgcggctcgggagatgacggagatggtggtggccgcgcgggcgccggcgccggcggcggggaggtggggcgcggcgccgccgcaggagctgctggagaggctcaaggactacggccaggagggagccttcgccttctgggacgagctcgggcccgaggagcgcgaccacctcatccgggacatcgagagcctagatcttcctaggatcgatcggattgtccggtgttccctcagatcacaaggtgctcctgtgccgaccgtcgagcctgtgccagagtcaagtgtctcgacggtggatgacagaactcctgaggacaaggaaaggtggtggagaaggggcttgagggccatttcagaggggaagttggccgttgtcctgttggctggtggccaggggactcggcttggcagttctgatcctaaagggtgtttcagtatcggacttccatctaggaagtcacttttccaactacaagcggaacggattttgtgtattcagaagctggctgctcagtgcaccgatgccccaggtagcacagtgcaaattcactggtatataatgactagtccctttactgatgaagccacacgaaaattctttgaaacccacagatattttggcttagagcctaaccaagtgacatttttccagcagggtactgttccatgtgtctctcctgacggaagatttattatggagacaccatataaggtagcaaaggctcctgatggcaatggtggagtatatgctgctctaaaatcgaaaaagttgctggatgatatggctgcaaaaggtgttaagtatgtagactgttatggagttgataatgtattggtccgtgttgcagatccaacattcctaggatacttcattgacagaggtgtatctgctgctgctaaggttgtaaggaaggcatacccacaagagaaggttggagtgtttgttcagcgtggaaggggaggacctctctctgtggtcgaatacagtgaaatggatgcagctatgactaccgaaataaatcaaactactgggcgcctacgttattgctggagcaatgtctgcttgcatatgttcactttggattttctgaaccaagtaacaaacagtcttgaaaaagatagcatttatcatctggcagagaagagaattccttcagtccatgggtacacatcaggattaaaacttgaacaatttatattcgatgtgttcaactattctccttcaacagctctttttgaggttttgcgcgaggaggaatttgcgccggtgaagaatgctaatggtgcaacctatgacactcctgatagtgccagattaatgctgcttcggcttcatagccgatgggtggttgctgcaggtggcttcttgacacattccgtgcccttgtatatgacaggtgttgaagtttctccactttgctcttatgctggagagaacctagaagccatatgccgaggaaggacattccatgcaccaagtgagatttcattctaggcatagtagttggaagcaacaatcagaaaacaggaagatgagatctgcccaattttgatttcaacatgacaattcttgcaaatagggtgtttatattagtcaactattgtatgtatgcaaggaccaattattgtaacgcaacacctgaagttgccttgtttctcctctagcattaatgtgtattgtattctcatgtgctgctcaaatgtagattatgacatgcttttctgtaatatttgttgaaaacagcatatctaccaaatgcttattatctttgcacaattctattcttgattctatgggctatgatgtgagaaaatcaagcaatagaatgtcctatttgtccctgtttcaagtctgtgacccagttgtcatctaccttgaattgtttcaagtagatattagtgagtcactgtatggtttcagccattgatctccatcgatgaaagatgtgctcaggaaaggtaatacttgcacatcactaagcttctgagcataaggcactctatctgccaggttggcaccatcacctgtacacttgtactctccataaaatacagtcctgaaattcagattgcacaaaaactgatgtcattgtactttgtgttatgcagataagaatcaacactagcattggagaatgcatactgatctcttgagggatcattccagtcattccatccttcagaggctatgatgtctgacattgatgtgt

SEQ ID NO: 1016 - DNA, 2439 bp, Sorghum bicolor
aacggagggaatatgggcatctgccggccacgccgaccgccgaactctgcagactgcagagcacctctgctgtctcctcatcccacgctgacacgatccaatcacgacgctaatcagtcagcctcgtcctaattaatcggcggccccgagatcggatcgtacccgccgtagatcatcactgcccagtcgtgtcgtagatctcgtcgtcatctctcttcctcggtgggggttgctgctgcggcttgagagatgacggagatggtggtggcggctcgggcgccggccccggcggcggggaggtggggcgcggcgccgccgcaggagctactggagaggctcaaggactacggccaggagggcgccttcgccttctgggacgagctcgcgcccgaggagcgcgaccacctcatccgggacattgagagcctagatcttcctaggattgatcggattgtccgatgctcgcttagatcacaaggtgctcctgtaccaacctttgagcctgtgccggagtcaagtgtctccacggtggatgacagaactcctgaggacaaagaaaggtggtggaggaggggcttgagagccatttcagaggggaagttagctgttgttttgttggctggtggccaggggactaggcttggcagttctgaccctaagggatgtttcagtatcgggcttccatctaggaagtcacttttccaactacaagctgaacggattttgtgtattcagaagctggctgctcaatgcactgacgccccaggtagcacagtgccaattcactggtatataatgactagtccctttaccgatgaagcgacccgaaagttctttgaaacccacagatattttggtttagagcctaatcaagtgacatttttccagcagggtactgttccatgtgtatctcatgatggaagatttattatggagacaccatacaaggtagcaaaggctcccgatggcaatggtggagtatatgctgctctaaaatctaaaaggttgctcgatgatatggctgcaaaaggtgttaagtatgtagattgctatggagttgataatgtattggtccgtgttgcagatccaacattcctaggatactttattgacagaggtgcatctgctgctgctaaggttgtcaggaaggcatatccacaagagaaagttggagtatttgttcagcgtggaaagggtggacccctctctgtagttgaatacagtgaaatggatgcagctatgacaactgaaatcaatcaaactactggtcgccttcgttattgctggagcaatgtctgcttgcatatgttcactttggattttctgaaccaagtgacaaacagtcttgaaaaggatagcatttaccatctagccgagaagagaattccttcagtccatgggtacacatcaggcttaaagcttgaacaatttatatttgatgtgttcaactattctccttcgacagctctttttgaggttttgcgtgaggaggaatttgcgccagtgaagaatgctaatggtgcaacttatgacactcctgatagtgccaggttaatgctgcttcggcttcatagccgatgggtggttgctgcaggtggcttcttgactcattctgtgcccttgtatatgacaggagttgaagtttctccgctttgttcttatgctggagagaatctagaagccatatgcagaggaagaacattccatgcaccaagtgagatttcattctaggcatagtagttggaagcaatctgaatacaggaagatgagatctgctcaattttgattacaacatgacaactcttgcaaataggatgttgatattagtcaactattgtatgttatgcaaggatcaaatattgtaatgcaacgcctgaagttgcctcctttctcccctagcattaatgcatattgcattctcatgtgctgttcgaatgtagatgatgacatgcttttgtgtaatatttgttgaaaacagcatatgtaccaaatatttattatctttgcacaattgtaattcttgattctatgactatgatgtgagaaaaatcaaagcatgagatgttctattttccctgtttcaagtctgtgacctggctctttgcctagaattgcttcaagcagatattagtgagtcacagtatggtttcagccattgatctccatcgatgaaagatgtgttcaggtaaggtaacacttgcacatcactaagcttctgagcataaggcactctatctgccaggtttgcaccatcacctgtacacttgtactctccataaaatacagtcctgaaaattcaaattgcacaaaagctgatgtcaatgtactttctgttttgcagataatcaaaaataacattggaggacacgtactgatctcttgtgtggtcattccagtcattccatccttcagaagctatgatgtctgacattgatgtgt

SEQ ID NO: 1017 - DNA, 3223 bp, Sorghum bicolor
gtggtcttcacagagctggtttgaccattttgcccctaagaagaagcgcccggctcgaaaattctctggaacggagggaatatgggcatctgccggccacgccgaccgccgaactctgcagactgcagagcacctctgctgtctcctcatcccacgctgacacgatccaatcacgacgctaatcagtcagcctcgtcctaattaatcggcggccccgagatcggatcgtacccgccgtagatcatcactgcccagtcgtgtcgtagatctcgtcgtcatctctcttcctcggtgggggttgctgctgcggcttgagagatgacggagatggtggtggcggctcgggcgccggccccggcggcggggaggtggggcgcggcgccgccgcaggagctactggagaggctcaaggactacggccaggagggcgccttcgccttctgggacgagctcgcgcccgaggagcgcgaccacctcatccgggacattgagagcctagatcttcctaggattgatcggattgtccgatgctcgcttagatcacaaggtgctcctgtaccaacctttgagcctgtgccggagtcaagtgtctccacggtggatgacagaactcctgaggacaaagaaaggtggtggaggaggggcttgagagccatttcagaggggaagttagctgttgttttgttggctggtggccaggggactaggcttggcagttctgaccctaagggatgtttcagtatcgggcttccatctaggaagtcacttttccaactacaagctgaacggattttgtgtattcagaagctggctgctcaatgcactgacgccccaggtagcacagtgccaattcactggtatataatgactagtccctttaccgatgaagcgacccgaaagttctttgaaacccacagatattttggtttagagcctaatcaagtgacatttttccagcagggtactgttccatgtgtatctcatgatggaagatttattatggagacaccatacaaggtagcaaaggctcccgatggcaatggtggagtatatgctgctctaaaatctaaaaggttgctcgatgatatggctgcaaaaggtgttaagtatgtagattgctatggagttgataatgtattggtccgtgttgcagatccaacattcctaggatactttattgacagaggtgcatctgctgctgctaaggttgtcaggaaggcatatccacaagagaaagttggagtatttgttcagcgtggaaagggtggacccctctctgtagttgaatacagtgaaatggatgcagctatgacaactgaaatcaatcaaactactggtcgccttcgttattgctggagcaatgtctgcttgcatatgttcactttggattttctgaaccaagtgacaaacagtcttgaaaaggatagcatttaccatctagccgagaagagaattccttcagtccatgggtacacatcaggcttaaagcttgaacaatttatatttgatgtgttcaactattctccttcgacagctctttttgaggttttgcgtgaggaggaatttgcgccagtgaagaatgctaatggtgcaacttatgacactcctgatagtgccaggttaatgctgcttcggcttcatagccgatgggtggttgctgcaggtggcttcttgactcattctgtgcccttgtatatgacaggagttgaagtttctccgctttgttcttatgctggagagaatctagaagccatatgcagaggaagaacattccatgcaccaagtgagatttcattctaggcatagtagttggaagcaatctgaatacaggaagatgagatctgctcaattttgattacaacatgacaactcttgcaaataggatgttgatattagtcaactattgtatgttatgcaaggatcaaatattgtaatgcaacgcctgaagttgcctcctttctcccctagcattaatgcatattgcattctcatgtgctgttcgaatgtagatgatgacatgcttttgtgtaatatttgttgaaaacagcatatgtaccaaatatttattatctttgcacaattgtaattcttgattctatgactatgatgtgagaaaaatcaaagcatgagatgttctattttccctgtttcaagtctgtgacctggctctttgcctagaattgcttcaagcagatattagtgagtcacagtatggtttcagccattgatctccatcgatgaaagatgtgttcaggtaaggtaacacttgcacatcactaagcttctgagcataaggcactctatctgccaggtttgcaccatcacctgtacacttgtactctccataaaatacagtcctgaaaattcaaattgcacaaaagctgatgtcaatgtactttctgttttgcagataatcaaaaataacattggaggacacgtactgatctcttgtgtggtcattccagtcattccatccttcagaagctatgatgtctgacattgatgtgtaggcaaagatgacccgagaatatggtctccatgctcgtccaagccatatccaaccggtgccacctatgctacaattgacaaatgagtagccagtgttgtcatcttctgatacccgggcatgtgcagtgactgaaccagtaattgatctttgccctgaaggcactgggtctgcaatagatatcaatctgcaattctcatagagtgacctagcatctccaaagataaagtcaatggagccctggatgaaacattccttgaagtaatgccggcctctgtcgtcatggagtgtgtcttgcgctccaaagaagccacaaccccagaatgctgcttggtcaccattgatcctgattgccactgcctgtgcatcgacagcgccaggccttggaattggtgctacattcatgaagcttatgttcttcgcaatgaatcctgatgcgaaaacagagactgaggcgctatagaatgtgccgttcgccgacttggcagtatcgttccacgcgatcgctgtcaggtcgaacccctgcccttggaatgtgatgttgggcttggatgctgggactgtcaccttctcaaagtagatgcccttgttgatccacacaacattccttttgctgctgtggtttggaactgcatcgaccgccgcctgcacggttgtgaattcacaacagccattgggatcgacacagaagatggacactgctggtatgtcgggcgg

SEQ ID NO: 1018 - DNA, 2030 bp, Zea mays
accgaactgcactgcagactgcagagcacctctcctgtctcctcatctcacgctgacaagatccaatcacgacgctaatcagtcgtcctaattaatcggcggccccgtgatcggatcgtacccgccgcagatcaccactgtccaagtgcccagtcgtagatcccgtgatcttttttttctcggtggggttgctgctgcggcttgaaagatgacggagatggtggtggcggctcggacgccggcccccgcggcggggaggtggggcgcggcgccgccgcaggagctgctggagaggctcaaggactacggccaggagggtgccttcgccttctgggacgagctcgcgcccgaggagcgcgaccgcctcatccgggacattgagagcctagatcttcctagaattgatcggattgtccgatgctcgcttagatcacaaggtgctcctataccaacctttgagcctgttcctgagtcaagtgtctcgacagtggatgacagaactcctgaggacaaagaaaggtggtggaggaggggcttgagagccatttcagaggggaagttggctgttgttttattggctggtggccaggggactaggcttggcagttctgaccccaagggatgtttcagtatcgggctcccatctaggaagtcacttttccaactacaagctgaacggattttatgtattcagaagctggctgcacagtgcactgatgccccaggtagcacagtgcaaattcactggtatataatgacgagtccttttaccgatgaagtgacccgaaagttctttgaaacccacagatattttggtttggagcctaatcaagtgacatttttccaacagggtactattccatgtgtatctcatgatggaagatttattatggagacaccatataaggtagcaaaggctcccgatggcaatggcggagtatatgctgctctaaaatctaaaaggttgctcgatgatatggctgcaaaaggtgttaagtatgtagattgctatggagttgataatgtattggtccgtgttgcagatccaacattcctaggatacttcattgacagaggtgtatctgctgctgctaaggttgtcaggaaggcatatccacaagagaaagttggagtatttgttcagcgtggaaagggtggacccctctctgtagttgaatacagtgaaatggatgcagctatgacaactgaaatcaatcaaactactggccgccttcgttattgctggagcaatatctgcttgcatatgtttactttggattttctgaaccaagtgacaaacagtcttgaaaaggatagcatttaccatctagccgagaagagaattccttcagtccatgggtacacatcaggattaaagcttgaacaatttatatttgatgtattcaactattctccttcaacagctctttttgaggttttgcgtgaggaggaatttgcgccagtgaagaatgctaatggtgcaacttatgacactcctgacagtgccagattaatgctgcttcggctacatagccgctgggtggttgctgcaggtggcttcttgactcattctgtgcccttgtatatgacaggagttgaagtttctccgctttgctcttatgctggagagaatctagaagctatatgcagtggaagaacattccatgcaccaagtgagatttcattctaggcatagtagttgttgcaagcaatctgaatacaggaagatgagatcaggccaattttgattacaacatgactactcttgcaaatagaatgttgatattagtaaactattgtatgttatgcaaggatcaaatattgtaacgcaacacctgaagttgcctcctttctcccctagcattaatgtgtatctgcctttcgaatgtagattatgacatgcttttgtgtaataattttttttgaaaacagcaaatgtaccaaatatttattatctttgaacaattgtaattcttgattctatgaactatgatgtaagaaaaatcaaacaatgagatgttctattttct

SEQ ID NO: 1019 - DNA, 2517 bp, Sorghum bicolor
agacgacagggttagatttcttgttgcaggaacagtccaacggcgttcgctgtaatctgctcgcgtccaaattaatacaggaggataagagtgtgagactgacacatgcacacagggatcacgcccggtatataaacgcgcaggcgcaggcggcccacccaccggcgacggcgatccgagaacaatccgtcgtccgagttggcatctttggccaaaccagtatcattgcccaatcacagatctcctctccctctctctctcatttcccactacctgctcttgctgctgcttgtgcggtgggcgctgcgggcggtgaggaggagcggagcagagaggtgaaaggggatgaaggaagagatggtggtcggcctgtcggcgccggggccggtggggaggtggggcgccgcgccgccgcaggcgatgctcgagaggatgaaggactacggccaggagggcgccttcgcgctctgggacgatctctcgcccgaggaccgggagctcctcgtccgggacatcgagagtctagacctttcaaggatcgatcggatcatccggcggtcccttggatcacaaggcatcccattgcctgctgtcgagcccgtgccagaatctagcgtctccaaggtggaggacaggtctcctgaggacaaagaaagatggtggaagaaggggctgaaagccatctcggaggggaagctggctgttgtccttttggccggtggtcagggtactcgactgggaagctcagatcctaagggatgtttcaatattggacttccatctggaaagtcacttttccaactccaagctgaacgtattttgtgtgttcaaaagctagctgctcaatctagtgaaagtccgagtaacactgtgccgatccactggtacataatgacaagcccctttacagatgctgtcactcgcaaattctttgagacccgtagatattttggcttggaccctgaccaagtgacatttttccaacaaggcacacttccatgtgtttctgctgatggtagatttattatggagacaccatatagggtagcaaaggctcctgatggcaatggtggagtttatgctggttcgagttgcagatcctacattcttaggtacttcattgacaaaggtgtatcttctgctgccaaagtggttaggaaggcttatccacaagagaatgttggggtatttgttcaacgaggtcgtggtggacctctctcggtggttgagtacagtgaaatggatgcagctatgactactgaaattaatcaatcaacagggcgacttcgttattgttggagcaatatctgtctgcacatgttcaccctggactttttgaatcaagtggcaaacagccttgagaaggacagtgtatatcatctagctgagaagaagattccttccatccatgggtttacaacaggcctgaagcttgaacagtttatattcgatgctttcacttattccccatccacggcactttttgaggtcatgcgggaggaggaattcgcaccagtaaagaatgccaatggcacaacatatgacacccctgatagcgcaaagctcatgctactccgcctccatagcagatgggtagtcgccgctggtggcttcttgacgcattctgtgcccttgtatatgacaggcgtcgaagtttctccactttcctcctatgctggagagaacctggaagcaatctgccgtgggcggacattccatgcgccaagtgagatatcattctaggtaggcctgtccatggcagcagctgagcagcagttgtgtaactgtaaaacaaacggaaaggattgcagggtgcgtatattttcttgtaggcgtgagatggatgtggatgggcgggttgttgtgtacttgtatgttctgtgcgtgttgtaatgtagcatctcgaactccaaattcatcttgagttttctcctcatctccttgcagttcaatttttttgcttcacctgtgttgctccagtgtagtgtagatggttttgaggccgtgtggaatcaacgaagtcttgttcatttggctgataagccgtggtagaaagtattgttagctgatttgttatgagaaaaaaaaacattgctgaatggctctcaaatgcaatgcctttggaacgcctttggaattccaatggctgcagttgtggcagtcttgcacggagcctgcacaactctggagtctggactgaaaaaacaatgccgtccaggatgtggagagaagcagcagcctgctcaaaacgggaagaccgttcgtccaagcaggccacgggattcgtatcgccaaatttgataggctgatccgcaagttgcacaaagtgatggcacatggcagactggctggcacgtacaaatggtcttgctaactgatcgagataaacacttttttccctactctatttcaaatctttcccggaaatgtatatgcgtctgctctagcctctaggtctgttctaggcaatgtataggtgtacaaatgtacagaagaaccatgatgaagcttcgttct

SEQ ID NO: 1020 - DNA, 1819 bp, Elaeis guineensis
gcgggcggggcgagatatagagagatatgaaggagatggtggtgggatctgaggtagggcgagggggacgccgccgccgccgccaccgcaggcgctgctagagaggctcaaggactacggccaggaggacgccttcgccctctgggacgagctctcgcaggaggagcgcgacctccttgtcaaggacattgagagcttagatcttccgagggttgatcgaatcattcgatgttctcttggatcacaaggccatcctttgcctgcgattgagccggtcccagaaggtagtgtctcgacagtggaagagaggacccctgaagaaagagagaggtggtggaagcgggggctgaaggccattgcagaagggaagttagctgttgtccttctgtctggcggacagggaactcgtcttggaagttcagatcccaagggatgctttaatattggcctcccatcaggaaagtcactttttcagcttcaagctgagagaattttgtgcgtccaaaggcttgcagctcagtccattgatggctcagcaggtaccgtcccaatccactggtacataatgaccagcccatttactgatgaagctacatgcaagttttttgaaagccataagtattttggtttggaagctgatcaggtcacctttttccaacaaggtactcttccctgtgtttctggagatggcagatttattatggagactccatacaaggtggcaagggctcctgatggaaatggaggactatatgctgctctaaggtcctcaagattactggaagatatggctatgagaggtgtgaaatacgtggatgtctatggagttgataatgctctggtccgtgttgcagatccagcattcttgggatactttattgataaaggtgtaactgctgcagcaaaagttgttcgcaaggcttatccacaagagaaggttggggtctttgtccagcggggtagaggtggacctcttactgtgatggaatatagtgaaatggatccatcaatggcttctgagatcaatcagaccactggacgccttcgcttttgttggagtaatatatgcttacatatgttcacgctggattttctaaatcaagttgcaaatggccttgagaaagacagcatttaccacctagctgaaaagaagattccttctattcatggatataccataggtttgaagcttgaacagtttatatttgatgcatttgcatatgctccatcaacggcactatttgaggtcttgcgggaggaggaatttgcaccagtgaaaaatgctaatggggcaagttacgacactcctgatagtgctcgacttatgcttctccgcctccacagccgttgggtagttgctgcaggtggcttcttaacacattcagtgccgctatatttaactggcgtggaaatctcgcctctatgttcatatgctggagagaaccttgaagctatatgccgtggaagaacgtttcatgcaccatgtgagattgcattctaggcgaggtaactgccagccgattttcgagttgccagctttctctggtaacgcaagcatcagattatccttgaaattaacttaaaatgtgttgtacaacagcacaagatccatcaacttcgatgcgatttggtcatatcacttataatcagatgtgtatgtgtagttcttcatatccaatttttcctgtttagggttcctgaagcgtctatgttacttgtttggggtaatagttaaaatcaagttttagcaatatttggctcagtttgcaatttggtgcagtgagagaaaccaatagtccatatgtcatccactaatttt

SEQ ID NO: 1021 - DNA, 2007 bp, Musa acuminata
ggccacaagccacgagggtatataacgtgcaccctctgcccctttgtctcggcggttcgaactcctctgcctcctctcggcttgctctgtttcggtggaaggaggaatgaaggagatagtggtcggatccgatgtggggcggagggggacgccgtcgcctccaccgccgcctccgcaggcgttgctggagaggctcaaggactacggccaagaggacgccttcgccttctgggacgagctctcgccggaggagcgcaacctcctcgtgaaggacatcgagagcttagatcttcctagaatcgatcggatcattcgatgttcacttggatctcaaggcctgccgttgcctgctgttgagcccgtaccggaggctagtgtttcaactgtggaagcaagaagccttgaggaaagagagaggtggtggaagaggggattgaaggctatttcagaaggaaagttagctgtggtacttctttccggcggacagggcactcgtcttggaagttcagacccgaagggatgtttcaatattggacttccatctggaaaatcactctttcaacttcaggctgaaagaattttgtgcatccaaaaacttgcatctcagtcaaacgacactggttttatgccgatccactggtacataatgactagtccatttactgatgaagccacccgcaaattcttcgaaagtcataaatattttggcttagaatctgatcaagtgacatttttccaacaaggtacacttccctgtgtttctggggatggcagattcatcatggagactccgtataaggtttcaagggctcctgatggaaatggaggattatattctgctcttaaatcttcaaaattactggaagatatggcaatgagaggtgtgaaatatgtagattgttatggagttgataatgtgctggtccgtgttgctgacccagcattcttgggatattttattgacaaaggtgtggctgcagcagcaaaagttgtacggaaggcctacccacaggaaaaggttggaatctttgtccagagaggcagaggtgggccttttgcagtggttgaatacagcgagatggatgcatcaatgacgactgagatcaatcagaccactgggcggcttcgctattgttggagtaatgtatgcctacatatgttcaccctggatttcctgaatcaagtagcaaatggccttgaaaaagacagcatttaccacctggctgagaagaaaatcccttcaatccatggattaactattggatttaagctggagcagttcatttttgatgcatttgcatatgctccatcaatggcactttttgaggtcccgagggaggaggaatttgcacccgtcaagaatgccaatggagcaagttatgatactcccgacagtgctcgactgatgcttcttcgcctccacagtcgttgggtagttgcagctggtggctttttgacacattcagtgcctctatacctaactggtgtggaaatctctccactttgctcctacgctggggagaacctcgaagctatatgccgtggaagaactttccacgcacccagtgagatcacgatttaggaggatgaatccttcagaggatgatatggatctggcatgtttcctacatattattcgtgttgttgatgatgattaaactaacaggatgatcttggccctgagtttcatttctggcaagtcttggatttgcagctgatgctcattaaattttgtgttttcagcgtctgttatttgtgcaagacttgtctattttaaaatatatggtgtaacatctgagcttgtatggttgacaaactttatatgatacggtgttaattttaatattctatcagatttgcgtgatatcaatgaaacaggtggtaattaaaaatttatataccgctttaccggtctgtatatattgtatcatccagggtgtaaaaaatatgaatcctggatccagcagtgtgttatagagtagatagggacttgttttaattgttttt

SEQ ID NO: 1022 - DNA, 1810 bp, Musa acuminata
gtgtgctcagtccatccgcgcaccgacacggagatgacggagatggtggtgggatccgaggtcgggcggagggggacgccgtcgccgccgccgccgccgcaagctctcctggagcggctcaaggactacggccaggaggacgccttcgcgctgtgggacgagctctcgcccgaggagcgcgacctcctcgtcaaggacatcgagagcttagatcttccacgggtcgatcggatcatcagatgctcacttggatctcaaggtgcatatttgcctgccgtggagcctgttccggaatctagtgtctcgaccgtagaagtgagaactcttgaagaccgagagaggtggtggaagaggggactgaaggccatttcggaagggaagttagctgttgtacttttatctggtggacaggggactcggcttggtagttccgatcctaaaggatgctttaatattggtcttccatctggaaagtcactttttcaaattcaagctgagagaattttgcgtctccaaagacttgcagctcagtcaaatgatgctggttttgtgccaccaatcccatggtacattatgactagcccatttactgatgaagccacccgcaggttttttgaaagacataagaattttggcttggaagttgatcaagtgacctttttccaacaaggcacccttccgtgtgtttcaagtgatggtagattcatcatggagacaccatacaaggtgtccaaggctcctgatggaaatggtggactctattcagctcttaaattgtcaaagctgctggaagacatggccatgagaggtgtgagatatgtggactgttatggggttgacaatgcattggttcgcgtagcagatccgacgttcttaggatactttattgacaaaggtgtggctacagcagcaaaagtcgcttatccacaagagaaagttggagtctttgtccagcgaggcagaggtggacctcttacggtggtagagtacagtgagatggatgcatcaatgactactgagattaatcagagcactgggcgcctacgctattgttggagtaacgtatgcttacatatgttcactctggatttcctgaatcaagtggcaaatggcctcgaaaaggacagcatttaccacctagctgagaagaaaattccttcgatccacggatacactatgggtttaaaacttgagcagttcgtatttgatgcatttacatatgctccatcaatggcactttttgaggtcttgcgggaggaggaatttgcgccggtcaagaatgccaatggggcaagttacgacactcctgatagtgctcgcctgatgcttctccgcctccatagtcgctgggtggttgctgcaggcggcttcttaacgcattcagttccattatacttaactggtgttgaaatctctcctctttgctcctacgccggggagaacctcgaagggttatgccgtgggagaacgtttcatgcaccgtgcgaaatttcattttgaggcaggctgggaaaacgctcttggcagcctgtaatcttgtgtacactaatattatgtatcggacatggtttgcctcagctatgatcctttatctgaattttaccagtcataatctgcgacacatgaagagtttgtatctctcttgagtcaccagagttttatcgcagtcgatccaagttggatcgacaatgtttagagcacgggaaccacaagtatgtaatttatattacacttttgtgtttgaaacaactgcattgtcagcactccttttacatctccgtaatatatgatgagtaccaaattaatctga

SEQ ID NO: 1023 - DNA, 979 bp, Leymus cinereus x Leymus triticoides
  misc_feature (5)..(6): n is a, c, g, or t
  misc_feature (8)..(9): n is a, c, g, or t
gtttnntnntcccgtgaagaaacacaagaagggaggaggcagcacgcaattagccagcgctcgcaccctacgcttctcaattgacccgatcgaggagtcgccaagcaggccgcgagagcaagcgaagaggcagccatggccaccgccaacctgtccagcgttgtggtggcggttgacggcagcgaggagagcatgaaggcgctgcgctgggcgctcgacagcctgcgcctccgccccgacggcgcgctcgtcgtgctccacgtccagccgccgcccggcatcgccgcggggctcaaccccggccccatccccttcggcggccccagtgtggcggaggtgccggcgttcacgcaggccatcgaggcgcaccagcggcggatcacggaggcgatcctggagcacgcgctcaagatttgctccgacaagaatgtggaggtgaagacgcaggtggcggtgggtgatcccaaggagaagatctgcgaggtgacggccgaactcaaggccgatctgctcgtcatgggttgccgtgcttttggccctgtcaagaggatgttcttgggtagtgtgagcaactactgcatcaacagcgtcggctgccccgtcgtcgtgatcaagggcacctgacccatcctcgacccaacaaacattccttattgtgttccacaccatgttttttgaggttgccactgtgctgtatgtactcctgtgcaaagccactgcgtgcttccaagactatgtatggcttatgttatcatccatgttgtttgttagtgcttggttgggatgaaggccgaagaactgctctgtacattctgtgcatggaaattggttgtgggatccgtggaaataagtctgcacagcgtgcacgctgttttgtaaattgatcatcgttgtatcagctaaaacacggtgccatggggcacgtggttttgtacaatgcagggtttgcaagttgcaagaatccctggtttctttgtca

SEQ ID NO: 1024 - DNA, 992 bp, Pseudoroegneria spicata
  misc_feature (404)..(404): n is a, c, g, or t
gtgaagaaacacaagaagggaggaggcagcacgcaatcagccagccagcccagtcgctcgccctcgccgctgctcaattgacccgatcgaggagtcgcccaggccgagcgaaggggcagccatggccaccgccaacctgtccagcgtggtggtggcggttgacggcagcgaggagagcatgaaggcgctgcgctgggcgctcgacagcctgcgcctccgccccgacggcgcgctcgtcgtgctccacgtccagccgccgcccggcatcgccgccgggctcaaccccggccccatccccttcggcggccccagtgtggcggaggtgccggcgttcacgcaggcgatcgagtcgcaccagcggcggatcacggaggcgatcctggagcacgcgctcaagatttgcnccggcaagaatgtggaggtgaagacgcaggtggtggtgggggatcccaaggagaagatctgcgaggtgacggccgaactcaaggccgatctgctcgtcatggggtgccgtgcttttgggcctgtcaagaggatgttcttgggtagtgtgagcaactactgcatcaacagcgtcggctgccccgtcgtcgtgatcaagggcacctgacccatcctcgacccaacaaccattcgttgctgcgctccacaccatgttttttgaggttgccaccgtgctgtatgtactcctgcgcaaagccactgcacacttccaagactttgtatggctggtgttatcattcatgttgtttgtttggtgcttggttggatgaggccgaagaactgctctgtacattctgtgcatggaaattggctgtgggtctctggaaataagtctacacattggtacattaattaatcgatttttgtaatttccccaataattaattattgtatcagctaaaacacggtgccatggggcacatggttttgtacaaaacatttgttatgcagggcttgcaagttgcaataatcctttgggttctttgtca

SEQ ID NO: 1025 - DNA, 986 bp, Secale cereale
tgtcgccctctacagctgaagctcgcgccgcgaaggtttctttaatcccgtgaagaaaacacaggaagggaggaggccgcacgcaattagccagcgctcgcaccctacgcttctcaattgacccgatcgagggagtcgccaagcaggccgcgcgagcaggcagccatggccaccgccaatctctccagcgtcgtggtcgcggtcgacggcagcgaggagagcatgaaggcgctgcgctgggcgctcgacagcctgcgcctccgccccgacggcgcgctcgtcgtgctccacgtccagccgtcgcccggcatcgccgccgggctcaaccctggccccatccccttcggcggccccagtgtggcggaggtgccggcgttcacgcaggcgatcgaggcgcaccagcggcggatcacggacgcgatcctggagcacgcgctcaagatttgctccgacaagaatgtggaggtgaagacgcaggtggtggttgggggatcccaaggagaagatctgcgaggtgacggccgaactcaaggccgatctgctcgtcatggggtgccgtgcttttggccctgtcaagaggatgttcttgggcagcgtgagcaactactgcatcaacagcgttggctgccccgtcgtggtaatcaagggcacctgacctatcatcaacccaacattcgttcgtgtgctgtatgtaatcctgtggaaacgactgctctgtatgtatgttcatgttgtttgcttggttgcgccgagagatgaggtcgaagaaatgctccgtacattcttctgtgcatgggagaagacgcatcattggttgtggatctgtgtgggaataagcctgcgccgctggctgcacattgttttgtgcattaattactgctgtatcatcatcagctaaaacacggtgccatggagcacatggctttgtacaaaacattgataatgccgggcttgcaagttgcaagaacccctggtttccttgtaaa

SEQ ID NO: 1026 - DNA, 977 bp, Secale cereale
tcgccctctacagctgaagctcgcgccgcgaaggtttctttaatcccgtgaagaaaacacaggaagggaggaggccgcacgcaattagccagcgctcgcaccctacgcttctcaattgacccgatcgagggagtcgccaagcaggccgcgcgagcaggcagccatggccaccgccaatctctccagcgtcgtggtcgcggtcgacggcagcgaggagagcatgaaggcgctgcgctgggcgctcgacagcctgcgcctccgccccgacggcgcgctcgtcgtgctccacgtccagccgtcgcccggcatcgccgccgggctcaaccccggccccatccccttcggcggccccagtgtggcggaggtgccggcgttcacccaggcgatcgaggcgcaccagcggcggatcacggacgcgatcctggagcacgcgctcaagatttgctccgacaagaatgtggaggtgaagacgcaggtggtggttggggatcccaaggagaagatctgcgaggtgacggccgaactcaaggccgatctgctcgtcatggggtgccgtgcttttggccctgtcaagaggatgttcttgggcagcgtgagcaactactgcatcaacagcgttggctgccccgtcgtggtaatcaagggcacctgacctatcatcaacccaacattcgttcgtgtgctgtatgtaatcctgtggaaacgactgctctgtatgtatgttcatgttgtttgcttggttgcgccgagagatgaggtcgaagaaatgctccgtacattcttctgtgcatgggagaagacgcatcattggttgtggatctgtgtgggaataagcctgcgccgctggctgcacattgttttgtacattaataattacgtactactgtatcatcagctaaaacacggtgccatggagcacatggctttgtacaaacaattgataatgcagggcttgcaagttgcaagaacccctggtt

SEQ ID NO: 1027 - DNA, 1014 bp, Triticum aestivum
ggcacgaggcgaaggcttctttaatcccgtgaagaaacacaagaaggggcaagaagggaggaggcagcacgcaatcagccagctctcgcactctacgcttctcaattgacccgatcgaggagtcgcccaggccgagcgaaggggcaggcagccatggccaccgccagcctgtccagcgtggtggtggcggtcgacggcagcgaggagagcatgaaggcgctgcgctgggcgctcgacagcctgcgcctccgccccgacggcgcgctcgtcgtgctccacgtccagccgccgcccggcatcgccgcggggctcaaccccggccccatccccttcggcggccccagtgtggcggaggtgccggcgttcacgcaggccatcgagtcgcaccagcggcggatcacggatgccatcctggagcacgcgctcaagatttgctccgataagaatgtggaggtgaagacgcaggtggtggtgggggatcccaaggagaagatctgcgaggtggcggccgaactcaaggccgatctgctcgtcatggggtgccgtgcttttggccctgtcaagaggatgttcttgggtagtgtgagcaactactgcatcaacagcgtcggctgccccgtcgtcgtgatcaagggcacctaacccatcctccacccaacaaacattcgttattgcgttccacaccatgttttttgaggttgctactgtgttgtgtgtactcctgtgcaaagccactgcatgcttccaagactatgcatggcttatgttatcattcatgttgtttgttagtgcttggttggatgaggccgaagaactgctctgtacattctgtgcatggaaattgccaaattggttgtgggatccgtggaaataagtctgcacagcgtgcacgctgttttgtaaattgatcattgctgtatattatcagctaaaacacggtgccatggggcacatggttttgtacaaaacattgtacgcggggctttgtccgatctgatctggtttggtttggcc

SEQ ID NO: 1028 - DNA, 1037 bp, Triticum aestivum
caagaggcaagtgtcgtcctcttacagccgcgccgcgaagctttctttaatcccgtgaagaagcagaggaggcggcacgcaattagccagcccagtcccctcgccctcacgctgctcaattgacccgatcgaggaggagtcgccaattaggccgagcgaaggggcagccaagccatggccaccgccaacctgtccagcgtggtggtggcggtcgacggcagcgaggagagcatgaaggcgctgcgctgggcgctcgacagcctgcgcctctgccccgacggcgcgctcgtcgtgctccacgtccagccgccgcccggcatcgccgccggcctcaaccccggccccatccccttcggcggccccagtgtggcggaggtgccggcgttcacgcaggccatcgagtcgcaccagcggcggatcacggatgccatcctggagcacgcgctcaagatttgctccgataagaatgtggaggtgaagacgcaggtggtggtgggggatcccaaggagaagatctgcgaggtggcggccgaactcaaggccgatctgctcgtcatggggtgccgtgcttttggccctgtcaagaggatgttcctgggtagtgtgagcaactactgcatcaacagcgtcggctgccccgtcgtggtgatcaagggcacctgacccatcctcgacccagcagacatttcttattgtgttccacaccatgattcttgaggttgctactgtgttgtacgtactcctgtgcaaattcactgcacacttccaagaccgccgtatggcttgtgttatcattcatgttgtttgttagtgcttggttggatgaggccgaagaactgctctgtacattccgtgcatggagattgccaaattggttctggggtccgtggaaataagaatgcacagcgtgcacgctgttttgtaaattgatcattgttgtaagtatatcagctaaaacatggtgccatggggcacatggttttgtacaaaacattgtacgcggggctttgtcctatctgatctggtttggtttggcc

SEQ ID NO: 1029 - DNA, 1062 bp, Triticum aestivum
gatgcggcgtgccgccagactgtcaccattaccaagaggcaagtgtcgtcctcttacagccgcgccgcgaagctttctttaatcccgtgaagaagcagaggaggcggcacgcaattagccagcccagtcccctcgccctcacgctgctcaattgacccgatcgaggaggagtcgccaattaggccgagcgaaggggcaggcagccatggccaccgccaacctgtccagcgtggtggtggcggtcgacggcagcgaggagagcatgaaggcgctgcgctgggcgctcgacagcctgcgcctctgccccgacggcgcgctcgtcgtgctccacgtccagccgccgcccggcatcgccgccggcctcaaccccggccccatccccttcggcggccccagtgtggcggaggtgccggcgttcacgcaggccatcgagtcgcaccagcggcggatcacggatgccatcctggagcacgcgctcaagatttgctccgataagaatgtggaggtgaagacgcaggtggtggtgggggatcccaaggagaagatctgcgaggtggcggccgaactcaaggccgatctgctcgtcatggggtgccgtgcttttggccctgtcaagaggatgttcttgggtagtgtgagcaactactgcatcaacagcgtcggctgccccgtcgtcgtgatcaagggcacctgacccatcctccacccaacaaacattcgttattgcgttccacaccatgttttttgaggttgctactgtgttgtgtgtactcctgtgcaaagccactgcatgcttccaagactatgcatggcttatgttatcattcatgttgtttgttagtgcttggttggatgaggccgaagaactgctctgtacattctgtgcatggaaattgccaaattggttgtgggatccgtggaaataagaatgcacagcgtgcacgctgttttgtaaattgatcattgttgtaagtatatcagctaaaacacggtgccatggggcacatggttttgtacaaaaattgtacgcggggctttgtccgatctgatctggtttggttt

SEQ ID NO: 1030 - DNA, 912 bp, Secale cereale
ggaggccgcacgcaattagccagcgctcgcaccctacgcttctcaattgacccgatcgagggagtcgccaagcaggccgcgcgagcaggcagccatggccaccgccaatctctccagcgtcgtggtcgcggtcgacggcagcgaggagagcatgaaggcgctgcgctgggcgctcgacagcctgcgcctccgccccgacggcgcgctcgtcgtgctccacgtccagccgtcgcccggcatcgccgccgggctcaaccccggccccatccccttcggcggccccagtgtggcggaggtgccggcgttcacgcaggcgatcgaggcgcaccagcggcggatcacggacgcgatcctggagcacgcgctcaagatttgctccgagaagaatgtggaggtgaagacgcaggtggtggttggggatcccaaggagaagatctgcgaggtgacggccgaactcaaggccgatctgctcgtcatggggtgccgtgctttcggccctgtcaagaggatgttcttgggcagcgtgagcaactactgcatcaacagcgtcggctgccccgtcgttgtaattaagggcacctgacctatcatcaacccaacattcgttcttgtgttgtgtgtaatcctgtgaaatggctgctctgtatgtatgttcatgttgttgcttggttttgcttggttgcgccgagagatgaggtcgaagaagtgctccgtgcattcttctgtgcatgggcatcattggttgtggatctgtgtggcaataagagcctgcgccgctggctgcacattgttctgtacattaattactactgtaatcatcagctaaaacatggtgccatggagcacatggctttgtacaaaacattgataatgccgggcttgcaagttgcaagaacccctggtttccttgtc

SEQ ID NO: 1031 - DNA, 813 bp, Secale cereale
aatctctccagcgtcgtggtcgcggtcgacggcagcgaggagagcatgaaggcgctgcgctgggcgctcgacagcctgcgcctccgccccgacggcgcgctcgtcgtgctccacgtccagccgtcgcccggcatcgccgccgggctcaaccctggccccatccccttcggcggccccagtgtggcggaggtgccggcgttcacgcaggcgatcgaggcgcaccagcggcggatcacggacgcgatcctggagcacgcgctcaagatttgctccgacaagaatgtggaggtgaagacgcaggtggtggttggggatcccaaggagaagatctgcgaggtgacggccgaactcaaggccgatctgctcgtcatggggtgccgtgctttcggccctgtcaagaggatgttcttgggcagcgtgagcaactactgcatcaacagcgtcggctgccccgtcgttgtaatcaagggcacctgacctatcatcaacccaacattcgttcttgtgctgtatgtaatcctgtggaaatttgctgctctgtatgtatgttcatgttgctgcttggttttgcttggttgtaagagatgaggtcgaacaagtgctccgtacactcttctgtgcatgggagaaaacgcatcattggttgtggatctgtgtgggaataagcctgcgccgctggctgcacattgttttgtacattaataattacgtactactgtatcatcagctaaaacacggtgccatggagcacatggctttgtacaaaacattgataatgcagggcttgcaagttgcaagaacccctggtttcct

SEQ ID NO: 1032 - DNA, 963 bp, Brachypodium distachyon
tccagtaaattaaccacgcgacagcgaaggagcaaaggcagcacgcaacgcaacctgacgctagcttcgctgggggcatcagcatcatcagccatggcgacggggggcggcaacctgggcagcgtggtggtggcggtggacggcagcgaggagagcatgaaggcgctgcgctgggcgctcgacagcgtccgcctccgccccgacggcgcgctcgtcgtgctccacgtccagccgcgcccgggcatcgccgccgggctcaaccccggccccatccccttcggcggccccagggaggtggaggtgccggcgttcacgcaggcgatcgaggcgcaccagcggcggatcacggaggccatcctggagcacgcgctcaagatttgcgccgagaagaacgtggaggtgaagacggaggtggtggtgggggatcccaaggagaagatctgcgaggtggcggccgagctcaaggccgatctgctcgtcatgggatccagggccattgggcctgtcaagaggatgttcttgggcagcgtgagcaactactgcatcaacagcgtgggctgccccgtcgtcgtaatcaagggcacctgaagaccatcttcgaaccaacattctctgctttgctgcagtccacatcaagtttttgatgcaatctgtaatcctgcgcgacacaatgttttcgtgtcacctggcgttgtttggtggtgtgtggttccgatggacgacaactgctctgctgtgcgtgcatacaacgtatatcccgtgcaaaggaaaatgtgtgtattattggttttgtggactttgtgggggaataagcgccggtgtagcacatggttttgtgtactcctgtggttctggccttctgggaaaacgtggtaccatgtggcatgtgaatgtgaacatttgcgaaatgtaaaaccctccatcctgtgttctttatctgatatcggcaaacaacttaacaca

SEQ ID NO: 1033 - DNA, 2274 bp, Brachypodium distachyon
aagctcggggcgccaacggttgatcgatccagtaaattaaccacgcgacagcgaaggagcaaaggcagcacgcaacgcaacctgacgctagcttcgctgggggcatcagcatcatcagccatggcgacggggggcggcaacctgggcagcgtggtggtggcggtggacggcagcgaggagagcatgaaggcgctgcgctgggcgctcgacagcgtccgcctccgccccgacggcgcgctcgtcgtgctccacgtccagccgcgcccgggcatcgccgccgggctcaaccccggccccatccccttcggcggccccagggaggtggaggtgccggcgttcacgcaggcgatcgaggcgcaccagcggcggatcacggaggccatcctggagcacgcgctcaagatttgcgccgagaagaacgtggaggtgaagacggaggtggtggtgggggatcccaaggagaagatctgcgaggtggcggccgagctcaaggccgatctgctcgtcatgggatccagggccattgggcctgtcaagaggatgttcttgggcagcgtgagcaactactgcatcaacagcgtgggctgccccgtcgtcgtaatcaagggcacctgaagaccatcttcgaaccaacattctctgctttgctgcagtccacatcaagtttttgatgcaatctgtaatcctgcgcgacacaatgttttcgtgtcacctggcgttgtttggtggtgtgtggttccgatggacgacaactgctctgctgtgcgtgcatacaacgtatatcccgtgcaaaggaaaatgtgtgtattattggttttgtggactttgtgggggaataagcgccggtgtagcacatggttttgtgtactcctgtggttctggccttctgggaaaacgtggtaccatgtggcatgtgaatgtgaacatttgcgaaatgtaaaaccctccatcctgtgttctttatctgatatcggcaaacaacttaacacagctagcctggtccatgtccaaggtctatctccttcgcctctaccagtctcccacccaccctgttctcctctgttgcttccactcgtttccccgcatagtacgtgaccggctgaaatttgcattatttccccccctgaacattactggtacgttccactgagtgtagcggataacactcatctctagcatccggaaggaaagtaaaattgcagatcaaattggactgaagaactaaagaagcgtacagtaccttttttttcgttgacattatattaaggataaattcgtccctaatccaccaaagttactcgtaattggcagtcatgaggtactggattgcgttttaggcaaatttttactttcagtttggaagaaattgacctgccattcagggagaattatggttcttttatgtcaaggcttccactgaaagtctgaaattttattttcgatccgccgctgctgactggcggacccgttccctccccacacgtcagtcaccaagcgtggctaatgtctttttgggggggaggtgtgtgcaatgttgcatagcaaaggagataaaatatcccctgaaatataggcagcatcaccaaggatcagaactcatcacaacaccaacgctgcgccgccgccgaattgtggacaggagaaccggacgacggaaagatggggttcgagaaggagatcctcaaagtcggcacaggccccaagcccgtcaagggccagaaggtcaccgtccactgcaccggctacgggaaggatggtgatctgtccaagaagttctggagtaccaaggaccctgggcagcagccatttagtttcaacattggcctgggttcagtgatcaaaggatgggatgagggagttatgaccatgcagttgggcgaaattgctcgtattcggtgcaccccagattacgcttatggatccggtggcttcccagcctggggaattcaaccaaactcggtgctggtgttcgagattgaggttcttagcgcaaagtgatgcactgtgtaattcttgacggagccatggaacagtgccgtgtcgccgtgcctcttcagtaccgaataattgtaacatgacatcctgttgacattggggtgatgttctgagtggatttgagtaaaaacattttcaaaaccttattatggtctgtcgtccagaatttgtgttgtttgttgaatctgcgatctgcatcagtgctgttgtatgtggcgctttggtgccatcctgttccggcttttagcaggaaattaaataaccttattatggcgcgca

SEQ ID NO: 1034 - DNA, 2955 bp, Oryza sativa
ctcgatccgttgatccgacggatccaagcttcccaacccaaagcgcatcagacggccatgtgacatgacaagagagagagagtcaaggagtcacttgcacagctcagcggaaggctgcgtagtcatctcgtttgatcgagctgagcacgagaggagaagaagcaagcacgcgacgcaaccatcgccgcgcctccgcgacccctgactgcgcgaggaggcgagctcgggccggagctgagggagctcgccatggcgaccggcaacctggccagcgtggtggtggcggtggacgggagcgaggagagcatgaacgcgctgcggtgggcgctcgacaacctccgcctccgccccgacggcgcgctcgtcgtgctccacgtccagccgccgccgagcatcgccgccgggctcaaccccggacccatccccttcggcggcccgagcgaggtggaggtgccggcgttcacgcaggcgatcgaggcgcaccagcggcggatcacgcaggctatcctggatcacgcgctcaagatttgctccgagaagaatgtggaggtgaagacggatgtggtcgttggggatcctaaggagaagatctgcgaggtgacggcaaatctcaaggccgatctgctcgtcatggggtgccgtgcttttggccccctcaagagaatgttcttaggaagtgtgagcaactactgcatcaacaatgtggtctgtccagttgttgtaatcaaaggcacttgagccatcttcgatcagtattctttgctgcactttaagtcaagcctctgaggttgctactgcgctatcatccgtaatggtactgcatatttcacatttggagactagtttgttgtgcatctttttgtcacatggtggtatttacggatgatagttgtcgcgtgcatttgagcaaggaaatatgtattgattgttcaattgtagaaataaatgtgccatgtagcacattgttttgtatattcttgtatttgttctgtgctaaacatcacaaacttggcagaagtgagttcccttttgtatgaatcctgtcatacttttatgttccttgagatgtccaaagtaaactattccaatttccagccttgtttcatatcataatcttatacgcgtggaaatttgcaaagaattgaatatgcaagagtaaaaaacagcagttctgacttctcagtagtcagtactgcatcttataaccagatgccgaactgctacgattgcattattcagagatgcacatgctgaagcacaagcgtgataacaaggataggtgatcaagacgaacaatgctcattccaaacggataccatacagtagtgcaattggagatcagtagatcaccagtcaccactgaatacaaaacaacaaattggagactatcgaacgaagcatacacacatactggtaagcagtagcacaccatcaaactcaatcatcacgcacgacagacaacttaaataaagaacttcagaaaaaagcaaaccaaccatttcttttggcaggcagagagcatcacccccctggatttgcaatggacaagaatgctcttcttcagttgagctttttccctgttccaattcaggcttcgtttcaatatcctgtagatgggttcagtctcacgctcctgttgagctgctgctgttgcgctccatgaacagccttatcctgaaggacgagaggatgtgctggctgcagcttattcacattccacattgctgggaaatcaactgcaatcactggacgatgacgcaattttagccacgcttgatgcgcgtgagccgctgatgctccagtgatgtgaggcagtaagagcttcctcctgaagttcttgagttcagcgagggcagtgtcagctgtttgagcagaaaacgcaagaactccttccttcagagcaggagtcgtcgctgccatccctgttctggcgccggcaatcccattgtcgccgccgacgcgggcaatcttcttgatcccgacgaaagtctcggtgaaccgacggatgtaaaccacgcggtagttcggcggcaagcggaactcgctcgccgagccaattggggcggcaaagatgccgccatccttgagcaccctgtcgacgaggccaaccctgtcgccgtccttgtcgaagtagccgaaatccagcacgaagtcgacggacaggtcccccgtcgtcagcaactcccgcggcgtgatgcgtcgcatgtcgtcgccgtcgagggcgggagggtggtggtggcagtctccatcggcggcgccgaggaagacggcgcgcgcgccgggggcgagcaggccctcgcggcggaggtcgcggagcaggagccccacctggagcgcgtccccggcgggggcctcggcatcgcggagccaggccagggagagcagcgcgacggcgaggagcaccgagcgcgcgatcacgcggaggacgcgcgggtccgggagccggatcaccacgcagccgtccggcatctgagcgagcgagcgagagagagagctataccgcacagagacggtggcgaagacgaagaggatgatgagtcttccggcgagggagggggggattagcgggtgcagaagcgggcggcggtgtggttgccacccacgagggcgaggcgggcgtgcggcgcgcggagcgtgaggaggaggaggtgacggatccgctcggtctccatggaggcgacgcgccctgcctcacccgcctcgggccggtgggagagatcgatccggcgttaggtctccatcggcggcggccgccggtgggggggagagatcggctacggaatttgggaggttttcgtgggaagaattgggagggtgcgggtggatggcgatgagcggcggcgcgccgggtgtgtccccgtgtttatgggggcggtaccgcgctaggttgggtggcttcggaacggtccggtgggaagcgagcggtccggtcgggggcacagtgggggactgggg

SEQ ID NO: 1035 - DNA, 997 bp, Oryza sativa
gcacagctcagcggaaggctgcgtagtcatctcgtttgatcgagctgagcacgagaggagaagaagcaagcacgcgacgcaaccatcgccgcgcctccgcgacccctgactgcgcgaggaggcgagctcgggccggagctgagggagctcgccatggcgaccggcaacctggccagcgtggtggtggcggtggacgggagcgaggagagcatgaacgcgctgcggtgggcgctcgacaacctccgcctccgccccgacggcgcgctcgtcgtgctccacgtccagccgccgccgagcatcgccgccgggctcaaccccggacccatccccttcggcggcccgagcgaggtggaggtgccggcgttcacgcaggcgatcgaggcgcaccagcggcggatcacgcaggctatcctggatcacgcgctcaagatttgctccgagaagaatgtggaggtgaagacggatgtggtcgttggggatcctaaggagaagatctgcgaggtgacggcaaatctcaaggccgatctgctcgtcatggggtgccgtgcttttggccccctcaagagaatgttcttaggaagtgtgagcaactactgcatcaacaatgtggtctgtccagttgttgtaatcaaaggcacttgagccatcttcgatcagtattctttgctgcactttaagtcaagcctctgaggttgctactgcgctatcatccgtaatggtactgcatatttcacatttggagactagtttgttgtgcatctttttgtcacatggtggtatttacggatgatagttgtcgcgtgcatttgagcaaggaaatatgtattgattgttcaattgtagaaataaatgtgccatgtagcacattgttttgtatattcttgtatttgttctgtgctaaacatcacaaacttggcagaagtgagttcccttttgtatgaatcctgtcatacttttatgttccttgagatgtccaaagtaaactattccaatttcc

SEQ ID NO: 1036 - DNA, 1023 bp, Sorghum bicolor
gccaagcgaagcgagcaagcagcaggctgggtctgcagggaaggggaaggaggtagcggcagcacgcaacttgaaccgacccgtcgcgcctggcgatccctcaccgatcgaggagccggcgacgcttgggaacgagcgacggagacctaggcagaagcaggacaggagctcccccatggcgaccggcaacctggcgagcgtggtggtggcggtggacggcagcgaggagagcatgaacgcgttgcggtgggcgctcgacaacctccgcctgcgccccgacggcgagctcgtcgtgctccacgtccagccgccgcccaacatcgcagcggggctcaacccggcgcccatccccttcggcggccccagcggggtggaggtgccggcgttcacgcaggccatcgaggcgcaccagcggcgcatcacgcaggcgatcctggagcacgcgctgaagatttgctccgagaagaatgtggaggtgaagacggaggtggtggtcggggaccccaaggagaagatctgcgaggtggcggccaacagcaaggccgatctgctcgtcatgggatgccgtgccattgggccgctcaagagggtgttcttgggcagtgtgagcaactactgtatcaaccatgtgggctgccctgttgttgtgatcaaggggacttgagattccctcagcccagcattctttggtgtacctccattcaaggtttttgaggtttctattgtgccatttgtaatcctgtaggatatgttcctgcacattctgcatttgttggtgctgctgagggacgagggttgctatgtggtatctttcatcgtaaaggaggagggttttttggttgtgtaatgtggaaataaatcggtcctgtggcagattgttctgtatattcttgtaattgttgtagacaaggttctgtctgaattctgaagcctgaagtttgaaactgcgcaaattaccaacctcggtttctttgtcggatgtcttttttttagttaatatggctgaactttgccgattactcc

SEQ ID NO: 1037 - DNA, 1150 bp, Sorghum bicolor
atccgcgcaaacttccagatcgggcagcgtccgtacactgccacgtagcaccatgtggccgcaagacaccgcttgattagatcaaagtagagccgggcaattattagctagtgagagttcagtcagctctagtacagctacagccagccaagcgaagcgagcaagcagcaggctgggtctgcagggaaggggaaggaggtagcggcagcacgcaacttgaaccgacccgtcgcgcctggcgatccctcaccgatcgaggagccggcgacgcttgggaacgagcgacggagacctaggcagaagcaggacaggagctcccccatggcgaccggcaacctggcgagcgtggtggtggcggtggacggcagcgaggagagcatgaacgcgttgcggtgggcgctcgacaacctccgcctgcgccccgacggcgagctcgtcgtgctccacgtccagccgccgcccaacatcgcagcggggctcaacccggcgcccatccccttcggcggccccagcggggtggaggtgccggcgttcacgcaggccatcgaggcgcaccagcggcgcatcacgcaggcgatcctggagcacgcgctgaagatttgctccgagaagaatgtggaggtgaagacggaggtggtggtcggggaccccaaggagaagatctgcgaggtggcggccaacagtaaggccgatctgctcgtcatgggatgccgtgccattgggccgctcaagagggtgttcttgggcagtgtgagcaactactgtatcaaccatgtgggctgccctgttgttgtgatcaaggggacttgagattccctcagcccagcattctttggtgtacctccattcaaggtttttgaggtttctattgtgccatttgtaatcctgtaggatatgttcctgcacattctgcatttgttggtgctgctgagggacgagggttgctatgtggtatctttcatcgtaaaggaggagggttttttggttgtgtaatgtggaaataaatcggtcctgtggcagattgttctgtatattcttgtaattgttgtagacaaggttctgtctgaattctgaagcctgaagtttgaaactgcgcaaattaccaacctcggtttctttgtcggatgtcttttttttagttaatatggct

SEQ ID NO: 1038 - DNA, 817 bp, Avena sativa
tctgaccaagaggcagccatggccacccggcaacctgggcagcgtggtggtggcggtggacggcagcgaggagagcatgaacgcactgcggtgggcgctcgacagcctccgcctccgccccgacggcgcgctcgtcgtgctccacgtccagccgccgcccggcatcgccgcggggctcaaccccggacccatccccttcggcggccccaagggggtggaggtgccggcgttcacgcaggcgatcgaggcgcaccagcggcggatcacggatgccatcctggagcacgcgctcaagatttgcgccgacaagattgtggaggtgaagacgaaggtggtggtgggagatcccaaggagaagatatgcgaagtcgcggccgaactcaaggccgatctgctcgtgatgggatgccgggcatttggtcctgtcaagaggatgttcctgggtagcgtgagcaactactgcatcaacagcgtcggctgccccgtcgtggtaatcaagggcacctgagcaatcctccgccgacaacattctttgcatcatgttttttgtgggcttctaccgtgatgtctgtaatcttgtcttgcgcaaagtcactgcacagtttcaagactatgctatgtatcacttggttttggaagggacgaggtcgagctgctctgtaaattgtgtgcaatgaaaagtgtaccattgatttgtgaatctgtggaaaataagtgtgccgttccatggattgatggatgggtacagcacatggttttgtacatgcttgtatctgtaggaaacattatgccatgtggacgtgaacattttatagtc

SEQ ID NO: 1039 - DNA, 862 bp, Saccharum officinarum
attgtaagacgctggttcggctgcactgccgctgcataattggctcgacccacgcgtcctgccaagcgaagcgaacaagcagcaggcagagtctgcagcgaagggggaggaggtggtggcagcacgcaacttgaaccgacccatcgcgcctcgtgacccctcaccgatcgaggagccggcgaggcttgggaacgagcgacggagacctaggcggaggcaggagctcccccatggcgaccggcaacctggcgagcgtggtggtggcggtggacggcagcgaggagagcatgaacgcgctgcggtgggcgctcgacaacctccgcctgcgccccgacggcgagctcgtcgtgctccacgtccagccgccgcccaacatcgccgcggggctcaacccggcgcccatccccttcggcggccccagcggggtggaggtgccggcgttcacgcaggccatcgaggcgcaccagcggcgcatcacgcaggcgatcctggagcacgcgctgaagatttgctccgagaagaatatggaggtgaagacggaggtggtggttggggaccccaaggagaagatctgcgaggtggcggccaaccgcaaggccgatctgctcgtcatgggctgccgtgccattgggccgctcaagagggtgttcttgggcagtgtgagcaactactgtatcaaccatgtgggctgccctgttgttgtgatcaaggggacttgagattccctcagcccagctttctgtggtgtacctcattcaagctttttgagatttctattgtgccatttgtaatcctgtacgatatattactgcacattctgcatttggtggtgctggtgaggaaatgagggtgctattgggtc

SEQ ID NO: 1040 - DNA, 994 bp, Setaria italica
gtcaaaatcaacagctaagccaagccagcgagcagcagcgtctgcagggaaggggaaggaggcggcagcacgcaactccgagccaaatccattgcgcttccgtgctcatggcccctcgctgagcgaagaggcggcgggattttgggggcgcgagggagtccgagagaggcgaggaggccccttgaccgcgagagctccctccatggcgaccggcaacctggcgagcgtggtggtggcggtggacggcagcgaggagagcatgaacgcgctgcggtgggcgctcgacaacctccgcctccgccccgacggtgagctcgtcgtgctccatgtccagccgccgcccaacatcgccgcggggctcaacccggcgcccatccccttcggcgggcccagcgggctggaggtgccggcgttcacgcaggccatcgaggcgcaccagcggcgtatcacgcaggcgatcctggagcacgccctcaagatttgctccgccaaaaatgtcgaggtcaagacggaggtgatcgtgggtgatcccaaggagaagatctgcgaggcgacggccaaccgcaatgccgatctgctagtcatggggtgccgtgccattgggccgcttcagaggatgttcttgggcagtgttagcaactactgcatcaatcatgtgggttgccctgttgttgtgatcaaggggacctaagctacccttgattaaaattctttggcgcacttcaattcaagtgtttcgaggctgctattgtgccatttgtaatcctgtacaatattgcacatttctcatttgaaggccagggatgagggttcctctgtggtctccgtgtttgtaaaggaaaatgtgtatttggttgtgtaatcctggaaataagcctgccatgtggcacatcacattgttctgtacattcttgtatgttggagacatacatggtgctgcctgaactttgaaacaaaattgccagaatccctagttcttgtctgttgtcttgcc

SEQ ID NO: 1041 - DNA, 920 bp, Setaria italica
caaagccaagccagcgagcagcagcgtctgcagggaaggggaaggaggcggcagcacgcaactccgagccaaatccattgcgcttccgtgctcatggcccctcgctgagcgaagaggcggcgggattttgggggcgcgagggagtccgagagaggcgaggaggccccttgaccgcgagagctccctccatggcgaccggcaacctggcgagcgtggtggtggcggtggacggcagcgaggagagcatgaacgcgctgcggtgggcgctcgacaacctccgcctccgccccgacggtgagctcgtcgtgctccatgtccagccgccgcccaacatcgccgcggggctcaacccggcgcccatccccttcggcgggcccagcgggctggaggtgccggcgttcacgcaggccatcgaggcgcaccagcggcgtatcacgcaggcgatcctggagcacgccctcaagatttgctccgccaaaaatgtcgaggtcaagacggaggtgatcgtgggtgatcccaaggagaagatctgcgaggcgacggccaaccgcaatgccgatctgctagtcatggggtgccgtgccattgggccgcttcagaggatgttcttgggcagtgttagcaactactgcatcaatcatgtgggttgccctgttgttgtgatcaaggggacctaagctacccttgattaaaattctttggcgcacttcaattcaagtgtttcgaggctgctattgtgccatttgtaatcctgtacaatattgcacatttctcatttgaaggccagggatgagggttcctctgtggtctccgtgtttgtaaaggaaaatgtgtatttggttgtgtaatcctggaaataagcctgccatgtggcacatcacattgttctgtacattcttgtatgttggagacatacatgg

SEQ ID NO: 1042 - DNA, 995 bp, Zea mays
gcatcagatacgttccctaaatgtaaaatagacactaggtttcaggctgcaggtgcagcacgcaacttgaccgatccatcgccgcatcgcggaccttgaccccgccctcactgagctaggagcagacgaggcttgagaacgagcgacggagacctagccgaagcaggagctccccatggcgaccggcaacctggcgagcgtggtggtggctgtggacggcagcgaggagagcatgaacgcgctgcagtgggcgctcgacaacctccgcctgcgccccgacggcgagctcgtcgtgctgcacgtccagccgctgcccaacatcgccgcgggactcaacccggcgcccatccccttcggcggccccagcgggttggaggtgccggcgttcacgcaggccatcgaggcgcaccagcggcgcataacgcaggcgatcctggagcacgccctgaagatttgttccgataagaatgtggaggtgaagacggaggtggtggtcggggaccccaaggataaaatctgcgagattgcggccaaccgtaaggccgatctgctcgtcatgggctgccgtgccattgggccgctcaagagggtgttcttgggcagtgtgagcaactactgtatcaaccatgtgggctgccctgttgttgtgatcaaggggacatgagattccatcagcccagcattctttggtgtacttccattcaaggtttttgaggcttctgctgtgacatgtgtaatcctgtacgatatattactgcacattactatgcttttgttggtgctgctgagggatgaaggttgctatgtggtccctttcgttataaaggaggaagctttgtcggtcgtgtaatcgtggtaataagttggtcctgtggcggattcttgtgtatattcttgtaatcgttcaaagacatggttctgtctgaagtcccaacagcgcaaaattaccagagtctcggtttgtttgtttgatgtcctctttcttttttttaacc

SEQ ID NO: 1043 - DNA, 1028 bp, Pennisetum glaucum
gcaagatcgatccaaatccgtcgacccggacaattatcttagccgggagttcagtcaaaatcaacagctaagccaagccaagccagcgagcagcagggtcttcaatcaccagggaaggaggcggcagcacgcaagatcgatccaaatccgtcgacccccgtgctagtccgtgctcgtgacccctcgcagagcgaagaggcggaggagattcgagcccgggagaagcgaggaggcccgcgagagagctccctccatggcgaccggcaacctggcgagcgtggtggtggcggtggacggcagcgaggagagcatgaacgcgctgcggtgggcgctcgacaacctccgcctccgacccgacggcgagctcgtcgtgctccacgtccagccgctgcccaacatcgccgccgggctcaacccggcgcccatccccttcggcgggccaagcgggctggaggtgccggcgttcacgcaggccatcgaggcgcaccagcggcggatcacgcaggtgatcctggagcacgctctcaagatttgctccgacaaaaatgtcgaggtcaagacggaggtgatcgtgggtgatcccaaggagaagatctgcgaggcgacggccaaccacaatgctgatctgctcgtcatgggctgccgtgccattgggccgcttcagaggatgttcttgggcagtgtgagcaactactgcatcaatcatgtgggttgccctgttgttgtgatcaaggggacttaagctacccttgatcgacattctttggtgcacttcaattcaagtgttctgatgctgctattgtgccatttatcctgtacaatatgacacatttcgcatttgaaggccatgcatcatattttatttgtcattctgctgctgaggtatgagggttgctctgtggcctccgcgtttgtaaagggaaatgtgtactggtttcgtaatcgtggaaataagtctgccttgtggcacattgttctgtacattcttgtatttgttggagctatggtgctgcctgaaacctgaacat

SEQ ID NO: 1044 - DNA, 776 bp, Cynodon dactylon
ggggatcgctgctcgtggctcgtgacccatcacaggagcgagggggcggcgagcgttcgagcacggtagctatccatggcgacggggaacctggcgagcgtcgtggtggcggtggacggcagcgaggagagcatgaacgcgctgcggtgggcgctcgacaacctccgcctccgccccgacggcgagctacttgtgctccacgtccagccgccgcccagcatcgccgccggcctcaacccggcacccatccccttcggcggccccagcgaggtggaggtgccggcgttcacgcaggccatcgaggcgcaccagcggcgcatcacgcaggcgatcctggatcacgcgcacaagatttgctctgagaagaatgaggaggtgaaaacggaggtggtcgtgggggaccccaaggagaagatctgcgaggtgaccgccaactgcaaggccgatcttcttgtcatgggttgccgtgcaatcgggccgctccagaggatgttcttgggaagtgtaagcaactactgcatcaaccatgtgggctgccctgttattgtaatcaagggtacttgagctgcccatgatcaacattctttggtgtacttcaattcaagttttttgtggttgcggtgccttctgtaatcctgtacattgcacattttgtgatcaaagcccataaattatgttctgttgctaagggggtgggatttgctatctggtctgcacattgtgaggaaaataagtgtgttggctgtggaattgtggaaataagtgtgccaattgcc

SEQ ID NO: 1045 - DNA, 942 bp, Panicum virgatum
gccaagccaagccagcgagcagcagggtctgcagggaaggggaaggaggcggcggcacgcaactttgaagccaaatccatcgagcgtcgtgccgtgcgcctgacctgacctctcgccgatccaaggggcggggggagtccgagctcgatctccatggcgaccggcaatctggggagcgtggtggtgtcggtggacggcagcgaggagagcatgaacgcgctgcggtgggcgctcgacaacctccgcctccgccccgacggcgagttcgccgtgctccacgtccagccgccgcccaacatcgccgccgggctcaacccggcgcccatccccttcggcggacccagcgggttggaggtgccggcgttcacgcaggccatcgaggcgcaccagcggcggatcacgcaggccatcctggagcacgccctcgagatttgctccgagaaaaatgtggaggtgaagacggaggtgatcgtgggtgatcccaaggagaagatatgcgaggtgacggccaaccgcaacgccgatctgctcgtcatggggtgccgagccattgggccgctcaagaggatgttcttggggagtgtgagcaactactgcatcaaccatgtgggttgccctgttgttgtgatcaaggggacttgaggccttgagctaccctcgatcaagtgttttgaggttgctattgtgtcatttgtaatcctgtacaatattggacattttgcatctgaagaccatgcatcacatttgtcagtctgctgccgagggaggagggttgctctgtgatctccgttgtaaaggaaaatgtgtcctggttctgtaatcgttgaaataagactgccctgtgggatattgttctgtatattcttgtatttgttggggatacacattgtgctgcctgaactctgaacatctcaaaattgccagaatcccggtttttgtggg

SEQ ID NO: 1046 - DNA, 1074 bp, Panicum virgatum
gagcttcctaccgaactgccaagtcgctccatgtgcctcgcgagatccacacgatgacactcgaccccgcttggatcgtcgcagaccaggcacagcgagttccgtcaaatccacagctaagccaagccagcgagcagcagggtctgcaaggaaggggaaggaggcggcggcacgcaactttgagccaaatccatcgctcctgacctgacctctcgccgatccaagaagcggggggagtccgagagaagcgagaaggcccgcgagcgagagctcgatctccatggcgaccggcaacctggccagcgtggtggtgtcggtggacggcagcgaggagagcatgaacgcgctgcggtgggcgctcgacaacctccgcctccgcccccgccccgacggcgagttcgtcgtgctccacgtccagccgccgcccaacatcgccgccgggctcaacccggcgcccatccccttcggtggacccagtgggttggaggtgccggcgttcacgcaggccatcgaggcgcaccaacggcggatcacacaggccatcctggagcacgccctcaagatttgctccgagaaacatgtggaggtgaagacggaggtgatcgtgggtgatcccaaggagaagatctgcgaggtgacggccaaccgcaatgccgatctgctcgtcatggggtgccgtgccattgggccgctcaagaggatgttcttgggcagtgtgagcaattactgcatcaaccatgtgggttgccctgttgttgtgatcaaggggacttgaggccttgagctaccctcgatcgacattctttggtgcatttcaattcaagtgttttctggttgctattgtgcccttttaatcctgtacagaccatgcatcatatttgtcagtttggtgctgagggatgagggttgctatgtggtctccgtttgtaaagaaaaatgtgttttgcttctgtaatcgtggaaataagcctgccatgtgacacattgttctgtatattcttgtatttgtcggggatatacattgtgctgcctgaactctgaacatctcaaaattgccagaatcccggtttttgt

SEQ ID NO: 1047 - DNA, 1029 bp, Secale cereale
cacacacggcaaaggcccggtggtgcccgcggggaagcagccgagccgaccgacgccccaaatggccgcgtccctccgctccccgccgcccgtgcccgccgccgccgccgccttccgccgctcccgcgccgccgtcgtcgtctgcgcctcctcctcttcctcctcgtcctcctcctcggccgtgtcgtccgctcccaaggcgcgcttcgtcgcccgccgctccgagtccacctccgtccagcagctcgcccgccccctcgcggagtacatgggcctgccggcgagccagtactcggtgctggacgcggagcgcatcgagcgcgtcgacgagtccaccttccgctgctacgtctaccgcttccgcttcttcgcgctcgaggtctgccccgtcctcctcgtccgcgtcgacgaggagcccaacggctgctgcatccgcctcctctcctgcaagctggaggggtcaccccttgtggaggcgcagaatgacaaattctcggcttccatggtaaatagggttttctgcagcagcagttcagaggattcgtcgcttcaacagcttacatcggatgctacaatcgaggttgcaattgacattccctttccatttcaagcactaccagttgaagccattgaatcaagtggcaggcaagtgcttgagcagttactccgagtcatgcttccacgatttctgaagcagcttgataaagactaccaggcttgggcctccggcgattcttcacggaaaccgcttggcactggggaaatatgaagctgaccataggcgtaatgatagcttttcttatttaatctagttgatgtgctcgtacatacatgatagtccgtccgtggaaaactctcgcgcttgtatattgtcatcccaccgtcatttggtcgattcgctcgcttctttcagctgattcgttcaactgattgtgggcttgtggccatcggccgcactttcagtgaacacaggaattgcattttgcctatgatcttcagtaaatgcaagagcaattgcatggagcaaaa

SEQ ID NO: 1048 - DNA, 883 bp, Pseudoroegneria spicata
tggtgcccgccgggaagcagccgaccgacgccccaatggcagcgtccctccggtccccaccgcccgtgcccgccaccgccttccgccgctcccgtgccgcagtcgtctgcgcctcctcttcctcctcgtcctcgtcctcggccgtgtcgtccgctcccaaggcgcgcttcgtcgcccgccgctccgagtccacctccgtccggcagctcgcccgccccctcgcggagtacatgggcctgccggcgagccagtactcggtgctggacgcggagcggatcgagcgcgtcgacgagtccaccttccgctgctacgtctaccgcttccgcttcttcgcgctcgaggtctgccccgtcctcctcgtccgcgtcgacgaggagcccaacggctgctgcatccgccttctctcctgcaagctggaggggtcaccccttgtggaggcgcagaatgacaaattctccgcttccatggtgaatagggttttctgcaacaacagttcagatgactcgacgcttcaacagcttacatcggatgctacaatcgaggttgcaattgacattccctttccgtttcaagcactaccagttgaagctattgaatcgagtggcaggcaagtgcttgagcagttactccgagtcatgcttccacgatttctgaagcagcttgataaagactaccaagcttgggcttcaggcgattcttcgaggaaaccacttggcactggcgaaatatgaagctggccggtatatccataggcgtaacgatagtttttcttgtttaatctagttgatgtgctcgcgcatgacccacttcctcatgatagtctgtccttggaaactctcgtggttgtatattgtcaatttgtcatcccacagtcatttgatca

SEQ ID NO: 1049 - DNA, 924 bp, Triticum aestivum
ccacgcgtccgcacggcaaaggcccggtggtgcgcgcccgcggggaagcagccgaccgacgcccacaatggcagcgtccctccgctccccgccgcccgtgcccgcagccgccgccttccgccgctgccgcgccgccgccgtcgtctgcgcctcctcctctccctcctcgtcctcgtcgtcggccgtgtcgtccgctcccaaggcgcgcttcgtcgcccgccgctccgagtccacctccgtccagcagctcgcccgccccctcgcggagtacatgggcctgccggcgagccagtactcggtgctggacgcggagcgcatcgagcgcgtcgacgagtccaccttccgctgctacgtctaccgcttccgcttcttcgcgctcgaggtctgccccgtcctcctcgtccgcgtcgacgaggagcccaacggctgctgcatccgcctcctctcatgcaagctggagggatcaccccttgtggaggcgcagaatgacaaattctcggcttccatggtgaatagggttttctgcaacagcagttcagagggttcgacgcttcaacaacttacatcggatgctacaatcgaggttgcaattgacattccctttccatttcaagcactaccagttgaagctattgaatcaagtggcaggcaagtgcttgagcagttactccgagtcatgcttccacgatttctgaagcagcttgataaagactaccaagcttgggcttccggcgattcttcaaggaaaccacttggcactggggaaatatgaagctgaccataggcataagatagcttttcttgtttaatctagttgatgtggtcgtacatgatccacttcctcatgatagtctgtccttggaaaactctcgtggttgtatattatgatcccaccgtcatatgatcgatccatttgcttctttc

SEQ ID NO: 1050 - DNA, 1149 bp, Triticum aestivum
agccgaccgacgcccacaatggcagcgtccctccgctccccgccgcccgtgcccgcagccgccgccttccgccgctgccgcgccgccgccgtcgtctgcgcctcctcctctccctcctcgtcctcgtcgtcggccgtgtcgtccgctcccaaggcgcgcttcgtcgcccgccgctccgagtccacctccgtccagcagctcgcccgccccctcgcggagtacatgggcctgccggcgagccagtactcggtgctggacgcggagcgcatcgagcgcgtcgacgagtccaccttccgctgctacgtctaccgcttccgcttcttcgcgctcgaggtctgccccgtcctcctcgtccgcgtcgacgaggagcccaacggctgctgcatccgcctcctctcatgcaagctggaggggtcaccccttgtggaggcgcagaatgacaaattctcggcttccatggtgaatagggttttctgcaacagcagttcagagggttcgacgcttcaacagcttacatcggatgctacaatcgaggttgcaattgacattccctttccatttcaagcactaccagttgaagctattgaatcaagtggcaggcaagtgcttgagcagttactccgagtcatgcttccacgatttctgaagcagcttgataaagactaccaagcttgggcctcgggcgattcttcacggaaaccgcttggcactggggaaatatgaagctgaccataggcgtaatgatagcttttcttgtttaatctagttgatgtggtcgtacatgatccacttcctcatgatagtctgtccttggaaaactctcgtggttgtatattgtcatcccactgtcatttgatcgatccactcgcttctttctgctggttcgttttaaactgcttgtactatgctggaacagatagatattttatctctccatcagttgatccaaaactgaaaagaaaaacggaaacgagagagagcaagtgagagatatatagagcaaaaacagtcaaactgtagaggtaaactactgcatccagtttacaaattacaagggcaatggtcagtgctaactaggtctacagtaattgcaaggccactgccaccagcagtgtaagtatagagcggtgtttgcaacgctgatattga

SEQ ID NO: 1051 - DNA, 973 bp, Avena sativa
ccaatggctgcgtccctccgctccccgccgcccgtggcttccccctttcgccgctcccgcgccgtcgtcgtctgcgcctcctcctcctcttcttcttcctcctcggccgtgtcgtcgtccgctcccaaggcgcgcttcgtcgcccgccgctccgagtccgcctccgtgcgccagctcgcccgtcccctagcggagtacatgggcctgccggcgagccagtactcggtgctggacgcggagcgcatcgagcgcgtcgacgagtccaccttccgctgctacgtctaccgcttccgcttcttcgcgctcgaggtctgccccgtcctcctcgtccgcgtcgacgaggagcccaacggatgctgcatccgcctcctatcctgcaagctggaggggtcgccccttgtggaggcgcagaatgacaaattctcagcttccatggtgaataaggttttctgcaacaacagttcagatggctcggcacttcaacaacttacgtcggatgctacaatcgaggttacaattgacataccatttccctttcaagcactaccggttgaagccattgaatcgagtggaaggcaagtgcttgagcagttactacgagccatgcttccacgatttctgaagcagcttgataaagactaccaggcttgggcttcgggcgattcttcaaggaagccacttggcactggtgaaatatgaagctgccgttatctccataggcatgatagcttttcttgtttaattaatagttcacgccgcttgatgggagtaactaccatgtccatacatcatccatttggtcatgaaagtttgtacatgtttaatcgtcacggacccatggttttatatattgcaatcctatggttatttggttgtaacatcagttagaagcatctacacattgagccatttataagtcacgaatgccttgttgtaacttgtaaaattatgagtacccaaccactcttttact

SEQ ID NO: 1052 - DNA, 1095 bp, Avena sativa
gtccaggagtccctgccgcggcggggacgcaaccggccgcctgcagccactcgcccagccccaacggacgacgcccaatggctgcgtccctccgctccccgccgcccgtggcttccccctttcgccgctcccgcgccgtcgtcgtctgcgcctcctcctcctcttcttcctcctcctcggccgtgtcgtcgtccgctcccaaggcgcgcttcgtcgcccgccgctccgagtccgcctccgtgcgccagctcgcccgtcccctagcggagtacatgggcctgccggcgagccagtactcggtgctggacgcggagcgcatcgagcgcgtcgacgagtccaccttccgctgctacgtctaccgcttccgcttcttcgcgctcgaggtctgccccgtcctcctcgtccgcgtcgacgaggagcccaacggatgctgcatccgcctcctatcctgcaagctggaggggtcgccccttgtggaggcgcagaatgacaaattctcagcttccatggtgaataaggttttctgcaacaacagttcagatggctcggcacttcaacaacttacgtcggatgctacaatcgaggttacaattgacataccatttccctttcaagcactaccggttgaagccattgaatcgagtggaaggcaagtgcttgagcagttactacgagccatgcttccacgatttctgaagcagcttgataaagactaccaggcttgggcttcgggcgattcttcaaggaagccacttggcactggtgaaatatgaagctgccgttatctccataggcatgatagcttttcttgtttaattaatagttcacgccgcttgatgggagtaactaccatgtccatacatcatccatttggtcatgaaagtttgtacatgtttaatcgtcacggacccatggttttatatattgcaatcctatggttatttggttgtaacatcagttagaagcatctacacattgagccatttataagtcacgaatgccttgttgtaacttgtaaaattatgagtacccaaccactcttttactgttttacacatgttgtccattaattgcaacaacaaaattcaaggattg

SEQ ID NO: 1053 - DNA, 1234 bp, Brachypodium distachyon
caataaagaaaaaagatccaactcaaaattcctctccccgcacgcccacacctctcgtgtccatctcccattctcctcccccttcctcggctcacttctcactcaagccgacggtccacgcggggacgcacgcacgcacgcaaccgccaccagccactcgcccggcaggctctgcaggcagccgccgcgccccgcgcccaatggctgcgtccctccgctccccgccgccggtcccagcctccgccttccgccgctcacggcccggggccgccgtcgtccgcgcctcctcttcttcctcctcctcgtcgtccacggccgtgtcgtctgctcccaaggcgcgcttcgtcgcccgccgctccgagtccacctccgtgcagcagctcgcccgccccctcgcggagtacatgggcctgccggcgagccagtactcggtgctggacgcggagcgcatcgagcgcgtcgacgactccaccttccgctgctacgtctaccgcttccgcttcttcgcgctcgaggtctgccccgtcctcctcgtccgcgtcgacgaggagcccaacggctgctgcatccgcctcctctcctgcaagcttgaggggtcaccccttgtggaggcgcagaatgacaaattctcagcttccatggcgaatagggttttctgcaataacagttcagatggctctcaacagcttacatcagatgccacaatcgaggttacaattgatataccctttccatttcgagcaataccagttgaagccattgaatcaagtggccggcaagtgctcgagcagctgctccgagtcatgcttccacgatttctgaagcagcttgataaagactaccaagcttgggcttcaggcgattcttcaaggaaaccacttggcaccggtgaaatatgaagctgtccataggcattataggttttcttgtttaatgtagttatcgtcgcttgatgagctagcagtcgtgctcacagatcatccaatcccccatgacagttcgttcttcttgaacttagttacggccttctgattttataccgcaatcctactgtcatgtgatccatgtgctctttttcttcttctggttttcgtctggagattcgttgcacttcttacatttagaagcatttgcagattgagcccttcgttgtagcttgcaagagaatgtcagccccttgccttcacatgtcctgtgattgataattgcaagtttaagctgattcaaggcttaa

SEQ ID NO: 1054 - DNA, 1574 bp, Oryza sativa
gaacccaaaattcctcccccacaccacgcctccacctccgcctcatttgctccagttcccggagggccgcaaccaccgctagccactcacccggcacggcatggctgcgtcgctccggtcgccgccccccttccccgccgcggcgttccgccgccgccgcgccgtcgtgcgcgcctcttcctcctcgtcgtcctcctcctcggccgtgtcgtccgcacccaaggcgcgcttcgtcgcccgccgctccgagtccaccttcgtccagcagctcgcccgcccgctcgcggagtacatgagcttgccggcgagtcagtactcggtgctcgacgcggagcgcatcgagcgcgtcgacgagtccaccttccgctgctacgtctaccgcttccgcttcttcgcgctcgaggtctgccccgtgctacttgttcgcgtcgacgaggagcccaacggctgctgtattagcctcctctcctgcaagctcgagggatcaccgcttgtggaggctcaaaatgacaagttttcagcttccatggtgaataaggtgttctgcaacagtagtatgagtgattcaacatctcaacagcttacatcggatactacaatcgaggttacaattgatataccatttccatttcgagcattacctgttgaagccattgaatcaagtggcaagcaagttcttgagcaactactccgagtcatgcttccacgatttttgaagcagcttgttaaagactaccaagcatgggcttcgggtgattcttcaaggaaaccacttggcactggtgaaatatgaagcttcgcagtgtctccattaggcattatagtcttttcttgttgcattagttattgcttgatggggtatagaaaagctgtttatacgtcgttttgctcacaaaatccatttgcttctttgtggtctttgcctgaagatgttctgtagtgtgtatggatttgtgccatgcgaccagtcacatacatttgtaggttgttcattcacaatgtgttgttgtaagattaacaatatccgaccaaaaactcttctgcctccatacacattacaaattatggtcctgtgatataaggattgtctatgcaaggaaggggtcggatatggttttctgatattgagagcaatatgtgcggacaacgaaggtgactactgaccagatcggatggccaaggggaattttggctatcatgttcatttaacagttcttaactatcttttccagcctgggcgacggttgatgtttttgtagcttgtgttatccataaatcatgaacatacatagtctgtctaatgtggaaagggatggtttagcaatcagatgtaaaaagtaataatacagagcttcatcatgcttaattatctgactctgttggatcgaagctagatgctcttcaatgatctgctttcaagaatcaagatatgcctgatgatcagatgacgcaatgctatgaagcgttttgtgctacattttaattacctacctgtgtaaagataagttatatttgctcaaactaacacagagctagaatctgtgtttagttcacgtcaaaattggaagttcgat

SEQ ID NO: 1055 - DNA, 1128 bp, Oryza sativa
tcgaacccaaaattcctcccccacaccacgcctccacctccgcctcatttgctccagttcccggagggccgcaaccaccgctagccactcacccggcacggcatggctgcgtcgctccggtcgccgccccccttccccgccgcggcgttccgccgccgccgcgccgtcgtgcgcgcctcttcctcctcgtcgtcctcctcctcggccgtgtcgtccgcacccaaggcgcgcttcgtcgcccgccgctccgagtccaccttcgtccagcagctcgcccgcccgctcgcggagtacatgagcttgccggcgagtcagtactcggtgctcgacgcggagcgcatcgagcgcgtcgacgagtccaccttccgctgctacgtctaccgcttccgcttcttcgcgctcgaggtctgccccgtgctacttgttcgcgtcgacgaggagcccaacggctgctgtattagcctcctctcctgcaagctcgagggatcaccgcttgtggaggctcaaaatgacaagttttcagcttccatggtgaataaggtgttctgcaacagtagtatgagtgattcaacatctcaacagcttacatcggatactacaatcgaggttacaattgatataccatttccatttcgagcattacctgttgaagccattgaatcaagtggcaagcaagttcttgagcaactactccgagtcatgcttccacgatttttgaagcagcttgttaaagactaccaagcatgggcttcgggtgattcttcaaggaaaccacttggcactggtgaaatatgaagcttcgcagtgtctccattaggcattatagtcttttcttgttgcattagttattgcttgatggggtatagaaaagctgtttatacgtcgttttgctcacaaaatccatttgcttctttgtggtctttgcctgaagatgttctgtagtgtgtatggatttgtgccatgcgaccagtcacatacatttgtaggttgttcattcacaatgtgttgttgtaagattaacaatatccgaccaaaaactcttctgcctccatacacattacaaattatggtcctgtgatataaggattgtctatgcaaggaaggggtcggatatggttttctgatatt

SEQ ID NO: 1056 - DNA, 1490 bp, Sorghum bicolor
ccatcttatccgtcgtccaggggggtggggggaatcacgagcccgaccgagaaattcccctccatttctcctggtcctggctcagcccagttccctccctcctcgatcgtctcctcccgtggccgtgggggacgcagtcgcacgcaacagcccgcagccactcaccgcggccgcgcacggcacagttacgcacgcaggcgcccaatggctgcgtcactccgctcgccgcctccgctcgccgccgccttccgccgctcccgcgtcgtcgtccgcgcctcctcctcctcctcctcttcgtcatcatccgccgtctcgtcgtcatcgtccgcccccaaggcgcggtttgttgcccgccgctccgagtccgtccccgtccagcagctggcccgcccgctcgcggagtacatgagcttgccggccagccagtactcggtgctggacgccgagcgcatcgagcgcgtcgacgactccaccttccggtgctatgtgtaccgcttccgcttcttcgcgcttgaggtctgccccgtcctcctcgtccgcgtcgatgaggaacccgacggctgttgcattcgcctcctctcctgcaagctggaggggtcaccgctcgtggaggcccaaaatgataaattctcagcttccatggcgaatagggttttctgcagcagcaggtcgcaagattcgaccattcaacagcttacatcagatactacaatagaggttgcaatcgatataccttttccatttcgagcaataccagttgaagccattgaatcaagtggcaggcaagtgcttgaacagttactcagagtcatgcttccaagatttctaaagcagcttgttaaagactaccaagcttgggcttctggtgatgcttcgaggaaaccacttggcactggggaaatctgaagctgcccagtggctccactagcactaggcatgataggttattcgttgaattcagttatcacctccttgtttgtatagcaatcctgcccaaacgttatccacttcactcatgacagttctttaacttgttgaaattagccattgccacttgtttttttggttccagttattcagcagccttggtctgaagatggctgatcgagcactcacactggaaattacagtatctgatctggcatttgtgcccgcgtttgtactcacactgaagattacagtatctgaagatttgcgtatactccaactccatatgtgaagtgatatgttttgtaaggaaactagttactgtaaccacgcaaggagggaagtataaactgaaacgtttcataaacagtgttacccctgtgatggttatggtactttgatctggggcgcggtgttgcctccgtcagcatttgccgtcgaataaacgctgtctcgtaaaacgacactaatactcctgtgtaggctgtacatttcatttatggatcatgttgcatttgatgatcaaatgatgggcgcaaggaatataatgggagagatggacc

SEQ ID NO: 1057 - DNA, 1560 bp, Sorghum bicolor
aacatgacgcctcgccacatccgctccctccatccatcttatccgtcgtccaggggggtggggggaatcacgagcccgaccgagaaattcccctccatttctcctggtcctggctcagcccagttccctccctcctcgatcgtctcctcccgtggccgtgggggacgcagtcgcacgcaacagcccgcagccactcaccgcggccgcgcacggcacagttacgcacgcaggcgcccaatggctgcgtcactccgctcgccgcctccgctcgccgccgccttccgccgctcccgcgtcgtcgtccgcgcctcctcctcctcctcctcttcgtcatcatccgccgtctcgtcgtcatcgtccgcccccaaggcgcggtttgttgcccgccgctccgagtccgtccccgtccagcagctggcccgcccgctcgcggagtacatgagcttgccggccagccagtactcggtgctggacgccgagcgcatcgagcgcgtcgacgactccaccttccggtgctatgtgtaccgcttccgcttcttcgcgcttgaggtctgccccgtcctcctcgtccgcgtcgatgaggaacccgacggctgttgcattcgcctcctctcctgcaagctggaggggtcaccgctcgtggaggcccaaaatgataaattctcagcttccatggcgaatagggttttctgcagcagcaggtcgcaagattcgaccattcaacagcttacatcagatactacaatagaggttgcaatcgatataccttttccatttcgagcaataccagttgaagccattgaatcaagtggcaggcaagtgcttgaacagttactcagagtcatgcttccaagatttctaaagcagcttgttaaagactaccaagcttgggcttctggtgatgcttcgaggaaaccacttggcactggggaaatctgaagctgcccagtggctccactagcactaggcatgataggttattcgttgaattcagttatcacctccttgtttgtatagcaatcctgcccaaacgttatccacttcactcatgacagttctttaacttgttgaaattagccattgccacttgtttttttggttccagttattcagcagccttggtctgaagatggctgatcgagcactcacactggaaattacagtatctgatctggcatttgtgcccgcgtttgtactcacactgaagattacagtatctgaagatttgcgtatactccaactccatatgtgaagtgatatgttttgtaaggaaactagttactgtaaccacgcaaggagggaagtataaactgaaacgtttcataaacagtgttacccctgtgatggttatggtactttgatctggggcgcggtgttgcctccgtcagcatttgccgtcgaataaacgctgtctcgtaaaacgacactaatactcctgtgtaggctgtacatttcatttatggatcatgttgcatttgatgatcaaatgatgggcgcaaggaatataatgggagagatggaccagtttattttctgagctttaagaacgcaagtcgcatg

SEQ ID NO: 1058 - DNA, 1063 bp, Setaria italica
gcacggtcccccgggggaagcaaccgcccgcagccactcaccggcgaccgacgccggccacgcacgcgacacagtcacacagcgcgcgcccaaatggctgcgtccctccgctcgccgcccccggtccccgccgcgttccgccgctcccgcgccgtcgtccgcgcctcctcgcagtcgtcgtcgtcgtcgtcatccgccgtctcctcctcttcgtccgcccccaaggcgcggttcgtcgcccgccgctcagagtccgtctccgtccagcagctagcccgccccctcgcggagtacatgagcttgccggcgagccagtactcggtgctggacgcggagcgcatcgagcgcgtcgacgactctaccttccgatgctacgtataccgcttccgcttcttcgcgcttgaggtctgccccgtcctgctcgtccgcgtcgacgaggagcccaacggctgctgtattcgcctcctctcctgtaagctggagggatcgccacttgtggaggcgcagaatgataagttctcagcttctatggtgaatagggttttctgcagtagcactttgcaaggttcgacccttcaacagcttacatcagatactacaatagaggtcacaatcgatataccttttccatttcgagcaataccagttacagccattgagtcaagcggcagacaagtgcttgagcagttgctcggagtcatgcttccaaggtttctgaatcagcttgttaaagactaccaagcttgggcttctggtgattcttcaaggaaaccacttggcactggcgaaatatgaagctgcacagtgcctccagtaggcatgatagtttgttcgttgaactcactatgttgtatagcaatcctgcctgaatgtcactcacgacaatttctgtatgttgaatctgttgaaattaggtattgccgttttctattgctgttcttcagctgtacgagttctgaagattgtaaatcgagcattcacagtcacaatgaagatgatagcatctgaactgtcatttgtgcccacgtactcgttttttctctttctttcgcgagaaaactag

SEQ ID NO: 1059 - DNA, 1093 bp, Setaria italica
agaagatcgagacctccatttcctagctcagcacggtcccccgggggaagcaaccgcccgcagccactcaccggcgaccgacgccggccacgcacgcgacacagtcacacagcgcgcgcccaaatggctgcgtccctccgctcgccgcccccggtccccgccgcgttccgccgctcccgcgccgtcgtccgcgcctcctcgcagtcgtcgtcgtcgtcgtcatccgccgtctcctcctcttcgtccgcccccaaggcgcggttcgtcgcccgccgctcagagtccgtctccgtccagcagctagcccgccccctcgcggagtacatgagcttgccggcgagccagtactcggtgctggacgcggagcgcatcgagcgcgtcgacgactctaccttccgatgctacgtataccgcttccgcttcttcgcgcttgaggtctgccccgtcctgctcgtccgcgtcgacgaggagcccaacggctgctgtattcgcctcctctcctgtaagctggagggatcgccacttgtggaggcgcagaatgataagttctcagcttctatggtgaatagggttttctgcagtagcactttgcaaggttcgacccttcaacagcttacatcagatactacaatagaggtcacaatcgatataccttttccatttcgagcaataccagttacagccattgagtcaagcggcagacaagtgcttgagcagttgctcggagtcatgcttccaaggtttctgaatcagcttgttaaagactaccaagcttgggcttctggtgattcttcaaggaaaccacttggcactggcgaaatatgaagctgcacagtgcctccagtaggcatgatagtttgttcgttgaactcactatgttgtatagcaatcctgcctgaatgtcactcacgacaatttctgtatgttgaatctgttgaaattaggtattgccgttttctattgctgttcttcagctgtacgagttctgaagattgtaaatcgagcattcacagtcacaatgaagatgatagcatctgaactgtcatttgtgcccacgtactcgttttttctctttctttcgcgagaaaactag

SEQ ID NO: 1060 - DNA, 1201 bp, Zea mays
tccattccctccctcgtggcctcgtctcctcccgtggcccgtgggggacggcacgcaaccacacgcagccactcaccggtgagcggcgaggcgactggcgcggccgcgcaccgcagtcacgcacgcaggcgctcaatggctgcgtcactctgctccccgcctccgctcccttccgccttccgccgatcccgcgccgtcgtccgcgcctcctcctcctcctcgtcgtcatccgccgtctcgtcgtcgtcgtccgcccccaaagcgcggttcgtcgcccgccgctccgagtccgtccccgtccagcagctggtccgcccgctcgcggagtacatgagcttgccagccagccagtactcggtgctggacgccgagcgcatcgaacgcgtcgacgactccaccttccggtgctacgtgtaccgcttccgtttcttcgcgcttgaggtctgccccgtcctcctggtccgcgtcgatgaggaacccaacggctgttgtattcacctcctctcctgcaaactggagggatcaccgctcgtggaggcgcagaatgataaattctcagcttccatggcgaatagggttttctgcagcagcaagtcgcaagattcgacccttcaacaacttacatcagatactacaatagaggttgcaattgatataccttttccatttcgagcaataccggttgaagccattgaatcaagtggcaggcaagtgcttgaacagttactcagagtcatgcttccaagatttctgaagcagcttgttaaagactaccaagcttgggcttctggcgatgcttctaggaaaccacttggcactggtgaaatctgaagctgcccagtgtctccattacgcatgatagtttgatcgtagaattcagttattgccccgttgtgttgtatagcaatcctgccaaaacaatgggcatgcttgtttcagtttttttttgctgattttggctgccaaaagctgttgtatgctaaacgctcagtttttgattccacttttatgagaatcattttgatgaaaaaatgtccaaaattaacttaaacacaatcgatcgacaggaggaatctgtcacttcctgcattctaaaccctatggatccttttatctttcttcgtatataatttttataattttgtattctctctacagctagattctctcaaaaaagctcgtcagaaaaaacaaacaaaca

SEQ ID NO: 1061 - DNA, 2132 bp, Secale cereale
gactcgcctccctgtcctgtcctcccgtcgcgacaaccgtctgactaagcagcgcccatggcgccggcggtgggggatcaagcgggcccccgcggcgcaggccgtcacggtgcagccgccgcccgacgcgcggctggtgcgcgaggccgtgcggacctccaccatcgccgaggccgtcgcccccgccgccctggaggcgcccgcgcccgcgctcgagggcttcctctgcctcgaggaggtggaggggcggcggtggaagtacgtggtggatgcagcccccgggaagggcaaggccaggggccggggcaggggcgggtccgccgtcccccttggggcctccgtccgggccgtgccgctccagtcgccgctcccgcccgccgaggaaataatggcgttcgtaagatcgtatgttgtgcctgaagggtttccagacagtgttactccttcatacgtcccatacatgacctggagagctctcaagcatttctttggtggagcaatgggtgtgttcacaacaagaaccttgctgagctccgtcggagtctctcaaagcaaggttaccccgggtgccattgctatcaattggatcctcaaggacggtgctggacgtgttggaaaaatgctttttgcgcgacaaggaaagaagtttgacaatgacctaaagcagctccgcttttctagtgatctcttgctggagataggtgctgggatagagttagctactgcagccttccctcagtttttcttgcctatggcttgcgttgcaaatgttgtaaagaatgttgctgctgttacatcgacctcaactcgcactccaatctacaaggcatatgcaagaggagaaaatattggagatgtgactgctaaaggcgaatccgtcgggaacattgcagatctgctgggcactggtttgagcatctttatcacaaagcggaacccatcattggtgacttcatttgccctcctgtcatgtggatatctcttgagttcatatcatgaggtgaggtctgttgtgctgaataccctaaacagggcaaggtttaccgttgcagtggattcctttattaagacagggtatgttccctcgttgaaggaaggaaactcgcaggagacaatatttattcatccttggcggcatgagccagtttcaataggatcacgatttggagaagcatttcaagaacctgtttcatttgttgccacaaggcctttgtttgaggatgagcgatacatggtaacatataacccaacgaaggataaagtatatgcgttactcaaggaccaagcaaagccagatgacattctcaaagctgctttccatgcccatgtgttgctgcatttcatcaacgtatcacatgaacggaagaggatgagctccaatcgatcggattactatgggaacccgcacccgcggaacatggatttcctggcacacatcgcagagtcttgcaaaattgtgtcgtcatcttacggaacattcaggaagaaagcaaaagaacagggttggataatgtcggaatcacttcttaaccctgggaaggctcgattatgcgtcacgagaccgcagtgacttcactatttccatctaccatcgacgggatgataccatctctagctgttactctagctttttcggtgaagacaggacatggtgctgattgagttgttggtagctgaactaacatgtgttggagcccggcctaggtgtgaaccacaagcgagcctatcatctcgtgcaacccctaaccgctgtctcaactacagctgccgagatccggggacaccaagaagctgttgtaactcgtcgtcaaaacaataacgcgggaggagatatgctcgcaccgagccaggggaagaccgagggcgacctccaactgctaactgcataggagtaggttccgtagagggacgtatatttaagcttgctggtagtggcgtcgctgtgatggaggacttgctaactgtatgtagcctgcctgttcgtgtgtggtgttcgtcggctgcagagtcgttttcgggttcgggatctaggaagagctgtttcctttctttgctgacctgccgtgctttgagatgtggtgttcgtcatgcgcctttgtagggctagggccgcttgttgtaagttgcagttt

SEQ ID NO: 1062 - DNA, 2067 bp, Avena sativa
cttggcatttccgcggctccgccaatataactccactttttttttcctctctctctccatccaacccactccgcctcgtcctgcgcccgtcgcgacagctcgcgcccgcacgcacgcccgcctgactaagcagcccccgccatggcgccggcggtggggatcaagcggtcccccgccgcgacgcagaccgtcacggcgcccccgccctcgccccccgacgcgcgcttcgcgctgggggcggccgtcaagtccaccatcgtcgaccccacgccgggcgacaggctggacgcgccggcgcccgcggtcgaggggttcctctgcctagaggagattgaagggaggaggtggaagtacgtggtggacggacacgcggggaacaagaggaagggcaggcgcggaggctctgccgtgccccccggggcatccgtcagggccgtgccgctccagtcgccgctgccgccagccgaggaaataatggcgttcgtaagatcatatgttgtgcctgaagggtttccagacagtgttactccttcctacgtcccatacatgacctggagagctctcaagcatttctttggtggagcgatgggggtgttcacaacaagaaccttgctgagctctgttggagtctctcaaagcaaggtaactccgggtgccattgccatcaactggatcctcaaggacggtgctggacgtgttggaaaaatgctttttgcacgacaaggaaagaagtttgacaatgacctaaagcagctccgcttttctagtgatctcttgctggagataggcgccgggatagagctagctactgcggccttccctcagtttttcttgcctatggcttgcgttgcaaatgtcgtaaagaatgttgctgctgttacgtcaacctcgacacgcactccaatctacaaggcctattcaagaggagaaaatattggagatgtgactgctaaaggagagtccgtggggaacatagcagatctgctgggcactggtttgagcatcttcatcacaaaacggaacccatcgttggtgacttcatttgccctcctgtcatgtggatatctcctgagttcatatcatgaggtgaggtctgttgtgctgaataccctaaacagggcaaggtttactgttgcagtggattccttcattaagacagggtatgttcccaccttgaaagaaggaaactcacaggagacaatatttattcatccttggcggcatgagccggtcgaaataggatcacggtttggagaagcattccaagaaccagtttcatttgttgccacaaggcctttgtttgaggatgagagatacatggtaacatataacccaacgaaggataaagtatatgctttgctcaaggaccaagcaaagccagatgacattctcaaagctgctttccatgctcatgtattgctgcacttcatcaataagacacatgagcggaagaggatgagctccaatcgatcagatcattatggaaacctgcaccaacggaacgtggatttcctgccacacattgcagaatctagcaaaatcgtgtcatcctcttatggaacattcaggaagaaagcaaaagaacagggttggataatgtcagaatcgcttcttaaccctgggaaggctcgattatccgtcacgagaccgcaatgattctacagtttccatttaccatcgacgggatgatgccgtctctatctgtcaggctaactttttgacaagactgacaggatgctgatgagttgttagtagctgaactagcacaagttgtttgcctaggtgccaaaatagcgcgggatatgcttatggtgagccatgagaagacgagggcgacttccaactgttaactgcatatgagtaggtagtggagggacttatatctatatttgctgctctctgacggaggacttctaactgtaactagtcatgtatggtgtttcgtcggctgccgagtcattttcagaatcatggaagagctgtttctttttctgctgaccttatgtacctttctgagtctttaagaactgttcctcattcacctcctagggccgtttgtaagttctc

SEQ ID NO: 1063 - DNA, 2160 bp, Avena sativa
cttggcatttccgcggctccgccaatataactccactttttttttcctctctctctccatccaacccactccgcctcgtcctgcgcccgtcgcgacagctcgcgcccgcacgcacgcccgcctgactaagcagcccccgccatggcgccggcggtggggatcaagcggtcccccgccgcgacgcagaccgtcacggcgcccccgccctcgccccccgacgcgcgcttcgcgctgggggcggccgtcaagtccaccatcgtcgaccccacgccgggcgacaggctggacgcgccggcgcccgcggtcgaggggttcctctgcctagaggagattgaagggaggaggtggaagtacgtggtggacggacacgcggggaacaagaggaagggcaggcgcggaggctctgccgtgccccccggggcatccgtcagggccgtgccgctccagtcgccgctgccgccagccgaggaaataatggcgttcgtaagatcatatgttgtgcctgaagggtttccagacagtgttactccttcctacgtcccatacatgacctggagagctctcaagcatttctttggtggagcgatgggggtgttcacaacaagaaccttgctgagctctgttggagtctctcaaagcaaggtaactccgggtgccattgccatcaactggatcctcaaggacggtgctggacgtgttggaaaaatgctttttgcacgacaaggaaagaagtttgacaatgacctaaagcagctccgcttttctagtgatctcttgctggagataggcgccgggatagagctagctactgcggccttccctcagtttttcttgcctatggcttgcgttgcaaatgtcgtaaagaatgttgctgctgttacgtcaacctcgacacgcactccaatctacaaggcctattcaagaggagaaaatattggagatgtgactgctaaaggagagtccgtggggaacatagcagatctgctgggcactggtttgagcatcttcatcacaaaacggaacccatcgttggtgacttcatttgccctcctgtcatgtggatatctcctgagttcatatcatgaggtgaggtctgttgtgctgaataccctaaacagggcaaggtttactgttgcagtggattccttcattaagacagggtatgttcccaccttgaaagaaggaaactcacaggagacaatatttattcatccttggcggcatgagccggtcgaaataggatcacggtttggagaagcattccaagaaccagtttcatttgttgccacaaggcctttgtttgaggatgagagatacatggtaacatataacccaacgaaggataaagtatatgctttgctcaaggaccaagcaaagccagatgacattctcaaagctgctttccatgctcatgtattgctgcacttcatcaataagacacatgagcggaagaggatgagctccaatcgatcagatcattatggaaacctgcaccaacggaacgtggatttcctgccacacattgcagaatctagcaaaatcgtgtcatcctcttatggaacattcaggaagaaagcaaaagaacagggttggataatgtcagaatcgcttcttaaccctgggaaggctcgattatccgtcacgagaccgcaatgattctacagtttccatttaccatcgacgggatgatgccgtctctatctgtcaggctaactttttgacaagactgacaggatgctgatgagttgttagtagctgaactagcacaagttgtttgcctaggtgccaaaatagcgcgggatatgcttatggtgagccatgagaagacgagggcgacttccaactgttaactgcatatgagtaggtagtggagggacttatatctatatttgctgctctctgacggaggacttctaactgtaactagtcatgtatggtgtttcgtcggctgccgagtcattttcagaatcatggaagagctgtttctttttctgctgaccttatgtacctttctgagtctttaagaactgttcctcattcacctcctagggccgtttgtaagttctcagttttcccagatggtgagtttatgtcgatgcaaagtgcagtggatatcatgtacatagatgtttgttgtaataatcggaagcgtttgctgct

SEQ ID NO: 1064 - DNA, 1955 bp, Triticum aestivum
cctatccccctcgtgttaggccttggacagtctccagaccgagacgggcccagccaatgggtatctaaacgctagaggttaacgtcgacggactctgcctgccttcgcctgcccagcctcctgtcctgtcctgtcctgtgtgcccgtacgccgctcccgcccgccgaggaataatggcgttcgtaagatcttatgttgtagcctgaagggtttccagacagtgttactccttcatacgtcccatacatgacctggagagctctcaagcattttttggtggagcaatgggtgtgttcacaacaagaaccttgctgagctccgttggagtctctcaaagcaaggttaccccgggtgctattgctatcaactggatcctcaaggacggtgctggacgtgttggaaaaatgctttttgcgcgacaaggaaagaagtttgacaatgacctaaagcagctccgcttttctagtgatctcttgctggagataggcgctgggatagagttagctactgcagccttccctcagtttttcttgcctatggcttgcgttgcaaatgttgtaaagaatgtcgctgctgttacatcgacctcaactcgcaccccaatctacaaggcatatgcaagaggagaaaatattggagatgtgaacgctaaaggcgaatctgtcgggaacattgcagatctgctgggcactggtttgagcatctttatcacaaagcggaacccatcgttggtgacttcatttgccctgctatcatgtggatatctcctgagttcatatcatgaggtgaggtctgttgtgctgaataccctaaacagagcaaggtttactgttgcagtggattcctttattaagacagggtatgtcccctcgttgaaggaaggaaactcgcaggagacaatatttattcatccttggcggcatgagccagtttcaataggatcacgatttggagaagcatttcaagaacccgtttcatttgttgctacaaggcctttgtttgaggatgagcgatacatggtaacatataacccaacaaaggataaagtatatgcattgctcaaggaccaagcaaagccagatgacattctcaaagctgctttccatgcccatgtgttgctgcatttcatcaatgtatcacatgaacggaagaggatgagctccaatcgatcagatcactacggaaacccgcacccacggaacatggatttcctggcacacatcgcagaatcctgcaaaattgtgtcatcctcttatggaacattcaggaagaaagcaaaagaacagggctggataatgtcagagtcacttcttaaccctgggaaggctcgattatgcgtcacgagaccgcagtgacttcactatttccgtttaccatcgacgggatgataccatctctagctgttactctagctttttcgacgaagacgggacatgatgctgatgagttgttggtagctgaactaacatgtgttggagcccggcctaggtgtgaaccagcgagcctatcatctcgtgcaacccctaaccgctgtatcaactacagctgccgaaatccggggacaccaagaagctgtaactcgtcgtcgaaacaataacgcgggaggagatatgctcgcgccgagccatgagaagaccgagggcgacctccaactgctaactgcataggagtaggttccctagagggacgtatatttaagcttgctggtagtagcgtcgctgtgatggagaggacttgctaactgtatgtagcctgttcgtgagtggtgttcgtcggaatgtaggaagagctgtttccttttttgctgtgctttgagatgtggtgttcgtcatgcgcctttgtagggccgcttgttgtaagttgcagtttttcggatggagtgtgttttcatgtcgatgcttgtacatactagtacctgcttgttgttgtaataatcggaagcgttttgctgctga

SEQ ID NO: 1065 - DNA, 1408 bp, Pseudoroegneria spicata
  misc_feature (5)..(5): n is a, c, g, or t
  misc_feature (57)..(57): n is a, c, g, or t
  misc_feature (63)..(63): n is a, c, g, or t
  misc_feature (66)..(66): n is a, c, g, or t
  misc_feature (81)..(81): n is a, c, g, or t
  misc_feature (97)..(97): n is a, c, g, or t
  misc_feature (99)..(99): n is a, c, g, or t
  misc_feature (102)..(102): n is a, c, g, or t
  misc_feature (122)..(122): n is a, c, g, or t
  misc_feature (161)..(161): n is a, c, g, or t
  misc_feature (194)..(194): n is a, c, g, or t
  misc_feature (197)..(197): n is a, c, g, or t
  misc_feature (200)..(200): n is a, c, g, or t
  misc_feature (210)..(210): n is a, c, g, or t
  misc_feature (311)..(311): n is a, c, g, or t
  misc_feature (338)..(338): n is a, c, g, or t
  misc_feature (446)..(446): n is a, c, g, or t
  misc_feature (485)..(485): n is a, c, g, or t
  misc_feature (599)..(599): n is a, c, g, or t
ctctncctcgatccttccgccgaagggttccattccccgtcgccactttcgatttcngttggnganttgggggagatcgantcctcgcctgggcggntntgncgttcgagttcatggccacntcgggcgatcagtcgggcggctgcgggtctgcggcggcnaaggggtccaagctgcggtacccgctgcggtcngcnggncgggggaagntggagccggcggcggcggatgctcctcctagcggccctgcttcgcgaagggccaaaccatcttcagatgtcaccaagagctgtgctctcgatctttctgcngtgaaggataaatcagctaaacctccncggaggcactcaataccaacaaagccaggtgttagtccaaggcctactcctactggaactattactccagtgtcaggggttcgctcgaggaggtcagacagccttggnaggttggataccccgacatctgaagcatccatgtctacngcaaggcgcaagttcagtacactctcctcggtctcatattggatgacacagattaggcttgcagaggctgcttccaagcactctatctctctgggcttcttcaagctcgccctngagtcagaatgcgagcctctggataggatgagagaagaactcaaggcttatgtggcccggcatggccttgcaacagaattggaggagcccgtgaaggagattcttcaggtttatgatatcgtggaagattttgagaagctaaagatctctctggactcctcactggagccaaaaaagtctgacaaggctgctcttagtgctaccaatgtgactccaaagggtaatctgaaacccaggtctctgaactctgttgccactcagagtaaagatggcaagaaagagaacattcagaaggagaagcctgatgccaagatcagaggttcctataaccagaatccagccaagaatgctcctgcaaaaggtgccaaaaataccagcaagaaaaccaagaagcaggctaaggagcagcaagaagattgcaatggaggtagtgaggtttcaccagttgacgcagaccaagaatctgttgatgtggtgaaggagatcacatacgaagataaggagaacatgggggatgctgagatggcaatagatgctggcaactccgtagcccaagaagtctagaacagatggaccgacttcagattcaaaccttttgtttgctgaatatgaagtattgagtggtgcttgttttctttcgccgttgttgatatgtcactagcacttgtctttccggttgtcagaccgtaacatgtctttaagagtgtgtattatggtttgctgcgtgagactgctcgcttgtattccctttgttaagtcagtttgcttgtccgtgtccagcttctgaatatagctgaattctttattta

SEQ ID NO: 1066 - DNA, 1421 bp, Triticum aestivum
agggttccgttccccatcgccggttccaatttccgttgggggagatccgatcgattcctcgcctgggccggtccgtcgttcgagtccatggccacctcgggcgatcagtcgggcggctgcgggtctgcggccgcgaaggggtccaaactgcggtacccgctgcggtcggcgggccgggggaagctcgagccgccggcggcggcagatgctgctcctagcggccctgcttcgcgaagggccaaaccatcttcagatgtcaccaagagctgtgctctcgatctttccgccgtgaaggataaatcagctaaacctccgcggaggcactcaataccaacaaagccaggtgttagtccaaggcctactcctactggaactattactccagtgtcaggggttcgctccaggaggtcagacagccttgggaggttggataccccgacatctgaagcatccatgtctacagcaaggcgcaagttcagtacactctcctcggtctcatattggatgacacagattaggcttgcagaggctgcttcgaagcactctatctctctgggcttcttcaagcttgcccttgagtcagaatgcgagcctctggataggatgagagaagaactcaagacttatgtggcccggcatggccttgcaacagaattggaggagccggtgaaggaggttcttcaggtttatgatatcgtggaagattttgagaagctaaagatctctctggactcctcgcaggagccaaaaaagtctgacaaggttgctcttagtgctgccaatgtgactccaaagggtaatctgaaacccaggtctctgaactctgttgcaactcagagtaaagatggcaaaaaagagaacagtcagaaggagaagcctgatgccaagatcagaggttcctataaccggaatccagccaaaaatgctcctgcaaaagaagctgccaaaaataccataaagaaaaccaagaagcaggctaaggagcagcaagaggattgcaatggaggtagtgatgtttcgccggttgatgcagatcaagaatctgttgatgcggtgaaggagatcacatatgaagataaggagaacatgggggatgctgagatggcaatagatgctggcaacaccatagcccaagaagtctagaaccgacggaccgacttcagattcaaaccttttgtttgctgaatatgaagtattgagtgtgtggtgcttgttttctttcgccgttgttgatatatcattagcacttgtctttccggttgtcaagccgcaacatgtctttaagagtgtggtattatggtttgctgggtgagactgctcgcttgtattccctttgtcaagtcagtttgcttgtccgtgtccagcttctgaatatagctgaattctttatttgtgtgaaaaacctcggccgcgaccacgct

SEQ ID NO: 1067 - DNA, 1450 bp, Secale cereale
actttcggtttccgttggaggactgggttggggatttgggggagatcgaatcctcgcctggggcggatctgccgttcgagttcatggccacctcgggcgatcagtcggccggctgtgtgtctgcggggacgaaggggtccaagctgcggtacccgctgcggtcggcgggccggggcaagctggagccggcggcggcgggggaggctcctcctagcggccctgcttcgcggagggccaagccatcttcagatgtcaccaagagctgtgttctcgatctttctgccgtgaaggataaatcagctaaacctccccggaggcactcaataccaacaaagccaggtgttagtccaaggcctactcctactggaattatcactccagtgtcaggggttcgctccaggaggtcagacagccttgggaggttgggtaccccgacatcagaagcatccatgtccactgcaaggcgcaagttcagtacactctcctcagtctcatattggatgacacagattaggcttgcagaggctgcttccaagcactctatctctctgggcttcttcaagcttgcccttgagtcagaatgtgagcctctggataggatgagagaagaactaaagacttatgtggccaggcatggccttgcaacagaattggaggagccggtgaaggagattcttcaggtttatgatattgtggaagattttgagaagctaaagatctcactggactcctcacaggagccaaaaaagtctgacaaggcttctcttggtgctgccaatgtgactccaaagggtaatctgaaacccaggtctctgaactctgttgcaactcagagtaaagatggcaagaaagagaacattcagaaggagaagcctgatgcgaagatcagaggttcctacaaccggaatccagccaagaatgctcctgcaaaagaaggtgccaaaaatactgccaagaagacaaagaagcaggctaaggagcagcaagaagattgtaatggaggcagtgaggtttcgccagttgacggcgatcaagaatctgttgatgtggtgaaggagatcacatatgaagataaggagaacatgggggatgctgagatggcaatagatgctggcaacgccgtagcccaagaagtctagaacagacggaccaacttcagattcaaaccttttgtttgctgaatatgaagtattgagtgtggtgcttgttttgttttcgccgttgttcatatgtcactagcacttgtctttccggttctcaaaccgtaacatgtcttgagagtgtgtattatggtttgctgggtgagactgctcgcttgtattccttggttaagtcggtttgcttgtctgtgtccagcttctgaatatagctgaatttctttatttgtgtgtataaccgttgggacaaagaaaaaaaaaactagagactgaccgaaggcacgacgaagggg

SEQ ID NO: 1068 - DNA, 1390 bp, Secale cereale
actttcggtttccgttggaggcctgggttggggatttgggggagatcgaatcctcgcctggggcggatctgccgttcgagttcatggccacctcgggtgatcagtcggccggctgcgtgtctgcggcgacgaaggggtccaagctgcggtacccgctgcggtcggcgggccggggcaagctggatccggcggcggcgggggaggctcctcctagcggccctgcttcgcggagggccaagccatcttcagatgtcaccaagagctgtgttctcgatctttctgccgtgaaggataaatcagctaaacctccgcggaggcactcaataccaacaaagccaggtgttagtccaaggcctgctcctactggaactattactccagtgtcaggggttcgctccaggaggtcagacagccttgggaggttgggtaccccgacatcagaagcatccatgtccactgcaaggcgcaagttcagtacactctcctcagtctcatattggatgacacagattaggcttgcagaggctgcttccaagcactctatctctctgggcttcttcaagcttgcccttgagtcagaatgcgagcctctggataggatgagagaagaactaaagacttatgtggccaggcatggccttgcaacagaactggaggagccggtgaaggagattcttcaggtttatgatatcgtggaagattttgagaagctaaagatctctttggacttctcacaggagccaaaaaagtctgacaaggcttctcttggtgctgccaatgtgactccaaagggtaatctgaaacccaggtctttgaactctgttgcaactcagagtaaagatggcaagaaagagaacattcagaaggagaagcctgatgcgaagatcagaggttcctataaccggaatccagccaagaatgctcttgcaaaagaaggtgccaagaataccgccaagaaaaccaagaagcaggctaaggagcagcaagaagattgtaatggaggtagtgaggtttcgccagttgatgcagatcaagaatctgttgatgtggtgaaggagatcacatatgaagataaggagaacatgggggatgctgagatggcaatagatgctggcaacgccgtagcccaagaagtctagaacagacggacgaacttcagattcaaaccttttgtttgctgaatatgaagtattgagtgtggtgcttgtttttctttcgcagttgttcatatgtcgctagcacttgtctttccggttctcaaaccgtaacatgtcttaagagtgtgtattatggtttgctgggtgagactgctcgcttgtattccctttgttaagttggtttgcttgtctgtgtccagcttctgaatatagctgaattctttatttgtgtg

SEQ ID NO: 1069 - DNA, 1253 bp, Avena sativa
gaaccaaaaccgaaaaccctctctcgattcttccgtaggcttccatttggcatcaccagtttcgattcgtgttggcggctgggggttgggggagaccgagttctctcatccgcggcggcttagtttttcgagttcatggccactccgggcgaccagtctggctctgcggcggcgaaggggtccaagctgcggtacccgctgcggtcggccagccgggggaaggtggagccggcgccgttggcggatgctcctcctagcggctccgtaccgagaagggccaaaccatcttcggatgtcaccaagagcatgtgtgctctcgatctttcgtcagtgaaggataaatcagcaaaacctccacggaggcactcaattccaacaaagccaggcgctagcccaaggcctactccttctggaactataactccagtgtcaggagttcggtctaggaggtcggacaccctgggaaagcttgataccccgacatcagaagcatccatgtccacagcaaggcgcaagttcagtactctgtcctcaatctcgtattggatgacacagattaggcttgcagaggctgcttcaaagcactccatctctctgggcttcttcaagcttgctctggaatcagaatgcgagccactagatcgaatgagagaagaactcaaggcttacgtagcccgacatggcctcacgacagaattggaggaacctgttaaggacattcttcaggtttatgatattgctgatgactttgagaagctgaagatctctgtagagtcctcacaagacccaaaaaagtctgacaaggctgctcctagtgctaccaatgtgactcccaagggtaatctgaagcctaggtcactgaactccgttgcaactcaaaacaaagatggcaagaaagagaacattcagaaggagaagcctgattccaaggtcaggggttcctacaaccggaatccagccaaaaatgcccctggaaaggaaacagctgccaaaaatggcgtcaagaaaaccaagaaacaggccaaggagcagcaggaggatggcaatggtggtagtgaggctttgtcagttggttcagagcaggcatctgttgatgtggtgatggagatcacatatgaagataaggagaacatgggggacaccgagatggcaagagatgctggcaatggcatagcccaagaagtctagttcagacggacctgacttcagattcaaaccttctgtttgctgagtatggagtattgagtgtttgg

SEQ ID NO: 1070 - DNA, 1249 bp, Avena sativa
gaaaaccgaaaaccctctctcgattcttccgtaggcttccatttggcatcaccagtttcgattcgtgttggcggctgggggttgggggagaccgagttctctcatccgcggcggcttagtttttcgagttcatggccactccgggcgaccagtctggctctgcggcggcgaaggggtccaagctgcggtacccgctgcggtcggccagccgggggaaggtggagccggcgccgttggcggatgctcctcctagcggctccgtaccgagaagggccaaaccatcttcggatgtcaccaagagcatgtgtgctctcgatctttcgtcagtgaaggataaatcagcaaaacctccacggaggcactcaattccaacaaagccaggcgctagcccaaggcctactccttctggaactataactccagtgtcaggagttcggtctaggaggtcggacaccctgggaaagcttgataccccgacatcagaagcatccatgtccacagcaaggcgcaagttcagtactctgtcctcaatctcgtattggatgacacagattaggcttgcagaggctgcttcaaagcactccatctctctgggcttcttcaagcttgctctggaatcagaatgcgagccactagatcgaatgagagaagaactcaaggcttacgtagcccgacatggcctcacgacagaattggaggaacctgttaaggacattcttcaggtttatgatattgctgatgactttgagaagctgaagatctctgtagagtcctcacaagacccaaaaaagtctgacaaggctgctcctagtgctaccaatgtgactcccaagggtaatctgaagcctaggtcactgaactccgttgcaactcaaaacaaagatggcaagaaagagaacattcagaaggagaagcctgattccaaggtcaggggttcctacaaccggaatccagccaaaaatgcccctggaaaggaaacagctgccaaaaatggcgtcaagaaaaccaagaaacaggccaaggagcagcaggaggatggcaatggtggtagtgaggctttgtcagttggttcagagcaggcatctgttgatgtggtgatggagatcacatatgaagataaggagaacatgggggacaccgagatggcaagagatgctggcaatggcatagcccaagaagtctagttcagacggacctgacttcagattcaaaccttctgtttgctgagtatggagtattgagtgtttgg

SEQ ID NO: 1071 - DNA, 1333 bp, Brachypodium distachyon
atggccacttccggcgatcaatccggatccgcggcggcgaaggcgtccaagctgcggtacccgctgcggtcggcgagccgggggaaggcggcgccgctggcggtggatgctcctcctgcagactcggctcccagaagggccaaaccatcttcggatgtcaccaagagcatgtgtgttcttgatctttcttccgtgaaagataaatcagccaaaccaccacggaggcactcaataccaacaaagccaggtgctagcccaaggcctactactactactggaaccatcaccccagtgtcagtggttcgctcgaggaggtcagagatccaggggaagtttgataccccaacatcagaagcatccatgtccacaggaaggcgcaagttcagtacactgtcctcaatctcatattggatgacacagatcaggcttgcagaggctgcttccaagcactctgtctctctgggctttttcaagcttgcccttgaatcagaatgcgagcctttagatcggatgagagaggaactcaaggcttacatagcccggcatggtcttgcaacggacttagaggagccggtgaaggacattcttcaggtttatgatattgctggtgattttgagaaactgaagatctctgtggactcctcgctggaatcaaaaaagtgtgacaaggctgctcttagtgctaccaatgcgactccaaagggtaatctgaagcctaggtcactgaattctgttgctactcaaagcaaagatggcaagaaagagaacattcagaaggagaagcctgatgctaaggtcagaggatcctatacccggaatccagccaaagttgctcctggaaaggaattagctgccaaaaatactggtaagaaaaccaagaagcaggccaaggagcatcaagaagattgcaatggaggtagtgaggctttgccagttgatccagacctagaatctgttgatgttgtgaaggagatcacatatgaagataaggagaacatgggggatactgagatgtcaattgatggtggaaatggcttagcccaagaagtctagaacagacgtaccgacttcagattcaaaccttttgtttgctgaacatgaagtattgagtgtgtggtgcttgttttcattcgtcattgttgatatgtcgtcagtgcttgtctttcttgctgtcaaaccgtaaggtgtgtatcatggtttgctgggtgagactgcttgcttgtattcgctttgttaagtcagctttgctgtgtgtggtcctgttgggcaggaaatacttcctgatggttgtgtttctcttttgaatataggtgaattctttatttgtgtgatc

SEQ ID NO: 1072 - DNA, 1791 bp, Brachypodium distachyon
tagaatcctctcgaaccgcccaggtcctcatccctccgtttcgcatcgcctgtttcgatttctgtttgggcgattgggttctctctctcccgtggccgattagttgttcgagggtttatggccacttccggcgatcaatccggatccgcggcggcgaaggcgtccaagctgcggtacccgctgcggtcggcgagccgggggaaggcggcgccgctggcggtggatgctcctcctgcagactcggctcccagaagggccaaaccatcttcggatgtcaccaagagcatgtgtgttcttgatctttcttccgtgaaagataaatcagccaaaccaccacggaggcactcaataccaacaaagccaggtgctagcccaaggcctactactactactggaaccatcaccccagtgtcagtggttcgctcgaggaggtcagagatccaggggaagtttgataccccaacatcagaagcatccatgtccacaggaaggcgcaagttcagtacactgtcctcaatctcatattggatgacacagatcaggcttgcagaggctgcttccaagcactctgtctctctgggctttttcaagcttgcccttgaatcagaatgcgagcctttagatcggatgagagaggaactcaaggcttacatagcccggcatggtcttgcaacggacttagaggagccggtgaaggacattcttcaggtttatgatattgctggtgattttgagaaactgaagatctctgtggactcctcgctggaatcaaaaaagtgtgacaaggctgctcttagtgctaccaatgcgactccaaagggtaatctgaagcctaggtcactgaattctgttgctactcaaagcaaagatggcaagaaagagaacattcagaaggagaagcctgatgctaaggtcagaggatcctatacccggaatccagccaaagttgctcctggaaaggaattagctgccaaaaatactggtaagaaaaccaagaagcaggccaaggagcatcaagaagattgcaatggaggtagtgaggctttgccagttgatccagacctagaatctgttgatgttgtgaaggagatcacatatgaagataaggagaacatgggggatactgagatgtcaattgatggtggaaatggcttagcccaagaagtctagaacagacgtaccgacttcagattcaaaccttttgtttgctgaacatgaagtattgagtgtgtggtgcttgttttcattcgtcattgttgatatgtcgtcagtgcttgtctttcttgctgtcaaaccgtaaggtgtgtatcatggtttgctgggtgagactgcttgcttgtattcgctttgttaagtcagctttgctgtgtgtggtcctgttgggcaggaaatacttcctgatggttgtgtttctcttttgaatataggtgaattctttatttgtgtgatcatcttgggcagtaaatccttcctgatggttgtgtttttcttttgtgcattgtatcactctctcgtgcatgcttaatagataatgatcaggacttgaattcgatgcacgcgagtgcacgttctatgctgcaagggtgtagaaggttgttttgtgtgatcatgtggcttttcgttgcaatcttgggtctatgacagaatttcagaatccagagcacacatgtatgtcggctttgtttaaatgcaacctgtaagctacatttcttttgctgtcaaatctttctgcctgagctagcatttgaatgttcgaacagcacatgatgtgattaaggtgtttcaacagca

SEQ ID NO: 1073 - DNA, 1262 bp, Triticum aestivum
accagcaacttgcactgaggcctctcgggttcctactttgaaattgctgccaactaatttttttatttcataatcgcttctaattgctctccatatatagggccaagccaacttcagatgtcaccaagagctgtgctctcgatctttctgccgtgaaggataaatcagctaaacctccgcggaggcactcaataccaacaaagccaggtgttagtccaaggcctactcctactggaactattactccagtctcaggggttcggtctaggaggtcagacagcctcgggaggtgtgataccccgacatcagaagcatccatgtccactgcaaggcgcaagttcagtacactctcctcagtctcatattggatgacacagattaggcttgcagaggctgcttccaagcactctatctctctgtgcttcttcaagctcgcccttgagtcagaatgcgagcctctggataggatgagagaagaactcaaggcttatgtggccaggcatggccttgcaacagaattggaggagccggtgaaggagattcttcaggtttatgatatcgtggaagattttgagaagctaaagatctctctggactcctcacaggagccaaaaaagtcagacaagtctgctgttagtgccgccaatgtgactccaaagggtaatctgaaacctaggtctctgaactctgttgcaactcagagtaaagatggcaagaaagagaacattcagaaggagaaacctgatgcaaagatcagaggttcctataacaagaatccagccaaaaatgctcctgcaaaagaaggtgccaaaaatactgtcaagaaaaccaagaagcaggctaaggagcagcaagaagattgtaatggaggcagtgaggtttcgccagttgaggcagaccaagaatctgttgatgtggtgaaggagatcacatacgaagataaggagaacatgggggatgctgagatggcaatagatgctggcaacgccgtagcccaagaggtctagaacagatggaccgacttcagattcaaaccttttgtttgctgaatatgaagtattgagtgtgtggtgcttgttttctttcgccgttgttgatatgtcactagcacttgtctatccggttgtcaaaccgtaacatgtctttaagagtgtgtattatggtttgctgggtgagactgctcgcttgtattctctttgttaagtcagtttgcctgtccgtgtccagcttctgaatatagctgaattctttatttgtgtgat

SEQ ID NO: 1074 - DNA, 1176 bp, Triticum aestivum
agggccaagccatcttcagatgtcaccaagagctgtgctctcgatctttctgccgtgaaggataaatcagctaaacctccgcggaggcactcaataccaacaaagccaggtgttagtccaaggcctactcctactggaactattactccagtctcaggggttcggtctaggaggtcagacagcctcgggaggtgtgataccccgacatcagaagcatccatgtccactgcaaggcgcaagttcagtacactctcctcagtctcatattggatgacacagattaggcttgcagaggctgcttccaagcactctatctctctgtgcttcttcaagctcgcccttgagtcagaatgcgagcctctggataggatgagagaagaactcaaggcttatgtggccaggcatggccttgcaacagaattggaggagccggtgaaggagattcttcaggtttatgatatcgtggaagattttgagaagctaaagatctctctggactcctcacaggagccaaaaaagtcagacaagtctgctgttagtgccgccaatgtgactccaaagggtaatctgaaacctaggtctctgaactctgttgcaactcagagtaaagatggcaagaaagagaacattcagaaggagaaacctgatgcaaagatcagaggttcctataacaagaatccagccaaaaatgctcctgcaaaagaaggtgccaaaaatactgtcaagaaaaccaagaagcaggctaaggagcagcaagaagattgtaatggaggcagtgaggtttcgccagttgaggcagaccaagaatctgttgatgtggtgaaggagatcacatacgaagataaggagaacatgggggatgctgagatggcaatagatgctggcaacgccgtagcccaagaggtctagaacagatggaccgacttcagattcaaaccttttgtttgctgaatatgaagtattgagtgtgtggtgcttgttttctttcgccgttgttgatatgtcactagcacttgtctatccggttgtcaaaccgtaacatgtctttaagagtgtgtattatggtttgctgggtgagactgctcgcttgtattctctttgttaagtcagtttgcctgtccgtgtccagcttctgaatatagctgaattctttatttgtgtgatcccccttgagca

SEQ ID NO: 1075 - DNA, 1174 bp, Secale cereale
agggccaagccatcttcagatgtcaccaagagctgtgttctcgatctttctgccgtgaaggataaatcagctaaacctccgcggaggcactcaataccaacaaagccaggtgttagtccaaggcctgctcctactggaactattactccagtgtcaggtgttcgctccaggaggtcagacagccttgggaggttgggtaccccgacatcagaagcatccatgtccactgcaaggcgcaagttcagtacactctcctcagtctcatattggatgacacagattaggcttgcagaggctgcttccaagcactctatctctctgggcttcttcaagcttgcccttgagtcagaatgcgagcctctggataggatgagagaagaactaaagacttatgtggccaggcatggccttgcaacagaattggaggagccggtgaaggagattcttcaggtttatgatattgtggaagattttgagaagctaaagatctctctggactcctcacaggagccaaaaaagtctgacaaggctgctcttggtgctgccaatgtgactccaaagggtaatctgaaacccaggtctttgaactctgttgcaactcagagtaaagatggcaagaaagagaacattcagaaggagaagcctgatgcgaagatcagaggttcctataaccggaatccagccaagaatgctcctgcaaaagaaggtgccaagaataccgccaagaaaaccaagaagcaggctaaggagcagcaagacgattgtaatggaggcagtgaggtttcaccagttgacgcagatcaagaatctgttgatgtggtgaaggagatcacatatgaagataaggagaacatgggggatgctgagatggcaatagatgctggcaacgccgtagcccaagaagtctagaacagatggaccaacttcagattcaaaccttttgtttgctgaatatgaagtattgagtgtggtgcttgtttttctttcgccgttgttcatatgtcactagcacttgtcttttcagttctcaaaccgtaacatgtcttaagagtgtgtattatggtttgctgggtgagactgctcgcttgtattccctttgttaagttggtttgcttgtctgtgtccagcttctgaatatagctgaattctttatttgtgtgatacccttgggcag

SEQ ID NO: 1076 - DNA, 1472 bp, Triticum aestivum
agggccaaaccatcttcagatgtcaccaagagctgtgctctcgatctttccgccgtgaaggataaatcagctaaacctccgcggaggcactcaataccaacaaagccaggtgttagtccaaggcctactcctactggaactattactccagtgtcaggggttcgctccaggaggtcagacagccttgggaggttggataccccgacatctgaagcatccatgtctacagcaaggcgcaagttcagtacactctcctcggtctcatattggatgacacagattaggcttgcagaggctgcttccaagcactctatctccctgggcttcttcaagcttgcccttgagtcagaatgcgagcctctggataggatgagagaagaactaaagacttatgtggccaggcatggccttgcaacagaattggaggagccggtgaaggagattcttcaggtttatgatatcatggaagattttgagaagctaaagatctctctggactcctcactggagccaaaaaagtctgacaaggctgctcttggtgctgccaatgtgactccaaagggtaatctgaaacccaggtctctgaactctgttgcaactcagagtaaagatggcaagaaagagaacattcagaaggagaagcctgatgccaagatcagaggttcctataaccggaatccggccaagaatgctcctgcaaaagaagttgccaaaaataccgccaagaaaaccaagaagcaggctaaggagcagcaagaagattgtaatggaggcagtgaggttttgccggttgacgcagatcaagaatctgttgatgtggtgaaggagatcacatatgaagataaggagaacatgggggatgctgagatggcaatagatgctggcaacgccatagcccaagaagtctagaaccgacggaccgacttcagattcaaaccttttgtttgctgaatatgaagtattgagtgtgtggtgcttgttttctttcgcccttgttgatatgtcattagcacttgtctttccggttgtcaagccgcaacatgtctttaagcgtgtgtattatggtttgctgggtgagactgctcgcttgtattccctttgtcaagtcagtttgcttgcccgtgtccagcttctgaatatagctgaattctttatttgtgtgatacccttgggcagacaattctccctgatctttgtgttcttctcatgtatatattatgcacaacggccatgttataattcttctcatgcgtgcttagtagtctgtgatcagatcttcaattctattcacgtgtctgcatgctctatgctgcatcagtgtagtatgcttactgtgtgatcatgtggtttatcctttcattcttggatacctcgatctatcacagtatccagagcacggagcacacatggatgttggtttgattaactgcaacttgtaagccacatttctttgctctgtaatcattttgctc

SEQ ID NO: 1077 - DNA, 973 bp, Triticum aestivum
cgcccgctatcctatcatggctcctcacgccgctgtcctcctctccctcctcctgctcaccacctgcgcggcggacacgcatctccacttcttcctccacgacgtggtctccggcagcaacccgacggcggtgcaggtcatcaagggtcctgcctcgtcgtccaacgccctcccggacgtggccttcggcgacacgaccgtcatcgacgacgcgctgacggagacctcgtcgccgacgtcggcgcccgtggggcgcgcgcaggggttctacatgatgtcgtcgcagtcgggcatggtgctgatgatgtgcgtgaacctgctgctcaccacgggggactacaacggcagcacgctggccgtcatcggccgcgacgacgtcatgaccaccacgcgggagctctccgtggtgggcggcacggggaagttccggatggcgacggggtacgtggtgtggaagaccaacagctcgagcggcgccgacgccaccatcgagcttgacgtctacaccaccggcctcaacggcaccgccaccatcgacgccaacgcgcccgtctcccccatcgacgggggcggcgccggtgcaccggcaagtcgtcctcgggcgcggcggcgctgagaggagcagtgccgtacgggtgggccaacgcgtgggtggccgccgtccttgtagctctggctggttgcgtttggtgagcagctcgattcgatccaccatgaatctgagtgagtgggagtggggtccatccatacaacggaatagatcttgattaggcgtgaggagttggtcggtgtagtggtgtggttggtgatgatggggtgggtgctttcttgtcgctgttcgggttgggtttggtgatgtgcacatgactacacatctcccatgcgtgcgtgagcgtgagacattactttccggctactacatccatttgattattacctagaagaaccgattctcacacttttaaaaaaaaaa

SEQ ID NO: 1078 - DNA, 1373 bp, Triticum aestivum
gctcctcacgccgctgtcctcctctccctcctcctgctcaccacctgcgcggcggacacgcatctccacttcttcctccacgacgtggtctccggcagcaacccgacggcggtgcaggtcatcaagggtcctgcctcgtcgtccaacgccctcccggacgtggccttcggcgacacgaccgtcatcgacgacgcgctgacggagacctcgtcgccgacgtcggcgcccgtggggcgcgcgcaggggttctacatgatgtcgtcgcagtcgggcatggtgctgatgatgtgcgtgaacctgctgctcaccacgggggactacaacggcagcacgctggccgtcatcggccgcgacgacgtcatgaccaccacgcgggagctctccgtggtgggcggcacggggaagttccggatggcgacggggtacgtggtgtggaagaccaacagctcgagcggcgccgacgccaccatcgagcttgacgtctacaccaccggcctcaacggcaccgccaccatcgacgccaacgcgcccgtctcccccatcgacgggggcggcgccggtgccaccggcaagtcgtcctcgggcgcggcggcgctgagaggagcagtgcggtacgggtgggccaacgcgtgggtggccgccgtccttgtagctctggctggttgcgtttggtgagcagctcgattcgatccaccatgaatctgagtgagtgggagtggggtccatccatgcaacggaatagatcttgattaggcgtgaggagttggtcggtgtagtggtgtggttggtgatgatggggtgggtgctttcttgtcgctgttcgggttgggtttggtgatgtgcacatgactacacatctccgatgcgtgcgtgagcgtgagacattactttccggctactacatccattagaagaacgcccgtgcgttgcaacggggccacattaactttaagagttcaatattaatcatgttaataatacatttaatattctcatacatatcaagtgacactggcgaccttttttaccatcaaaacctcacacacatacactctccgtacctcttcctcactctctctccccctctctccccccctctctctctctctaacacacacacatatccatcttattgggtataggaccataatccatctatttcacacatatgctagtgcataacaatatggattatgtgtattatatttgccaccacaactgagggaatttatttcatgtaaatcggccagccacagctccgtgacaaacaatacatctaaattctcagcgttatttttatgtaacatgcattatctttatactatttcttgtccgcgattaaactattacctgaacttgctaccaccaaatga

SEQ ID NO: 1079 - DNA, 949 bp, Secale cereale
tcctatcatggcttctcacgccgctgtcctcttctccctcctcctgctcaccacctgcgcggcggacacgcacctccacttcttcctccacgacgtggtctccggcagcaacccgacggcggtgcaggtcatcaagggtcctgcctcttcgtccaacgccttgccgggcgtggccttcggcgacacgaccgtcatcgacgacgcgctgacggagacctcgtctccgacgtcggcgccggtggggcgcgcgcaggggttctacatgatgtcgtcgcagtcgggcatggtgctgatgatgtgcgtgaacctgctgctcaccacgggggactacaacggcagcacgctggccgtcatcggccgcgacgacgtcatgaccaccacgcgggagctctccgtggtgggcggcacggggaagttcaggatggcgacggggtacgtgctgtggaagaccaacagctcgagcggcgccgacgccaccatcgagctcgacgtctacaccaccggcatcaacggcaccgccaccatcgacgccaacgcgcccgtctcccccatcgacgggggcggcgccggtgcgtccggcggcgccaccgggaagtcgtcctcgggcgcggcggcgctcagaggagcagtgccgtacgggtgggtggccgccgtccttgtagctctggctggttgcgtttggtgagcagctcgattcgatctaccatgaatccgagtgagtgggagtggggtccatccatacaacggaatagatcttgattaggcgtgaggagttggtcggtgtagtggtgttgttggtgatgatggggtgggtgctttcttgtcgctgttcgggttgggtttggtgatgtgcacatgaccacacatctccatgcgtgcgtgagcgtgagaggttactttccggctattacatccatttgattattacctagaagaaccgattctcaca

SEQ ID NO: 1080 - DNA, 947 bp, Secale cereale
tcaccggcgctgacgcgacggcggaaccattccgcatttacgtgggctacgactcccgcgaggacatcgcataccgcgtctgccggcggtcactcctgcgccgctcctccgtgccgctggaggtcatcccgatcgtccagcaggagctccgcgaggctgggctgtactggcgggagcgcggtccgacggagagcaccgagttctccttcacccgcttcctgacgccgcacctcgccggctaccgcgggtgggcgctcttcgtggactgcgacttcctcttcgtcgccgacgtggcagagctggcgcgcatggccgacccgcgctatgccgtgctgtgcgtgcaccacgactacacgcccaaggaggccaccaagatggacggcgccgtgcagacggtgtacccccgcaagaactggtcctccatggtgctcttcaactgcggccaccccaagaaccgcgccgcgctcacgccggaggccgtgagcacccagagcggagcgcacctccaccgcttcgcgtggctggacgacgccgacgtcggcgaggtgccgttcgcgtggaacttcctcgtggggcacaaccgcgtcgacccggcggacgtggccgggaccacgccgcgcgccatacactacacgtccggcgggccgtggttcgagcggtacaaggactgcgagttcgccgacctctgggtccaggagcgcgacgcgtacgagtccgaggagaaacaagacgaggtggaaggcacaagagtgccatcatcgtctacggttgcagtggacgcatgaatgatgcaccacgtctttctgttcgtctttgttgttttcccttgtcaagttacttcctactactatgagcgtgacgactatcatgtgtcaaaataaggccctagaaggcgttccttgagggcccgagtgcagtgtatcgaatataatatatcctatgttgct

SEQ ID NO: 1081 - DNA, 1095 bp, Setaria italica
acaagctataacattcacacaggctagcacagatagcaaggagcaaacgctcttcacgaacgtatccccatccgcgtgaaactgaaaatgtcgcccacaccttctcacctcgcgggagcgggcgccgtcgccgtcgccggcccggagccgttccgtgtgttcgtgggctacgactcccgcgaggacatcgcgtaccgcgtgtgccgccgctccctgctccgccgctcctccatcccgctcgacgtgatccccatcgtccagcaggagctccgcgaggccgggctgtactggcgggagcgcggcccgacggagagcaccgagttctccttcacccgcttcctgacgccgcacctggcggggtaccgcgggtgggcactgttcgtggactgcgacttcctcttcgtcgccgacgtcgcggatctggcgcgcctcgccgccagcgccgacccgcgccacgccgtgctgtgcgtgcaccacgactacacgcccacggaggcgaccaagatggacggcgccgtgcagacggtgtacccgcgcaagaactggtcgtccatggtgctcttcaactgcggccactccaagaaccgcgccgcgctcacgccggaggccgtcagcacgcggagcggcgcctacctccaccgcttcatgtggctcgacgacgacgaggtcggggaggtgccgttcgtgtggaacttcctcgtggggcacaacaaggtcgaccccgccgacgaggccgccacggcaccgcgcgccatacactacacgtcggggggcccgtggttcgagaggtacaaggactgcgagttcgccgacctgtgggtccaggagcgcgacgcctacgaggccgaggaggagaagaagaaggtcgaggaggagggtgtcaaggccgccgtacaaatgtcatccgcggtgtcggtggacgcatgagatgagatctcccttgctagccccctagctacttgctgagctgaggccgcgcttcgtgcttttttttttctcgtacacgttgatacgtgcgtgtggtggaaatggtttgtgcaagcgtgcatgtgtgtccgtactgtattttattaagaaataaaggatgtggtcgga

SEQ ID NO: 1082 - DNA, 1486 bp, Oryza sativa
atgcataattctggacatcgatctccctgggcctaataatgcaagcgtaacgctgttgacgtacatgtcgtcatatacgcatgtcctcgtttcaattcgctccccacactcaaaggacaaagggctcttaggctcttattaaaaaggcggaggagtttgtgataactcgcacggcctatgcgtacgtagcaccaggagctagcaaacactactctttttttctttttttgcggggaagctagcaaacagtactactaaccttctgcttatatatcaccaacaaatactatgtcggtcacgcctaccaacgacgtcgtgatgactggccctgtagctggcgccggcgacgtgcaggccgctgagacgttccgcgtgttcgtcgggtacgactcgcgcgaggacatcgcgtaccgcgtgtgccggcgctccctgctgcagcgctcctccgtgccggtggccgtgatcccgatcgtgcagcaggagctccggtctgcggggctgtactggcgggagcgcgggcccacggagagcaccgagttctccttcacccgcttcctgacgccccacctggccggctaccgcggctgggcgctcttcgtcgactgcgacttcctcttcgtcgccgacgtcgcggagctggcgcgcatggccgacccgcgctacgcggtgctgtgcgtgcaccacgactacgcgcccaaggaggccaccaagatggacggcgccgtgcagacggtgtacccgcgcaagaactggtcgtccatggtgctcttcaactgcgcccacccaaagaaccgcgccgcgctgacgcccgaggccgtgagcacgcagagcggcgcgtacctgcaccgcttcatgtggctggacgacgccgacatcggcgaggtgcccttcgtgtggaacttcctcgtggggcacaaccgcgtcgaccccgccgacacggccgggacggcgccgcgcgccatccactacacttccggcgggccgtggttcgagcagtacaagaactgcgagttcgcggagctctgggtccaggaacgtgacgcgtatgaggccgaggcggaggaggacgaggagaaggaagagcacgagcccaaggccatcctgcatgcccctgctgcgccgtcggcagttcccgtggacgcctgagcctcacgtgcggtgcctactgttttctaataatatgattggaataaactcatgacggccacacctcaagaatgataagttctatatattgttgatcatatggttaaatattactttgaggctaaatgctggtcataacgtgtctttgtggctatcaagtcaagtgatctctctaagaggaagtgggagcaccccgagcgaagggtgaaggacgacgacaaaccagagtgaaagaagggcacaaaacaagcggagattaccaaatcactaatacctggggaaaaactattgcaatctatgctcatcgaattgtcgtgctagactaaccgttacttatagg

SEQ ID NO: 1083 - DNA, 1121 bp, Oryza sativa
aactcgcacggcctatgcgtacgtagcaccaggagctagcaaacactactctttttttctttttttgcggggaagctagcaaacagtactactaaccttctgcttatatatcaccaacaaatactatgtcggtcacgcctaccaacgacgtcgtgatgactggccctgtagctggcgccggcgacgtgcaggccgctgagacgttccgcgtgttcgtcgggtacgactcgcgcgaggacatcgcgtaccgcgtgtgccggcgctccctgctgcagcgctcctccgtgccggtggccgtgatcccgatcgtgcagcaggagctccggtctgcggggctgtactggcgggagcgcgggcccacggagagcaccgagttctccttcacccgcttcctgacgccccacctggccggctaccgcggctgggcgctcttcgtcgactgcgacttcctcttcgtcgccgacgtcgcggagctggcgcgcatggccgacccgcgctacgcggtgctgtgcgtgcaccacgactacgcgcccaaggaggccaccaagatggacggcgccgtgcagacggtgtacccgcgcaagaactggtcgtccatggtgctcttcaactgcgcccacccaaagaaccgcgccgcgctgacgcccgaggccgtgagcacgcagagcggcgcgtacctgcaccgcttcatgtggctggacgacgccgacatcggcgaggtgcccttcgtgtggaacttcctcgtggggcacaaccgcgtcgaccccgccgacacggccgggacggcgccgcgcgccatccactacacttccggcgggccgtggttcgagcagtacaagaactgcgagttcgcggagctctgggtccaggaacgtgacgcgtatgaggccgaggcggaggaggacgaggagaaggaagagcacgagcccaaggccatcctgcatgcccctgctgcgccgtcggcagttcccgtggacgcctgagcctcacgtgcggtgcctactgttttctaataatatgattggaataaactcatgacggccacacctcaagaatgataagttctatatattgttgatcatatggttaaatattactttgaggctaaatgctggtcataa

SEQ ID NO: 1084 - DNA, 753 bp, Secale cereale
tccccagccccctcgtccctaccaggcagccgccagagcccagaggaggaggggaaagcggccgccggatcgacgatgatgtggggcgtcgcagccgccgtcgcgtcggccgccgccgtcgccgtggcctccggcgccgagctgctcgcctgcgactgcgccccgacgccggccgtcgccgtcggcagatgcgacgagttcctcctccgccagcgggattcctcggcgtcgagcggggccagcggcggcgtgccggacgacaagttcgcgccgcggttcgacgggctgcgcttcatcgagacgctcgtcacggcgcaccgctgaaaccccctgttttgttttctcaggggattctttctctccgtgcgattcgcggggaggggctggctgctaccctattaatccggcgattggcggccaacgcgccgccgaatttttgctgctatgacaaattgaggtttctcgtttctttttttcttttctttgctgctgatgacgattatcgtcctattgttgtcgagtgatgcgattgaattggaacctgcatatgatgtgatgagcgtatgtacctgtgctagcatttgattctttacccgatctgttatgcaagcatgatagcatgatatgagatgattgttggtatgatttcagctccaaacttgcctttctcatgtatggttggtaggcctgctgtccctgtttgtggttggcctccttccggaattgtcattttcccctctttgttgcacgcaa

SEQ ID NO: 1085 - DNA, 637 bp, Secale cereale
gaggaggaggggaaagcggccgccggatcgacgatgatgtggggcgtcgcagccgccgtcgcctccgcggccgccgtcgccgtggcctctggcgccgagctgctcgcctgcgactgcgccccgacgccggccgtcgccgtcggcagatgcgacgagttcctcctccgccagcgggattcctcggcgtcgagcggggccagcggcggcgtgccggacgacaagttcgcgccgcggttcgacgggctgcgcttcatcgagacgctcgtcacggcgcaccgctgaaaattaaatctccctggggattctttccggtcttcttcttcgtgcgattcgcggggaggggctgtctgctaccctattaatccggcgattggcggccaacacgccgccgaatttttgctgctaggacaaattgaggttttttttcgtttctttttcttcccttttcttctttgccaatgacgattatcgtcctattgttgtcgagtgatgcgattgaattggaaccttcaagtatgtgatgattgtacctgatccgttgtgcaagcatggtatggtatggtatgatttcataccccaaactttgcctttcgcgtgtatggtaggcctgctgtctctgtttgtggttggccttgtt

SEQ ID NO: 1086 - DNA, 796 bp, Triticum aestivum
attccagcctgccctgcccaagcaaagaattcccagccttcacacctctccccctcgctccgtccctaccagccagaggaggaggaggggaaagtggctgctggatcgacgatgatgtggggcgtcgcagccgccgtcgcctccgcggccgccgtcgccgtggcctccggcgccgagctcctcgcctgcgactgcgccccgacggagccgcccgccgccgtcgccatcggcagatgcgacgagttcctcctccgccagcgggattcctcggcgtcgagcggggccagcggcgacgacaagttcgcgccgcggttcgacgggctgcgcttcatcgagacgctcgtcacggcgcaccgctgaaaattcccccctgcggactctttccagtcgtcttcttcgtgcgattcgcggggagaggctggctgctaccctattaattcggcgattggcggccaacgcgccgccgaatttttgctactactaggacaaattgaggttttccgtttctttttctcccttttgtttctctttgctgatgacgattatcgtcctattgttgtcgagttatgcgattgaactggaacattcaagtgggcatgtgatgtgatgagcgtatgtacttgtgctagcatttggttccttacccgatctgttatgcaagcatgttagtatgatatgagatgattgatggtctgatttcagctccaaacttgccattctcatgtatggtaggcctgctgtccctgcttgtggttggcctctttccggaattgtcctttttcccctctttgctgca

SEQ ID NO: 1087 - DNA, 447 bp, Secale cereale
ccccagccccctcgtccctaccagcagccgccagagcccagaggaggaggggaaagcggccgccggatcgacgatgatgtggggcgtcgcagccgccgtcgcgtcggccgccgccgtcgccgtggcctccggcgccgagctgctcgcctgcgactgcgccccgacgccggccgtcgccgtcggcagatgcgacgagttcctcctccgccagcgggattcctcggcgtcgagcggggccagcggcggcgtgccggacgacaagttcgcgccgcggttcgacgggctgcgcttcatcgagacgctcgtcacggcgcaccgctgaaaccccctgttttgttttctcaggggattctttctctccgtgcgattcgcggggaggggctggctgctaccctattaatccggcgattggcggccaacgcgccgccgaatttttgctgctatgac

SEQ ID NO: 1088 - DNA, 604 bp, Secale cereale
tcagataaaaaataccactacgcggctagccgtcacctccattccagcctgcccaacagcccaagcaaagaatccccagccccctcgtcgctaccagccagccgacagacgaggaggaggaggggaaagcggccgccggatcgacgatgatgtggggagtcgcagccgccgtcgcgtcggccgccgccgtcgccgtggcctccggcgccgagctcctcgcctgcgactgcgccccgacgccggccgtcgccgtcggcagatgcgacgagatcctcctccgccagcgggattcctcggcgtcgagcggggccagcggcggcggcccggacgacaagttcgcgccgcggttcgacgggctgcgcttcatcgagacgctcgtcacggcgcaccgctgaaaattaaatccccccggggattctttcctcgtgcgattcgcggggagaggctggctgctaccctattaaaccggcgattggcggccaacgcgccgccgaatttttgctactactaggacaaattgaggtttttttggtttccttttctccccctatatcttctttctttgctcatgacgattatcgtcctattgttgttgagtgatgcg

SEQ ID NO: 1089 - DNA, 997 bp, Triticum aestivum
attcccagccttcacacctctccccctcgctccgtccctaccagccagaggaggaggaggggaaagtggctgctggatcgacgatgatgtggggcgtcgcagccgccgtcgcctccgaggacgccgtcgccgtggcctccggcgccgagctcctcgcctgcgactgcgccccgacggagccgcccgccgccgtcgccatcggcagatgcgacgagttcctcctccgccagcgggattcctcggcgtcgagcggggccagcggcgacgacaagttcgcgccgcggttcgacgggctgcgcttcatcgagacgctcgtcacggcgcaccgctgaaaattcccccctgcggactctttccagtcgtcttcttcgtgcgattcgcggggagaggctggctgctaccctattaattcggcgattggcggccaacgcgccgccgaatttttgctactactaggacaaattgaggtttcccgtttctttatctcccttttgtctctctttgctgatgacgattatcgtcctattgttgtcgagttatgcgattgaactggaacattcaagtgggcatgtgatgtgatgagcgtatgtacttgtgctagcatttggttccttacccgatctgttatgcaagcatgttagtatgatatgagatgattgatggtctgatttcagctcccatgtaaatgtcctcgtgctccaaaagggcggccgttctagagtatcctcggagggtccaggcttacgcgtacccggctttttgttacaagtggtcccatggggagtcgaataatagttaggccctggcggcttttaaaagttttgaattggaaactggtccttgggatcttgggagggacctaactccggggtgtgaaatatgggacaactacctgcgggattttaggcctagggaattttaaatttcaggtttttgtgttaaaccaccggtattccctcccgcctaaattttgcttcgggggtttattttgaaaatt

SEQ ID NO: 1090 - DNA, 846 bp, Triticum aestivum
ccgtcggcacggttcagcccgccaaagagattccagcgtgccgccagcgttcacgcctctcccccctttccagccagccaccagagcagaaggggaaagtggatcgacgatgatgtggggaatagcaaccgcggtggcgtccgcggccgccgtcgccgtggcctccggcgccgagctcctcgcgtgcgactgcgccccgacggcgccgaccgccgccgtcgtcggcagatgcgacgggttcctcttccgacagcgggaatcctcgtcttctagcggccggggcgagaggttcgcgccgaggttcgacgggctgcggttcatcgagacgctcgtcacggcgcaccgctgaagactccggaagctcgtcccgtcgtccgggcggctcccagccgaccctgttcatcaggggattctttcctaccgccctcttcatgcgattcgcgagaagaggctagctgctagacggttaattcggcgattggtggccaatatgttgccaaatttttgctaggacaaattgagagttttggtttctttcttcttcttttcctggtgatgatgatcgtcctattgttgagtgatgcggttgaattggaaccttcaagtggcatgtgatgattgtatgtgcctgtgctagcattggttctttacctgatttgttgtgcaagcatgatgtgatatgatttcacctccaaacttgccattctatgtgttgtcttgttgtcttctgtgtgtggtcggtcttgttctggagctgtttcttcctctcccttggctgctcatatcacatggctcagtgtttggactttggagtgcatcctgtccatgtatgttggggtggtaaaa

SEQ ID NO: 1091 - DNA, 886 bp, Hordeum vulgare
acggttccttcccgttccagcccgccaaagagattccagcgtgacgccagcgttcacgcccctctcccccgtgccagccagccgccagaggaggagggggaaagtggatcgacgatgatgtgggggctcgcagccgccgtcgcgtccgcggccgccgtcgccgtggcctccggcgccgagctcctagcgtgcgaggaccgcgccccgacggcgccggcgaccgccctcgccgtcgtcggcagatgcgaccggttcctcctccggcagcagggatcctcgtcgtcgggcggccgggacgacaggttcgcgccgaggttcgacgggctgcggttcatcgagacgctcgtcacggcgcaccgctgaaatcgccggtggaccgacccttcatcggccgggtgacacccacatactactataatcgaccctgtttcttaacggattcttttcgtatcatcctcttcgtgcgatgcgattcgcgagaagaggctagctgctacactgtctaattcggcgactggcggcgaacatgttgccataattttgctaggacaaactgaggcttttgatttcttcttctttttcctgattgttgagtggggcggttgaattggaaccttcaggtatcatgtgatgagtctattactagttctgtacctgatttgttgtgtgatacccaaacttgccattctcatgtcttgtctgatttgtttgtggttggtcttctctgtatcctctctctgttgcacagatcagagggctcagtaaaattattccctggatagatggtaataattactggctggatgctgaactggcctttgattgctgcgtttaatttggcaatgagacattatctttcagtcctcacagacctgtagataaagat

SEQ ID NO: 1092 - DNA, 2567 bp, Triticum aestivum
cctctcgcccgcgtcaatccaattttaatgctgcggcagcccccctccccatcctcggaatctgttgcattcaatacaactttcgaaaaacaatcatttttctaatgcgccccagctacctagatccagccaaaggctccaagccccttttgccagcactgttcggcctccattagcggcgcacgagcgagcttctccgccccctcgcctccgctgattaccgctggtgcgattagcggagcgctcacgaagagagagaccagcagtgaaggcgaggccttcgagctcgcgatcccttttcctctgctgctgcccgcaagattacaaaatcccgcgtttgtcctgttgccgctgctgccgctggcgctgctctcgggagggcggccatagaaaggagataaggagaggaagaaacggaaaaaagaaaataaaggctggaggcttttggagctcataatttttggcctttctctgcgctccccggggagattttccggcgctttctcactttctttccggaggtgggagagaatccagcctctgaattcgtttctggtctggtccaaggcgagagagtgttcttgcttgagttggtgttgatccaatgggcgagatgaaccaccagcccggggcgccgccgccggtgggcgtgccaccgcccatggggatgcagcccatgatgaacgcaccggtcggcgcgggcgccatgcaccagccctacgagcagttcaaccaactcaactactgcgtccactccaatccttcttgggttcaggtagcagggcttgcattcctccactacctagtgatgttgggctctactgtcatgcttgtgtcaattattgttcctgcaatgggtggtggtcctggtgagaaggctcgtgttattcaagcgttcctgtttgtgagtggcattaatactctgctccaaacactcgttgggacacgacttccaacagttatgaatgcctccttcgcatttgttgtcccagtgctgtcaatagccagacagtttaacacaaacgactttgaaagtaatcacgagagatttgttcacacaatgagagcaactcaaggggctctaattgttgcttcaatcctcaacatgattcttggatacagcagagcatggggggcatttgccaagaaattcagtcctgtaataatgactcctgttgtttgtgtcgttggtcttggactatttcaaattggctttcctcaggttggaaaatgtgttgagattgggttgccaatgctaattcttgcgattgttgtgcaacagtatgcgccactttacttcagacatatccatgaccgaacaaccttcttgtttgagaggtattcgttgcttctttgtatcggcattgtgtgggcctttgcagctatccttactgctgctggtgcatacaaccatgtttcgctcaagacacaacagcactgccgcactgacaagtctttccttatatcatctgcaccatggatcaaaatttcataccccttccattggggtccaccaatcttcactgcaggtcattcatttggaatgatgggtgctgtgcttgtttcatcttttgagtcaaccggtgcacactttgcaactgcacgtctagccggtgcaacaccacccccagctcatgttcttactcgaagtattggtttacagggcattgggatattcctggcaggactgtgtggtgctccagccggttcatctgtatcagtcgaaaacatcgggctacttggattaacaaaagttggaagtaggagagtgatccagatatcaactggcttcatgatattcttctccatatttgggaagtttggggcgttcttcgcatcaatcccgttgccaatcttcgcggcaatttactgcatcttgtttggtatcgtagctgctgtgggaatctcgttcagccagtttgcaaacaaaaactccatgaggaacatctacatcattggactatccttgttccttggcatctcgatccctcaatatttcgcggagtacaccgcttctgctggccgcggacctgcccgaacaaatgcaggatggttcaatgacatcatcaacacagtttttgcctccggcccaacggtggcgctgatcgtcgcgtcgcttctggacaacacgctggagccccgtgccaacgagaacgaccgggggctctcatggttcacgccatttctgcgccgccgtaaagggtactcggaccctaggaacgaggagttctacagctacccgatccgggtccatgacttggttccgcaccggtttctctgattctagaaggggtgctgctaattatcctgtgctgctgtgcaatgtaaatcccctttgttcttgttagccttttaccccctgtggcccgtagcgattggtgcggtcacaggtttcagcttagtgggatatatggtacaaggatgctaggacttccgtcgttgctgttgctggccgtttgggccaaggagttggttacatggttgacgtagagttttattgtccgggtgtaatgctgtctctggggaaaaatgaatgcaaaaggatgatagtacctcaattatcggtt

SEQ ID NO: 1093 - DNA, 5613 bp, Triticum aestivum
ccaggaagcagcaacaccgtagaaatccggactgatgaaaaatcctggtagaagatcgctgtcccatccgccaaatgtgatgggacctacagtcgctagcaccactcggggaagcagcgagcggcgcagaagaacctctcgcccgcgtcaatccaattttaatgctgcggcagccccccctccccatcctcggaatctgttgcattcaatacaactttcgaaaaacaatcatttttctaatgcgccccagctacctagatccagccaaaggctccaagccccatcagccagcactgttcggcctccattagcggcgcgcgagcgagcttctccgccctctcgcctccgctgattaccgctggtgcgattagcggagtgctcacgaagagagagaccagcagtgaaggcgaggccttcgagctcgcgatccctttttctctgctgctgcccgcaagattacaaaatcccgcgtttgtcctgttgccgctgctgccgctggcgctgctctcgggagggcggccatagaaaggagataaggagaagaagaaacggaaaaaaaaaaataaaggctggaggcttttggagctcataatttttggcctttctctgcgctccccggggagattttccggcgctttcttactttctttccgggaggtgggttgggagagaatccagcctctgaattcgtttctggtctggtccaaggcgagagagtgttcttgcttgagttggtgttgatccaatgggcgagatgaaccaccagcccggggtgccgccgccggtgggcgtgccaccgcccatggggatgcagcccatgatgaacgctccggtcggcgcgggcgccatgcaccagccctacgagcagttcaaccaactcaactactgcgtccactccaatccttcttgggttcaggtagcagggcttgcattcctccactacctagtgatgttgggctctactgtcatgcttgtgtcaattattgttcctgcaatgggtggtggtcctggtgagaaggctcgtgttattcaagcgttcctgtttgtgagtggcattaatactctgctccaaacactcgttgggacacgacttccaacagttatgaatgcctccttcgcatttgttgtcccagtgctgtcaatagccagacagtttaacacaaacgactttgaaagtaatcacgagagattcgttcacacaatgagagcaactcaaggggctctaattgttgcttcaatcctcaacatgattcttggatacagcagagcatggggggcatttgccaagaaattcagtcctgtaataatgactcctgttgtttgtgtcgttggtcttggactatttcaaattggctttcctcaggttggaaaatgtgttgagattgggttgccaatgctaattcttgcgattgttgtgcaacagtatgcgccactttacttcagacatatccatgaccgaacaaccttcttgtttgagaggtattcgttgcttctttgtatcggcattgtgtgggcctttgcagctatccttactgctgctggtgcatacaaccatgtttcgctcaagacacaacagcactgccgcactgacaagtctttccttatatcatctgcaccatggatcaaaatttcataccccttccattggggtccaccaatcttcactgcaggtcattcatttggaatgatgggtgctgtgcttgtttcatcttttgagtcaaccggtgcacactttgcaactgcacgtctagccggtgcaacaccacccccagctcatgttcttactcgaagtattggtttacagggcattgggatattcctggcaggactgtgtggtgctccagccggttcatctgtatcagtcgaaaacatcgggctacttggattaacaaaagttggaagtaggagagtgatccagatatcaactggcttcatgatattcttctccatatttgggaagtttggggcgttcttcgcatcaatcccgttgccaatcttcgcggcaatttactgcatcttgtttggtatcgtagctgctgtgggaatctcgttcagccagtttgcaaacaaaaactccatgaggaacatctacatcattggactatcgttgttccttggcatctcgatccctcaatatttcgcggagtacaccgcttctgctggccgcggacctgcccgaacaaatgcaggatggttcaatgacatcatcaacacagtttttgcctccggcccaacggtggcgctgatcgtcgcgtcgcttctggacaacacgctggagccccgtgccaacgagaacgaccgagggctctcatggttcacgccatttctgcgccgccgtaaagggtactcggaccccaggaacgaggagttctacagctacccgatccgggtccatgacttggttccgcaccggtttctctgattctagaaggggtgctgctaattatcctgtgctgctgtgcaatgtaaatcccctttgttcttgttagccttttaccccctgtggcccgtagcgattggtgcggtcacaggtttcagcttagtgggatatatggtacaaggatgctaggacttccgtcgttgctgttgttggccgtttgggccaaggagttggttacatggttgacgtagagttttattgtccgggtgtaatgctgtctctggggaaaaatggagggagtgtctatttagcatttgactgttttttaattcgagaacattcaaatttccggacaaataaacaactaacacctgtatgtccaaaaccttccacccctacaactgtatgttttgtatttgaaagaaaactgttcgggctaatctctgacccggttcacctgcacgcagctctcctattccaattgaaataggacgatccacaggtcagcaatactcctattccaattcattaaaagaagactcctactccaattgttcgctctcttcacctcttgcatgagcaaattaggaggatctttcttcatctacaaaagagacagatcaatagcaaactgtaaatttgggaaactatatgaactttgcaagctacatgtagcaattaaaatgacatgaacatggaaattacactaaaattctgacatggtttacatgtaagcgggtaaaaacagtgtaaatagaagacatatcaacaacatctgtaaatctgggaaattacataaccttcgcatgctacatgtagcaggaaattactctaaaatattgaggtagttccaatgtaaaatctagggtaattttcagaaacattcagtagcagaaactaatgacaatgcaagtaaaaacggatgacactaaaaatacccaagagttacactgaaagtgaccaagatttacagtgtaaatccccctataaattacatagtacatacacagtaattacactgcaagcacacaaggaattacacctgtaaaaactgatgagattacactaaattacagtgtaagtgagcaggaattacagtgtgaaacccaagaatccaaagcttgtaattacagtgcaagtgaccaagaattacattgtaaaacctctataaaatacaatatacatacaatgtaattacacagcaagtacccatggcttacactgtaatacccaagctttacggtgaaagtgcttacagtgcaataccctcaaagaatacagaaaaaatacacagggaattagaatgaaattatgcagggatttgcagtgatgaagctatgcggtaaaaacccaatgaattacaataaaacttcagagctacttcactataatttacagtgcatgttccgaggatacacttggaataccccaactattggaagcaaaaatacataaagtacaactgtttaagtacccaacaaaattcatctatatctaaacggtttgttgctcaatattatgttgatactggcattttttgttcaaatatgccagatgaggagcatgataataaagacagcaactgaagatgatctattgagattgtcacaggaagaactcattctaaatgtgagttacacatttgtttcagaatatgttgaaagacactataggaacattctaaatacataaataataataaaagctcacaacaaatatgccgcaggacacattttctatcaccgcgcttctacattccgatattatattcatggtaaaagcaaaattcaaataccacagagctaccaatctgagaaaagcacaactatagaaaacaaattgcccttttgcttgcaggtacactcaggagatgggcctatgaacatggacgcagatgataatttcctttcaagcattttactttctgaaatgacaaaaacacaagggccacccaaagaaatacccaaaacaaaatcaaaatagtacaagaaatggaaaacacacttgattcagatagaacttcaaaagagatttgtcaaaccctccttcatcaccagatagttccgtagacataggataagaaccatcttccgcaaagtcgttaggcacaataggttcacccacagaatctgcattctcaagagatgatactaaccaaacatccggatgagagactttctgtagcctactcattaaactaaaacatataaacagaatacatgaaggaggaaaagaaaataagtaaaatagtagaacaaatctccatacacttcattaaagaatacacatgaacagctaatgcaacgctatttactagacaaatctagaaagaacacaaaaacaatcatcaacctaaaacaggaactctgctcaatactactgcaacggagacacactagcacaagaaaagaagaaaataaaaagcaagaaaatacatgaattgtagtcctaaaagcatgctaattacactgcaaaatcagaggtaaatcaactgtgatctatctgacaaatacgttgtaagccctacaacaattacagtgttgaagcattcaaattacagtgtaaatctgcagtaaattacagtgtaagccctccaattcaaaggtaaaatccactgtaatctacctcgcaaatacctacaacaaatacaatgtcgaaccatacaaattatagtgtaaaactatggtatactacagtgtaagccatctacaactacatctaccaataaaaatgcaggcggaatagacacccaggccagcagaaataaaatcgacaggggaatccaccactagaactacaacttcgcctacctctacatctacagcagaggaaacaaatcagcaggggtgaaaacgaccacaacgaccagatgacctagaacacccgatgactaacagaacaaatcacccatctcaggcaagtagaagggaagcaaaatgacggactacaacatggccgcaacatgcacctgccacggatccaaacaagaaactcagcctagattttcatgacacaaccacaacacaagcaaaataataccggggagggcgagagacaagaacaaccgggcggcagccagggatcgaagagaaagggaagagaaatcaagatcgagcggtagaatatctcggaatcgacatgaacagaaggaattgcctcctctgctccgccactcgaactctttctctctcccctcggcattatctaaacagagccaccaaatgaaagaggaa

SEQ ID NO: 1094 - DNA, 2523 bp, Secale cereale
tctgttgcattcaatacaactttcgaaaaacaatcatttttctaatgcgccccagctacctagatccagccaaaggctccaagccccatcagccagcactgttcgcctccattagcggcgcaagagcttctccgctctctctctctcgcctctgttgattagtacttaccaccagccattagtggagtgctgcctcacacgaagagagatcagcagtgaaggcgaggccttcgagctcgcaaccccttttctctgtttgctgcccgcaagattacaaaatcctgcgtttgtcctgttgccgctgcttccgctggcgctctcgggagggcggccatagaaaggagataaggagaagaagaaacggaaaagaaaaaataataaaggctggaggcttttggtgctcataatttttggcctttctctgcgctccccgggaagattttccggcgctttctctcttctctttccgggaggtgggagagaatccagcctctgaattcgtttctggtctggtccaaggcgagagagtgttcttgagtaggtgttgatccaatgggcgagatgaatcaccagccgatgcagccgcaggtgggcgtgccaccgcccatggggatgcagcccatgatgaacgcaccggtcggcgcaggcgccatgcaccagccctacgagcagttcaatcaactcaactactgcgtccactccaatccttcctgggttcaggtggcagggcttgcattcctccactacctagtgatgttgggctccacagtcatgcttgtgtcaactattgttcctgcaatgggtggtggtcctggtgagaaggctcgtgttattcaagcgttcctgtttgtgagtggcattaatactctgctccagacactcgttgggacacgacttccaacagttatgaatgcctccttcgcatttgttgtcccagtgctttcaatagccagacagtataacacaaacgactttgaaagtaatcacgagagattcgtgcacacaatgagggcaactcaaggggctctaattgttgcttcaatcctcaacatgattcttggatacagcagagcatggggggcatttgcaaagaaattcagtcctgtaataatgactcctgttgtttgtgtcgttggtcttggactatttcaaattggctttcctcaggttggaaaatgtgttgagattgggttgccaatgctaattcttgcgattgttgtgcaacagtatgcgccacattacttcagacatttccatgagcgaacaaccttcttgtttgagaggtattcgttgcttctttgtatcggcattgtgtgggcctttgcagctatccttactgctgctggtgcatacaaccatgtttcgctcaagacacaacagcactgccgcactgacaagtctttccttatatcatcggcaccatggatcaaaatttcataccccttccattggggttcaccaatcttcactgcaggtcattcatttggaatgatgggtgctgtgcttgtttcatcttttgagtcaaccggtgcacactttgcaactgcacgtctagccggtgcaacaccacccccagctcatgttcttactcgaagtattggtttacagggcattgggatattcctggcaggactgtgtggcgctccagccggttcatctgtatcagtcgaaaacatcgggctacttggattaacaaaagttggaagtaggagagtgatccagatatcaactggcttcatgatattcttctccatatttgggaagtttggggcgttcttcgcatcaatcccgttgccaatcttcgcagcaatttactgcatcttgtttggtatcgtagctgctgtgggaatctcgttcagccagtttgcaaacaaaaactccatgaggaacatctacatcattggactatcgttgttccttggcatctcgatccctcaatatttcgcggagtacaccgcttctgctggtcgcggacctgcccgaacaaatgcaggatggttcaatgacatcatcaacacggtttttgcctctggcccaacggtggcgctgatcgtcgcgtcgcttctggacaacacgctggatccccgggcgaacgaggccgaccgggggctctcatggttcacgccatttctgcgccgccgtaaagggtactcggaccccaggaacgaggagttctacagctacccgatccgggtccatgacttggttccgcaccggtttctctgattctagaaggggtgctgctgattatgctgtgctgctgagcaatgtaaatcccctttgttcttgttagccttttatttaccccctgtggcccgtagcgattggtgtggtcacaggtttcagcttagtgggatatggtgcaaggatgctaggacttccgtcgttgctgttgttggccgtttgggccaaggagttggttacatggttgacgtagagttttattgtccggtccgggtgtaatgttgtctctggggaaaaatgaatgcaaaaggatagtacctcaattatcggttgccgagg

SEQ ID NO: 1095 - DNA, 2630 bp, Secale cereale
tccccatcctcggaatctgttgcattcaatacaactttcgaaaaacaatcatttttctaatgcgccccagctacctagatccagccaaaggactccaagccccactcagccagcactgttcgcctccattagcggcgcaagagcttctccgctctctctctctcgcctctgttgattagtactaccaccagccattagtggagtgctgcctcacacgaagagagatcagcagtgaaggcgaggccttcgagctcgcaaccccttttctctgtttgctgcccgcaagattacaaaatcctgcgtttgtcctgttgccgctgcttccgctggcgctctcgggagggcggccatagaaaggagataaggaggagaagaaacggaaaagaaaaaaaataaaggctggaggcttttggtgctcataatttttggcctttctctgcgctccccggggagattttccggcgctttctctcttctctttccgggcggtgggagagaatccagccgctgaattcgcagtttctggtctggtccaaggcgagagagtgttcttgagtaggtgttgatccaatgggcgagatgaatcaccagccgatgcagccgcaggtgggcgtgccaccgcccatggggatgcagcccatgatgaacgcaccggtcggcgcaggcgctatgcaccagccctacgagcagttcaatcaactcaactactgcgtccactccaatccttcctgggttcaggtggcagggcttgcattcctccactacctagtgatgttgggctccacagtcatgcttgtgtcaactattgttcctgcaatgggtggtggtcctggtgagaaggctcgtgttattcaagcgttcctgtttgtgagtggcattaatactctgctccagacactcgttgggacacgacttccaacagttatgaatgcctccttcgcatttgttgtcccagtgctttcaatagccagacagtataacacaaacgactttgaaagtaatcacgagagattcgtgcacacaatgagggcaactcaaggggctctaattgttgcttcaatcctcaacatgattcttggatacagcagagcatggggggcatttgcaaagaaattcagtcctgtaataatgactcctgttgtttgtgtcgttggtcttggactatttcaaattggctttcctcaggttggaaaatgtgttgagattgggttgccaatgctaattcttgcgattgttgtgcaacagtatgcgccacattacttcagacatttccatgagcgaacaaccttcttgtttgagaggtattcgttgcttctttgtatcggcattgtgtgggcctttgcagctatccttactgctgctggtgcatacaaccatgtttcgctcaagacacaacagcactgccgcactgacaagtctttccttatatcatcggcaccatggatcaaaatttcataccccttccattggggttcaccaatcttcactgcaggtcattcatttggaatgatgggtgctgtgcttgtttcatcttttgagtcaaccggtgcacactttgcaactgcacgtctagccggtgcaacaccacccccagctcatgttcttactcgaagtattggtttacagggcattgggatattcctggcaggactgtgtggcgctccagccggttcatctgtatcagtcgaaaacatcgggctacttggattaacaaaagttggaagtaggagagtgatccagatatcaactggcttcatgatattcttctccatatttgggaagtttggggcgttcttcgcatcaatcccgttgccaatcttcgcagcaatttactgcatcttgtttggtatcgtagctgctgtgggaatctcgttcagccagtttgcaaacaaaaactccatgaggaacatctacatcattggactatcgttgttccttggcatctcgatccctcaatatttcgcggagtacaccgcttctgctggtcgcggacctgcccgaacaaatgcaggatggttcaatgacatcatcaacacggtttttgcctctggcccaacggtggcgctgatcgtcgcgtcgcttctggacaacacgctggatccccgggcaaacgaggccgaccgggggctctcatggttcacgccatttctgcgccgccgtaaagggtactcggaccccaggaacgaggagttctacagctacccgatccgggtccatgacttggttccgcaccggtttctctgattctagaaggggtgctgctgattatgctgtgctgctgagcaatgtaaatcccctttgttcttgttagccttttatttaccgcctgtggcccgtagcgattggtgtggtcagaggtttcagcttagtgggatatggtgcaaggatgctaggacttccgtcgttgctgttgttggccgtttgggccaaggagttggttacatggttgacgtagagttttattgtccggtccgggtgtaatgttgtctctggggaaaaatgaatgcaaaaggatagtacctcaattatcggttaccgaggcagtgatgtgttgatgaaccttcaatcccgtgcattggtgtctgaaatctttgcgagtaaactggcctgattttcttccgcaaaaagtc

SEQ ID NO: 1096 - DNA, 2507 bp, Secale cereale
ttcgcctccattagcggcgcaagagcttctccgctctctctctctcgcctctgttgattagtactaccaccagccattagtggagtgctgcctcacgcgaagagagatcagcagtgaaggcgaggccttcgagctcgcaaccccttttctctgtttgctgcccgcaagattacaaaatcctgcgtttgtcctgttgccgctgcttccgctggcgctctcgggagggcggccatagaaaggagataaggagaagaagaaacggaaaagaaaaaataataaaggctggaggcttttggtgctcataatttttggcctttctctgcgctccccgggaagattttccggcgctttctctcttctctttccgggaggtgggagagaatccagcctctgaattcgtttctggtctggtccaaggcgagagagtgttcttgagctggtgttgatccaatgggcgagatgaatcaccagccgatgcagccgcaggtgggcgtgccaccgcccatggggatgcagcccatgatgaacgcaccggtcggcgcaggtgccatgcaccagccctacgagcagttcaatcaactcaactactgcgtccactccaatccttcctgggttcaggtggcagggcttgcattcctccactacctagtgatgttgggctccacagtcatgcttgtgtcaactattgttcctgcaatgggtggtggtcctggtgagaaggctcgtgttattcaagcgttcctgtttgtgagtggcattaatactctgctccagacactcgttgggacacgacttccaacagttatgaatgcctccttcgcatttgttgtcccagtgctttcaatagccagacagtataacacaaacgactttgaaagtaatcacgagagattcgtgcacacaatgagggcaactcaaggggctctaattgttgcttcaatcctcaacatgattcttggatacagcagagcatggggggcatttgccaagaaattcagtcctgtaataatgactcctgttgtttgtgtcgttggtcttggactatttcaaattggctttcctcaggttggaaaatgtgttgagattgggttgccaatgctaattcttgcgattgttgtgcaacagtatgcgccacattacttcagacatttccatgagcgaacaaccttcttgtttgagaggtattcgttgcttctttgtatcggcattgtgtgggcctttgcagctatccttactgctgctggtgcatacaaccatgtttcgctcaagacacaacagcactgccgcactgacaagtctttccttatatcatcggcaccatggatcaaaatttcataccccttccattggggttcaccaatcttcactgcaggtcattcatttggaatgatgggtgctgtgcttgtttcatcttttgagtcaaccggtgcacactttgcaactgcacgtctagccggtgcaacaccacccccagctcatgttcttactcgaagtattggtttacagggcattgggatattcctggcaggactgtgtggcgctccagccggttcatctgtatcagtcgaaaacatcgggctacttggattaacaaaagttggaagtaggagagtgatccagatatcaactggcttcatgatattcttctccatatttgggaagtttggggcgttcttcgcatcaatcccgttgccaatcttcgcagcaatttactgcatcttgtttggtatcgtagctgctgtgggaatctcgttcagccagtttgcaaacaaaaactccatgaggaacatctacatcattggactatcgttgttccttggcatctcgatccctcaatatttcgcggagtacaccgcttctgctggtcgcggacctgcccgaacaaatgcaggatggttcaatgacatcatcaacacggtttttgcctctggcccaacggtggcgctgatcgtcgcgtcgcttctggacaacacgctggatccccgggcaaacgaggccgaccgcgggctctcatggttcacgccatttctgcgccgccgtaaagggtactcggaccccaggaacgaggagttctacagctacccgatccgggtccatgacttggttccgcaccggtttctctgattctagaaggggtgctgctgattatgctgtgctgctgagcaatgtaaatcccctttgttcttgttagccttttatttaccccctgtggcccgtagcgattggtgtggtcacaggtttcagcttagtgggatatggtgcaaggatgctaggacttccgtcgttgctgttgttggccgtttgggccaaggagttggttacatggttgacgtagagttttattgtccggtccgggtgtaatgttgtctctggggaaaaatgaatgcaaaaggatagtacctcaattatcggttaccgaggcagtgatgtgttgatcgaaccttcagtcccgtgctattggtgtctgaaatcgtttgcgaagtaactggcctgtattttctccgaac

SEQ ID NO: 1097 - DNA, 2389 bp, Leymus cinereus x Leymus triticoides
  misc_feature (1094)..(1094): n is a, c, g, or t
  misc_feature (2328)..(2328): n is a, c, g, or t
cggccatcgttcccacgagcttctccgccctctcgcctctgttgattagtaccagcgattagtggagtgctcacgaagagatcagtgaaggcgaagtcttcgagctcgcaatcccttttttctgttgctgccgcaagattacaaaatcctgcgtttgtcctgttgccactgcttctctcgggagggcggccatagaaaggagataaggagaagaaacggaaaaaataaaggctggacgcttttagtgctcataatttttggcctttctctgcgttccccggggagattttccggtgctttctttctttctgggaggcgggagaggatccagcttctgaattcgtttctggtccggtccaaagcgagagagtgttcttgagttggtgttgatccaatgggcgagatgaaccaccagccggggccgccgccggtgggcgtgccaccgccgatggggatgcagcccatgatgaacgcaccggtcggcgcgggcgccatgcaccagccctacgagcagttcaaccaactcaactactgcgtccactccaatccttcttgggttcaggtggcaggacttgcattcctccactacctagtgatgttgggctctactgtcatgcttgtgtcaactattgttcctgcaatgggtggtggtcctggtgagaaggctcgtgttattcaagcgttcctgtttgttagtggcattaatactctgctccaaacactcgttgggacacgacttccaacagttatgaatgcctccttcgcatttgttgtcccagtgctgtcaatagccagacagtttaacccaaatgacttcgaaagtaatcacgagagattcgttcacacaatgagagcaactcaaggggctctaattgttgcttcaatcctcaacatgattcttggatacagcagagcatggggggcatatgccaagaaattcagtcctgtaataatgactcctgttgtttgtgtcgttggacttggactatttcaaattggctttcctcaggttggaaaatgtgttgagattgggttgccaatgctaattcttgcgattgttgtgcaacagtatgcgccacattacttcagacatntccatgagcgaacaaccttcttgtttgagaggtattcgttgcttctttgtatcggcattgtgtgggcctttgcagctatccttactgctgctggtgcatacaaccatgtttcactcaagacacaacagcactgccgcactgacaagtctttccttatatcatctgcaccatggatcaaaatttcataccccttccattggggttcaccaatcttcactgcaggtcattcatttggaatgatgggtgctgtgcttgtttcatcttttgagtcaactggtgcacactttgcaactgcacgtctagctggtgcaacaccacccccagctcatgttcttactcgaagtattggtttacagggcattgggatattcctggcaggactgtgtggtgctccagccggttcatctgtatcagtcgaaaacattgggctacttggattaacaaaagttggaagcaggagagtgatccagatatcaactggctttatgatattcttctccatatttgggaagtttggggcgttctttgcgtcaatcccgttgccaatcttcgcagcaatttactgcatcttgtttggtatcgtagctgctgtgggaatctcgttcagccaatttgcaaacaaaaactccatgaggaacatctacatcattggactatccttgttccttggcatctcgatccctcagtattttgccgagtacaccgcttctgctggccgtggacctgcccgaacaaatgcaggatggttcaatgacatcataaacacagtttttggctctggcccaacggtggcgctgatggtcgcgtcgcttctggacaacacgctggagccccgggccaacgagtccgaccgagggctctcatggttcacaccatttctgcgccgtcgtaaagggtactcagaccctagaaacgaggagttctacagctacccgatccgggtccatgacttggttccaagccggtttctctgattctagatagaaggggtgctgttaattatcctgtgctggtgtgcaatgtaaatccccttggttcttgttagccttttacccctgtggcccgtagcgattggtgcggtcaccggtttcagcttagtgggatatggtacaaggggacttccgtcgttgctgttgttggccgtttgggccaaggagttggttacatggttgacgtagagttttattgtccggtccgggtgtatgttgtctctgggaaaaaatgaatgcaaaangatactagtacctcaattatcagttatcgaggcagcgatgttgatgaaccttcaaaaaaaa

SEQ ID NO: 1098 - DNA, 2347 bp, Brachypodium distachyon
gtggccataataaaggttgtcaattctccaagcttgcacaagccttttctctcctccttctttgccgcaagattacaaaaccttgtgtttgtcctgttgccgccgctgccgctggcgctcctcgcgactccagagaggccgtagaaagcagataagtagaaacggaaagagaaagaaataaataaagggtcaaggcttttggtatccggagtaccgattgattatcctttctctgcgctcccccccctggaaaaaatctttgcgctttcctggaggtgtgcgggacgagaatccagggcttctgaaatcccagtctggtccaaggagacagttagatacagagaggaagttcttgagtcttcgttgctgaaatgggtgagatgaaccagccgccgccaccgcccgtgggcgtgccgccgccgatggggatgcagcccatgatgaacccgcctgtcggcgccggcgccatgcacccgccgcacgagcagttccaccatcttgcttactgtgtccactcgaatccttcctgggttcaggttgccgcacttgcattcctccactatttagtgatgctgggctcaaccgtcatgctggcatcaattattgttccagcaatgggtggctctcctggggacaaagctcgtgtgattcagtcgttcctgtttatgggtggtatcaacacactgctccagacactcattggaacacggcttccaaccgtcatgaacgcgtccttcgcgtttgttgtccctgtgctgtctatagccagagaagtaggtcaacaagatttcccaagtaatcaacagagatttgttcacacaataagaacagctcaaggggcgctaattgttgcttctgtcctcaacatgattcttggatacagcacagtatggggggcatatgcgaaaaaattcagtcctgtaattatgacccctgttgtttgtgtggtcggtcttggactatttcaacttggctttccccaggttggaaaatgtgtggagatcgggttgccaatgctaattcttgcagtcgttgtgcaacagtatgtgccacattacttcaggcatttccatgagcgaacaacattcttgttcgagaggtattcgttgcttctttgtatcaccattgtgtgggcctttgcagctatcattactgctgccggtgcatacaaccatgtttcactcaagacacagcagcactgccgcactgacaagtcttaccttatgtcatctgcaccatggatcaaaattccattaccctttcaatggggcacgcctatcttcactccaggtcattcattcggaatgatgggtgctgtacttgtttcagcctttgagtcaactggtgcacacttcgcaactgcacgtctagctggtgctacaccacccccagctcatgttcttagtcgaagtattggtttgcagggcattgggatgttcctggaaggaatctttgccgctccgtgtggttcatctgtatcagtggaaaacattgggcttcttggattaaccaaagttggaagtaggagagtgatccagatatcaactggatttatgatattcttctccatatttggaaagtttggtgcgttctttgcatcaattccattgccaatctttgcagcaatttactgcatcttatttggtattgtagctgccgtgggaatctcttacggacaatttgtaaacaaaaactccatgaggaacatctacataattggactatccttgttccttggcatctcgatccctcagtacttctctgaatataccgcatctgctggcagcggacctgcccgaacaaatgcaggatggttcaatgacatcataaacacggtgtttgcttctggcccaacggtggcgctgatggttgcatctcttctggataacacactggaggtcaggggccacgagtccgaccgagggctctcatggttcatgccattcctgcggcgtcggaaagggtactcggatcctagaaacgaggagttctacaagtacccgatcagggtgcatagtttgatcccgagccgctttcactgattctggagggggctttgctgttaccttgtgccgctgagcatgtaaatcctttgttcttgttagccttactcctgtgatctttagtaattggcgctgtcacaggttcgacttagcgggatatggtacaagaaagtttaggacttctgttttacttttttttttcctgccgtttgggttaagcatttgttggttacatgacatcgtgatgtagagtcctatatctgggtgtatgttcttgggaaaaattgctaaatgacagtaccttgttaattaccgggccagcgatgtttatgaattttctggca

SEQ ID NO: 1099 - DNA, 2654 bp, Brachypodium distachyon
gttttaatgctgctgctctgctgctgagacacccttccccatcctcggaatctgtttctccattcaatacgactctcaaaaaccgatgatttttcaatgccatcctccctccccatctacctagatccatccaaacctccaagctccagtcggtgcctcagtggccacacacacccatcgttttcacaagttctttctatccctgtctctccccaagtcagtgtgaatgatttagtggagtgctgaggaagaaattagcgtggccataataaaggttgtcaattctccaagcttgcacaagccttttctctcctccttctttgccgcaagattacaaaaccttgtgtttgtcctgttgccgccgctgccgctggcgctcctcgcgactccagagaggccgtagaaagcagataagtagaaacggaaagagaaagaaataaataaagggtcaaggcttttggtatccggagtaccgattgattatcctttctctgcgctcccccccctggaaaaaatctttgcgctttcctggaggtgtgcgggacgagaatccagggcttctgaaatcccagtctggtccaaggagacagttagatacagagaggaagttcttgagtcttcgttgctgaaatgggtgagatgaaccagccgccgccaccgcccgtgggcgtgccgccgccgatggggatgcagcccatgatgaacccgcctgtcggcgccggcgccatgcacccgccgcacgagcagttccaccatcttgcttactgtgtccactcgaatccttcctgggttcaggttgccgcacttgcattcctccactatttagtgatgctgggctcaaccgtcatgctggcatcaattattgttccagcaatgggtggctctcctggggacaaagctcgtgtgattcagtcgttcctgtttatgggtggtatcaacacactgctccagacactcattggaacacggcttccaaccgtcatgaacgcgtccttcgcgtttgttgtccctgtgctgtctatagccagagaagtaggtcaacaagatttcccaagtaatcaacagagatttgttcacacaataagaacagctcaaggggcgctaattgttgcttctgtcctcaacatgattcttggatacagcacagtatggggggcatatgcgaaaaaattcagtcctgtaattatgacccctgttgtttgtgtggtcggtcttggactatttcaacttggctttccccaggttggaaaatgtgtggagatcgggttgccaatgctaattcttgcagtcgttgtgcaacagtatgtgccacattacttcaggcatttccatgagcgaacaacattcttgttcgagaggtattcgttgcttctttgtatcaccattgtgtgggcctttgcagctatcattactgctgccggtgcatacaaccatgtttcactcaagacacagcagcactgccgcactgacaagtcttaccttatgtcatctgcaccatggatcaaaattccattaccctttcaatggggcacgcctatcttcactccaggtcattcattcggaatgatgggtgctgtacttgtttcagcctttgagtcaactggtgcacacttcgcaactgcacgtctagctggtgctacaccacccccagctcatgttcttagtcgaagtattggtttgcagggcattgggatgttcctggaaggaatctttgccgctccgtgtggttcatctgtatcagtggaaaacattgggcttcttggattaaccaaagttggaagtaggagagtgatccagatatcaactggatttatgatattcttctccatatttggaaagtttggtgcgttctttgcatcaattccattgccaatctttgcagcaatttactgcatcttatttggtattgtagctgccgtgggaatctcttacggacaatttgtaaacaaaaactccatgaggaacatctacataattggactatccttgttccttggcatctcgatccctcagtacttctctgaatataccgcatctgctggcagcggacctgcccgaacaaatgcaggatggttcaatgacatcataaacacggtgtttgcttctggcccaacggtggcgctgatggttgcatctcttctggataacacactggaggtcaggggccacgagtccgaccgagggctctcatggttcatgccattcctgcggcgtcggaaagggtactcggatcctagaaacgaggagttctacaagtacccgatcagggtgcatagtttgatcccgagccgctttcactgattctggagggggctttgctgttaccttgtgccgctgagcatgtaaatcctttgttcttgttagccttactcctgtgatctttagtaattggcgctgtcacaggttcgacttagcgggatatggtacaagaaagtttaggacttctgttttacttttttttttcctgccgtttgggttaagcatttgttggttacatgacatcgtgatgtagagtcctatatctgggtgtatgttcttgggaaaaattgctaaatgacagtaccttgttaattaccgggccagcgatgtttatgaattttctggcatgcattggtttacgatatcgctgtgagtaacgtttgcctgcatctcaa

SEQ ID NO: 1100 - DNA, 2427 bp, Setaria italica
aggaagaaacacggctgattaattacaaagtagtcaaaaaaggttgaggtggaggaggaggagattttcgaatttgcgaatcttttcctgagctccagcaaggctacaaatcccgcgtttgtcctgttgcgcgcgccgccgctggatatcgagagaggagggggccataggaaggagataagaataggcagaaaggtggagaagaagcgaagggggagaaaaggggaatagaaaggcgaggccttttactgattgcttcccgcacagctttcctcccctcgctcaaaaatctccctggattctctggaaagttcttgcttttcgagaggcgggagcgagggaccagcggcccgagcttctgaattctctggaggaggagtgggcgttcccgtgacgttgctgattcaatgggggagacgaaccagccgccgccgccgccggtggccgcgccgccgcccatgatgccgatgcagcccatgatggcaccggccgtcggcaccggcgccatccacccgccccatgagcagttccaccatctcgcctactgcgtccactccaatccgtcttgggttcaggtggcagcacttgcattccttcactatcttgtgatgttgggctctaccgttatgctcgcatcaactattgttcctgcaatgggtggtaacgctggggataaggctcgagttattcaatcgttcctctttatgagtggcatcaatacgctgctgcaaacacttgttggaacgagacttccaacaattatgaatgcttcctttgcatttgttgtcccagtgctatcaatagccagagagatggatccaaatgactttacaaataatcacctgagatttgtccacacaatgagaacaacacaaggagctctgattgttgcttccatcctcaacatgattcttgggttcagcacagtatggggggcatatgccaagaaattcagtcctgtaataatgacccctgttgtttgtgtcgttggtcttggactatttgaacttggttttccccaggtgggtaaatgtgtggagattgggctgccaatgctaattcttgcggtgattgtgcagcagtatgtgccacattacttcagtcatatccatgagcggatcaccttcttgtttgagaggtattctttgcttctttgtattggcattgtgtgggcctttgcagctatccttactgctgcgggtgcctacaaccatgtttcacttaagacgcagctgcactgccgcactgataagtctttcctgatgtcatctgcaccatggattaaaattccataccctttccaatggggtacgccaatcttcaccgctggtcattcatttgggatgatgggtgctgtacttgttgcagcctttgagtcaactggagcacactttgcaactgcacgtctagcaggtgctacaccacctccaggtcatgtccttagtcgaagtgttggcttgcagggtattgggatgttcctggaggggatctttggtgctccagcaggttcatccgtatcagtgggaaacattggtctccttgggctgacgaaagttggaagtaggagagtgatccagatatcaactggatttatgatatttttctccatatttgggaagtttggggccttctttgcatcaattccactgccaatctttgcagcaatttactgcatcttgtttggcatcgtagctgctgtgggagtctcattcatgcagtttgccaacaagaactcgatgaggaacatctacatcattggactctcgttgttccttggcatctcagtccctcagtacttcaatgaatatacttcttctgctggccgtggacctgcccgaacaaatgctggatggttcaacgatattttaaacaccgtgtttgcttctggcccaacggtggcgctgattgttgcatctgttctggacaacacattggaggctaggggcttcgacggcgaccggggtctcccatggttcatgccattcctgcgccgacacaaaggttactcggacccaagaaatgaggagttctacagtttcccaatcagggttcacgacttaatcccgagccgattcctctgactttctcatgagcgctgctgcgcatgtaaatctctttgttcttggtagtcttactcctgtgacctgtagcgtgattggttctctacattctagtgggatatgggtacaagaatgtttaggacatttgctttatttacccccttctgggctaagaaatggttacatgacaatgtagagcggtatgccctggcgtatggttttgggaaggattacagaaaaatagcaccttacttgttgatgacttccagtaaaatgcattggtttatttttactcaatgtgtggctgttgatctactgtttgagcgaaaaaaggtagtagcagaaatttcacaagatttcttcatga

SEQ ID NO: 1101 - DNA, 2887 bp, Oryza sativa
caggaaaggagatggtgcagaagaacccacaccaccatgctcacagatgcacagacacagggctcctccccagttttaatgctaggacactctccccatccttggaatctgttgcattcaatacagctctcaaaaaactaaaagaaaaaagaaaacaagatttaatgttgtcctagctagatccatccaaggctccaaaaacactgtttggctcctcccagtagctgaagtgaactgaactcctctcattttcaagagtgcattagtactcactcccccccctcacatgtgttgtgttttgcttgcttgtgtgattagtggagtaatcaagaagaaatagtggggaaagataagtgtgtgtgggtgtggcaataaaggtgaagtcttcaagtttgcaatcttctccctttgctccccacaagattacaaatcttgtgtttgtcttgttgccactgccgctggtgatagactctaccatactagagaaagccatagaaaggagataagaagaaaccaagaaaagggagaaacaaaagttgaagaagactttctgctgatatttttgcacatatatataattttttctcctccatctgcactctctggaaagaagaagaagaagaagcagaagaagcttggagcttgagctttctgaatttcagtcggtgtaactaatgggggagatgaaccagccgccgccgccgccggtggccgtgccgccgccgatggtgatgcagccaatcatgcatccgcccgtcggcaccggcgccgtcttcccgccgcacgagcagttccaccatctcgcctactgcgtccactccaacccttcctgggttcaggtggccgcacttgcattcctccactatcttgtgatgctgggttctactgtcatgcttgcatcaactattgttcctgcaatgggtggtaccccaggggataaggctcgtgttattcaatccttcctatttatgagtggcatcaatactctcctccaaacacttgttggaacgcggctccctacagttatgaatgcttcctttgcatttgtcgtcccagtactgtcaatagccaaagactttgaacaaaataactatgcgagcagtcaccagagatttactcacacaatgagagcaactcaaggggctctgattgttgcttctatcctcaacatgattcttgggttcagcacaatttggggggcattcgccaggaaatttagtcctgtaataatgacccctgttgtttgcgttgttggtcttgggctatttgcacttggctttccccaggttggaaagtgtgtggagatcgggctaccaatgctaatccttgcagttgttgtgcaacagtatgtgccatattacttccatcattaccatgagcgaatcaccttcttgtttgagaggtattcgttgcttctttgtattgggattgtgtgggcctttgcagctatccttactgctgctggtgcatacaaccatgtttcactcaagacccagcagcactgccgcactgacaagtcctatctcatatcatcggcaccatggatcaaaatcccataccccttccaatggggtacaccaatcttcactgcaggtcattcatttggaatgatgggtgctgtacttgtttctgcttttgagtccactggtgcacactttgcaactgcacgtctagctggtgcgacaccacctccagctagtgtccttagtaggagtgttggtttgcagggcattggaatgttcctagaaggtatctttggcgctccagctggttcatctgtatcagttgaaaacattgggcttcttggactaacaaaagttggaagcaggagagtgatccagatatcaactggatttatgattttcttctccatatttgggaagtttggtgctttctttgcatctattccattgccaatcttcgcagcaattttctgtatcttatttggtattgttgctgcggtgggagtctcgtacatgcaatttgtaaacaaaaattcgatgaggaacatatacatcattggactttcgctgttcctaggcatctcggttcctcaatacttccatgagtatactgcttctgctagcactggacctgcccgaacaaatgctggatggttcaatgacatcataaacacagtcttcgcctctggcccgacagtgtcactgattgtcgcatcgatcctggacaacacactggagtttagaggctacgaaaacgaccgggggcttccatggttcatgccgttcctgcaccgtcggaaaggttactcagatcctagaaacgacgagttctacagcttcccgatcagggtgcatgacgtcatcccaagccgattcctctgacgggcgagggtagcgcccgttacctgcgcttccgcgcatgtaaatctctttgttcttgttagcccttccttactcctgtgacatgtagcaattggcaccgccaagattaaaaagtctcaacttagtggggatatggtacaaatggttaggacttttggttttcttttctttttcctcccctttgggccaaccatttggttaattacatgatggtgtagagttggttaaatgattttgggatggatctttaaagaatatcagccacctcaatttgttgattgctcagccagtgatgtagatgtgcttccaggacatgcattgatttcgtcataactctgtaatcacaccatcttttcactgcatttgattgagaaaacttcagaatcagacctgatgcacattgaactcaaagagtctggtctttggatgaccgcatataatcaatcaggcagtaaattccagcatgatgccactgccatctccttcaccctataaaaagagcaggtgaagtatcagcagcttgtttttgttttccttgcctg

SEQ ID NO: 1102 - DNA, 2740 bp, Oryza sativa
cccagttttaatgctaggacactctccccatccttggaatctgttgcattcaatacagctctcaaaaaactaaaagaaaaaagaaaacaagatttaatgttgtcctagctagatccatccaaggctccaaaaacactgtttggctcctcccagtagctgaagtgaactgaactcctctcattttcaagagtgcattagtactcactcccccccctcacatgtgttgtgttttgcttgcttgtgtgattagtggagtaatcaagaagaaatagtggggaaagataagtgtgtgtgggtgtggcaataaaggtgaagtcttcaagtttgcaatcttctccctttgctccccacaagattacaaatcttgtgtttgtcttgttgccactgccgctggtgatagactctaccatactagagaaagccatagaaaggagataagaagaaaccaagaaaagggagaaacaaaagttgaagaagactttctgctgatatttttgcacatatatataattttttctcctccatctgcactctctggaaagaagaagaagaagaagcagaagaagcttggagcttgagctttctgaatttcagtcggtgtaactaatgggggagatgaaccagccgccgccgccgccggtggccgtgccgccgccgatggtgatgcagccaatcatgcatccgcccgtcggcaccggcgccgtcttcccgccgcacgagcagttccaccatctcgcctactgcgtccactccaacccttcctgggttcaggtggccgcacttgcattcctccactatcttgtgatgctgggttctactgtcatgcttgcatcaactattgttcctgcaatgggtggtaccccaggggataaggctcgtgttattcaatccttcctatttatgagtggcatcaatactctcctccaaacacttgttggaacgcggctccctacagttatgaatgcttcctttgcatttgtcgtcccagtactgtcaatagccaaagactttgaacaaaataactatgcgagcagtcaccagagatttactcacacaatgagagcaactcaaggggctctgattgttgcttctatcctcaacatgattcttgggttcagcacaatttggggggcattcgccaggaaatttagtcctgtaataatgacccctgttgtttgcgttgttggtcttgggctatttgcacttggctttccccaggttggaaagtgtgtggagatcgggctaccaatgctaatccttgcagttgttgtgcaacagtatgtgccatattacttccatcattaccatgagcgaatcaccttcttgtttgagaggtattcgttgcttctttgtattgggattgtgtgggcctttgcagctatccttactgctgctggtgcatacaaccatgtttcactcaagacccagcagcactgccgcactgacaagtcctatctcatatcatcggcaccatggatcaaaatcccataccccttccaatggggtacaccaatcttcactgcaggtcattcatttggaatgatgggtgctgtacttgtttctgcttttgagtccactggtgcacactttgcaactgcacgtctagctggtgcgacaccacctccagctagtgtccttagtaggagtgttggtttgcagggcattggaatgttcctagaaggtatctttggcgctccagctggttcatctgtatcagttgaaaacattgggcttcttggactaacaaaagttggaagcaggagagtgatccagatatcaactggatttatgattttcttctccatatttgggaagtttggtgctttctttgcatctattccattgccaatcttcgcagcaattttctgtatcttatttggtattgttgctgcggtgggagtctcgtacatgcaatttgtaaacaaaaattcgatgaggaacatatacatcattggactttcgctgttcctaggcatctcggttcctcaatacttccatgagtatactgcttctgctagcactggacctgcccgaacaaatgctggatggttcaatgacatcataaacacagtcttcgcctctggcccgacagtgtcactgattgtcgcatcgatcctggacaacacactggagtttagaggctacgaaaacgaccgggggcttccatggttcatgccgttcctgcaccgtcggaaaggttactcagatcctagaaacgacgagttctacagcttcccgatcagggtgcatgacgtcatcccaagccgattcctctgacgggcgagggtagcgcccgttacctgcgcttccgcgcatgtaaatctctttgttcttgttagcccttccttactcctgtgacatgtagcaattggcaccgccaagattaaaaagtctcaacttagtggggatatggtacaaatggttaggacttttggttttcttttctttttcctcccctttgggccaaccatttggttaattacatgatggtgtagagttggttaaatgattttgggatggatctttaaagaatatcagccacctcaatttgttgattgctcagccagtgatgtagatgtgcttccaggacatgcattgatttcgtcataactctgtaatcacaccatcttttcactgcatttgattgagaaaacttcagaatcagacctgatgcacattgaactcaaagagtctggtctttggatgaccgcatataatcaatcaggcagtaaattccagc

SEQ ID NO: 1103 - DNA, 2091 bp, Pennisetum glaucum
tcggaggaaggaggagttgggcgttcgcgtgacgttgctgatccaatgggggagacggaccagccgccgccgccggtggccgcgccgccgcccatgatgccgatgcagcccatgatggcgccgcccgtcggcaccggcgccatccacccgccccacgagcagttccaccatctcgcctactgcgtccactccaatccgtcttgggttcaggtggcagcacttgcattccttcactatcttgtgatgttgggttctaccgttatgctagcatcaactattgttcctgcaatgggtggtaccgctggggataaggctcgagttattcaatcgttcctctttatgagtggcatcaatacactgctgcaaacacttgttggaacgagacttccaacaattatgaatgcttcctttgcatttgttgtcccagtgctatcaatagccagggagatgaatccaaatgactttacaaataatcaccagagatttgtgcacacaatgagaacagtgcaaggagctctgattgttgcttccatcctcaacatgattcttgggttcagcacagtatggggggcatatgccaagaaattcagtcctgtaataatgacccctgttgtttgtgtcgttggtcttggactatttgaaattggttttccccaggtgggtaaatgtgtagagattgggctgccaatgctaattcttgcggtgattgtgcagcagtatgtgccacattatttcagtcatatccatgagcggatcaccttcttgtttgagagatattctttgcttctttgtattggcattgtgtgggcctttgcagctgttcttactgctgcgggtgcatacaaccatgtttcacttaagacacagctacactgccgcactgataggtctttcctgatgtcatctgcaccatggattaaaattccataccctttccaatggggtactccaatctttaccgctggtcattcatttgggatgatgggtgctgtacttgttgcagcctttgagtcaactggcgcacactttgcaactgcacgtctagctggtgctacaccacctccaggtcatgtccttagtcgaagtgttggcttgcagggtattgggatgttcctggaggggatcattggtgctccagctggttcatctgtatcagttgaaaacattggtctccttgggctgacaaaagttgggagtaggagagtgatccagatatcaactggatttatgatatttttctccatatttgggaagtttggggccttctttgcatcaattccactgccaatctttgcagcaatttactgtatcttgtttggcattgtagctgccgtgggagtctcattcatgcagtttgccaataagaactcgatgaggaacatctacatcattggactctcgttgttccttggcatctcagtccctcaatacttcaatgaatacacatcttctgctggccgtggacctgcccgaacaaatgctggatggttcaacgatattataaacaccgtgtttgcttctggcccaacagtggcgctgattgtcgcatccattctggacaacacattggaggctaggggctacgaaggcgaccggggtctcccatggttcatgccgttcctgcgccggcacaaaggttactcggaccccagaaacgaggagttctacagcttcccaatcagggtccacgacttcgtcccgagccgattcctctgacttgctcatgagcgcccctgcgcatgtaaatctctttgctctttcttggtaggtcttactcctgtgacctgtagcgtgattggttctctacattctagtgggagatgggtacaagaatgtttagggcatttgcttttatttgccccccgttctgggctgagaaatggttacatgacaatgtagaggagctgtatgcccccggcgtatggttttgggatggattacagaagaatagcaccttacttgtcgatgacttccagcaaaatgcaccattggttgatttttactaacaaaaaaaaaaaaaaaaaaaaaaaacaaaaaaaaaaaacaaaaaaaaaaaaaaacaaaaaaaaaaaagtaaaaaagtaaagtaag

SEQ ID NO: 1104 - DNA, 2203 bp, Panicum virgatum
gagagagagagagagagagagagagggccgccgtagggaggagataagaataagcagaaaggcgaagaagcacaagggaagaaaaaggggaatagaaaggcgaggccttttggggaatagaaaggcgaggccagctttcccctcggctcaaaatctctctggattctctggaaagttcttgcttttcgagaccagcggcctgagcttctgaattcagtctggtcggagttggtcgttcgcgtgacgttgctgatccaatgggggagacgaaccagccgccgccgccgccggtggccgctccgccgtccatgatgccgatgcccatgatggcgccggccgtcggcgccggcgccatccacccacctcacgagcagttccaccatctcgcctactgcgtccactccaatccgtcttgggtccaggtggcagcactggcattccttcactatcttgtgatgttgggctctactgttatgcttgcatcaattattgttcctgcaatgggcggtaacgctggggataaggctcgagttattcaatcattcctatttatgagtggtatcaatacaatgctgcaaacacttattggaacgagacttccaacaattatgaatgcctcctttgcatttgttgtccccgtgctgtcaattgccagagacatagattcaaatgacttcacaaataatcaccagagatttctccacacgatgagaactacgcaaggagctctgattgttgcttccatcctcaacatgattcttgggttcagcacaatatggggggcatatgctaagaaattcagtcctgtaataatgacccctgttgtttgtgttgttggtcttggactatttgaacttggttttccccaggttggtaaatgtgtggaaattgggttgccaatgctaattcttgcggtgatcgtgcagcagtatgtgccacgttacttcagtcatatccatgagcggatcacatacttgtttgagaggtattcgttgcttctttgtattggcattgtgtgggcctttgcagctatccttactgctgcgggtgcatacaatcatgtttcacctaagacgcagcagcattgccgtactgataagtctttcctgatgtcatcggcaccgtggattaaaattccataccctttccaatggggtacaccaatcttcactgctggtcattcatttgggatgatgggtgctgtacttgttggagcctttgagtcaactggagcacactttgcaactgcacgtctagcgggtgctacaccacctccaggtcatgtccttagtcgaagtgttggcttgcagggtattgggatgttcctggaggggatctttggtgctccagcaggttcatctgtatcagttgaaaacattggcctccttgggctgaccaaaatcggaagtaggagagtgatccagatatcaactggatttatgatatttttctccatatttgggaagtttggggccttctttgcatcaattccactgccaatcttcgcagcaatttactgcatcttgtttggcatcgtagctgctgtgggagtctcattcatgcagtttgccaacaagaactcgatgaggaacatctacatcattggactctcgttgttccttggtatctcagtccctcaatacttcaatgaatatacttcttctgctggccgtggacctgcccgaacaaatgctggatggttcaatgacattataaacaccgtgtttgcttctggcccaacggtggcgctgattgttgcctctgttctggataacacattggaggccaggggcaacgactctgaccgagggctctcatggttcacgccattcctgcgccgtcacaaaggttactcggacccaagaaacgatgagttctacagtttcccaatcagggttcacgacttcatcccgagtcggttcctctgactttctcatgagcgctgttactgtgcatgtaaatctctttgttcttggtagtcttactcctatgacctgtagtgattggttcttacattctagtgggatatgggtacaagaatatttagggaatttgctttatttaccccttctgcgctaagaaatggttacatgacaatgtagggctgtgtgcccaggcgtatggttttgggaaggattacagaagaatagcaccttacttattgatgacttccagttaactgcattggtttagttttactcaa

SEQ ID NO: 1105 - DNA, 2578 bp, Sorghum bicolor
tttctttcttcgtgtgcgggtttcattttcgtgcccgctttgttctttattttattagtgcgcttgcgctgatgatgtgatgtgctgggttttctatacttgcatccttttcgctgcattttcttttctttagcgcaagttcttcgaacaagcgatcgagcgctgctcgcgggaatctttggagtgaagctcccatcccatcagtcctcttcttgtccctgtctcgccagttccgggataaggaagaggaatcggtggaggtctggtcatcgattccccaggatttgcctccgaatcttccccgaaatctgaatcttttttttttattttgcgtctgtggagtctcttgctgcgtgctgctgccactccatctgagagttagtccagtctagcgcgagacgctagcagcagcaaagcagtccagtcggagaagcggaagttcgcgtgtcgttgctgatccaatgggagagacgaacgagcagccgccgccgccgccgccggtcgccgcgccgccgcccatgatggccatgatggtgccgcccgtcggcgcgggcgccatccacccgccccacgagcagttccaccacctcaactactgcgtccactcgaatccgtcctgggttcaggtggcagcacttgcattccttcactatcttgtgatgttgggttctaccgtcatgcttgcatcagttattgttcctgcaatgggtggtaacgctggtgacaaggctcgagtcattcaatcgttgctctttatgagtggcataaatacactgattcaaacacttattggaacgagacttccaacagttatgaatgcctcttttgcatttgttgtcccagtgctctcaatagcaagagagatcgagtcaaataatgacttgctgaatgatcacgagagatttaaacacacaatgagaacagcacaaggagctctgattgtggcttccatcctcaacatgattcttgggttcagcacgatatgggcagcatatgccaagaagttcagccctgtaataatgacccctgttgtttgtgttgttggtcttggactattcgaaattggctttccccaggttgggaaatgtgtggagattgggcttccaatgctaattcttgcggtgcttgtgcaacagtatgtgccaaattacttcggttatatccatccacgggtcaccttcttgtttgagaggtattcgttgcttctttgtatcggcattgtgtgggcctttgcagccattcttactgctgcgggtgcatacgaccatgtttcacttaagacacagcagcactgccgcactgataagtctcgactcatctcatcggcaccatgggttaaagttccattgccattccaatggggtcctccaatcttcactgctggtcattcatttgggatgatgggtgctgtacttgttgcagcctttgagtcaactggagcacactttgctactgctcgtctagcgggtgctacaccacctccagctcatgtccttagtcggagcgttggcttgcagggtattggaatgttcctgggggggatctttagttgtccgacaggctcatctgtatcagttgaaaatattggcctccttggtctgaccaaagtcggaagtaggagagtcgtccagatatcaactgggtttatgatcttcttctccctatttggtaagtttggtgccttctttgcatcaattccattgccaatctttgcagcaatttactgcatcttgtttggcattgtagctgctgtgggagtctccttcatgcagtttgccaacaaaaactccatgaggaacatctatatcattggactctcattgttccttggcatctcaatccctcaatacttcaatgaatacacttcttcagctgacggccgtggacctgcccggacaaacgctggatggttcaacgacatcataaacaccgtgtttgcttccggcccgacggtggcgctaattgttgcttctgtcctggataacacattggagttcaggggctacgagtccgaccgggggctctcatggtttcagccattcctgcgtcgccataaaggatactcggaccccaggaacgaggagttctatagcttcccaatcagggttcatgacttcatcccaagccgatttctctgacttcagatgactgctgttacccgcagcagtgcatgtaaatccccgtgctcttgttaggcttactcctgtgacttgtagcggttggttctagggggatatgggtaaaagaatgtttagggcatttgctttgtttgactcttttgggctgagaaatggttatacatgataatgtagagagctctgtgccagatacatggttttgggaaggattacagaagaatagcaccttacatgttgatgggttttaaatgcaaggcattgtttagtttttacccaatgtgttgctgttgagacttgatctgccatctgggaaaagggggagtatgtaggtttttttttatttatgaaagttaactttacggtttgttgacagtgcctgtgcccattcagtgaaatcaggcactgaatcacctgatgcaaataaaatggtagtacctgcc

SEQ ID NO: 1106 - DNA, 3065 bp, Sorghum bicolor
tttggaagtaaacaagagtccaatgtggggaggaggaagcagcctggaactgagctcaatctcgagcagtcaccagcagggcacggcggcactccctgcccacacagcgattaatgctacaagacaccctcaccatcctcggaatctgccgcggctgcattcaatacaccttcccaaaaacaagaactgtcaatgcattccagtcctgcccagatccaccccatcaaaccatcagttccagttccagctcgtccagtccagtccagcacaccacagcaccgccgtttctactcgcctccaacagcgttccggaacgccggagcacggcagctcttgccctccaccgtctaccgagcacgagcagagcgcggtgcctcgcctttttgctttggacgcttgtgattagcagccagtagagtgattagcaaggcagcaaatcaacacgcctcataaaaaccaggtgtaaagcgggtgttttcgaattcgcaatcttttcctgatcctccgcaagctcacaaatcccccgcttgtcctgttccgcttgcgcccgcaccgccgccgccgctggctgggcaccgagagaggcccagccatataaaggagataagaataagcgcaaggcagagagcacaggcagaggaggaagcgaggaaaaagggggcataaaaagtccagtcggagaagcggaagttcgcgtgtcgttgctgatccaatgggagagacgaacgagcagccgccgccgccgccgccggtcgccgcgccgccgcccatgatggccatgatggtgccgcccgtcggcgcgggcgccatccacccgccccacgagcagttccaccacctcaactactgcgtccactcgaatccgtcctgggttcaggtggcagcacttgcattccttcactatcttgtgatgttgggttctaccgtcatgcttgcatcagttattgttcctgcaatgggtggtaacgctggtgacaaggctcgagtcattcaatcgttgctctttatgagtggcataaatacactgattcaaacacttattggaacgagacttccaacagttatgaatgcctcttttgcatttgttgtcccagtgctctcaatagcaagagagatcgagtcaaataatgacttgctgaatgatcacgagagatttaaacacacaatgagaacagcacaaggagctctgattgtggcttccatcctcaacatgattcttgggttcagcacgatatgggcagcatatgccaagaagttcagccctgtaataatgacccctgttgtttgtgttgttggtcttggactattcgaaattggctttccccaggttgggaaatgtgtggagattgggcttccaatgctaattcttgcggtgcttgtgcaacagtatgtgccaaattacttcggttatatccatccacgggtcaccttcttgtttgagaggtattcgttgcttctttgtatcggcattgtgtgggcctttgcagccattcttactgctgcgggtgcatacgaccatgtttcacttaagacacagcagcactgccgcactgataagtctcgactcatctcatcggcaccatgggttaaagttccattgccattccaatggggtcctccaatcttcactgctggtcattcatttgggatgatgggtgctgtacttgttgcagcctttgagtcaactggagcacactttgctactgctcgtctagcgggtgctacaccacctccagctcatgtccttagtcggagcgttggcttgcagggtattggaatgttcctgggggggatctttagttgtccgacaggctcatctgtatcagttgaaaatattggcctccttggtctgaccaaagtcggaagtaggagagtcgtccagatatcaactgggtttatgatcttcttctccctatttggtaagtttggtgccttctttgcatcaattccattgccaatctttgcagcaatttactgcatcttgtttggcattgtagctgctgtgggagtctccttcatgcagtttgccaacaaaaactccatgaggaacatctatatcattggactctcattgttccttggcatctcaatccctcaatacttcaatgaatacacttcttcagctgacggccgtggacctgcccggacaaacgctggatggttcaacgacatcataaacaccgtgtttgcttccggcccgacggtggcgctaattgttgcttctgtcctggataacacattggagttcaggggctacgagtccgaccgggggctctcatggtttcagccattcctgcgtcgccataaaggatactcggaccccaggaacgaggagttctatagcttcccaatcagggttcatgacttcatcccaagccgatttctctgacttcagatgactgctgttacccgcagcagtgcatgtaaatccccgtgctcttgttaggcttactcctgtgacttgtagcggttggttctagggggatatgggtaaaagaatgtttagggcatttgctttgtttgactcttttgggctgagaaatggttatacatgataatgtagagagctctgtgccagatacatggttttgggaaggattacagaagaatagcaccttacatgttgatgggttttaaatgcaaggcattgtttagtttttacccaatgtgttgctgttgagacttgatctgccatctgggaaaagggggagtatgtaggtttttttttatttatgaaagttaactttacggtttgttgacagtgcctgtgcccattcagtgaaatcaggcactgaatcacctgatgcaaataaaatggtagtacctgcctacatttcttgtgtgagattgcggtctctttcactctataaaaggagttgaaggagcaagactgcaagacacaatgcaggcacccaaagggagatgaggtgttcgtttgtggtaactgcagtggcttagtgtagttgtaggcttggaaagcatcaggaggtctgctcgtttcactctgaatgggtggcgttccttgacacatcagtgaagagccaagaaaaccctttcaagtgcct

SEQ ID NO: 1107 - DNA, 2559 bp, Zea mays
gctgcattcaatactcccttccccaaaacaagaactgtcaatgcatgcagtccatccagccctctctctctcatcagccgtcctgcccagcccagatccaccccatcaaccagcaggtccagtccagccatccaactccagcacagaacgagaacagcaccactgctgctgtactgcttgctgttcgcctcccagcagtggaacaccagcacttccccttcagcgtccagccgtcgaccgagcacacggccagagcggtgcctcgcttctgctttggacgcttgtgatccagtagagtaaccaggaaggaagcaaatcaacacggctgctaaaaagaaaccggcgattaaaccaggtgccgcaaggctacaaaatcccctgcttgtcctgttgcgccccgccgccgctgggttccgagggagggccagccgtagaaaggagataagaagcgagaagagagcacaggcagagggagtgagggaaaaggcgagagcgtagaaagcagtccggtcggagaagcggaagttcgcgttgctttgctgatccaatgggggagaccaacgagctaccgccgccacccgtggccgcgccgccgcccatgatgccgatgcagtccatgatggtcggcgcaggcgccatccacccgccccacgagcagttccaccatctcaactactgcgtccactcaaatccatcctgggttcaggtggcagcacttgcattccttcactatcttgtgatgttgggttctaccgtcatgcttgcaacagctattgttcctgcgatgggtggtaacgctggtgacaaggctcgagttattcaatcgttcctctttatgagtggcataaacacactgctgcaaacacttattggaacgagacttccaacagttatgaatgcctcttttgcatttgttgtcccagtgctgtcaatagcaaaagagattgaatcaaataacttcctgaatgatcatgagagatttaaacacacaatgagaacagcacaaggagctctgattgtggcatccatcctcaacatgattcttgggttcagcacgatatggggggcatatgccaaaaagttcagtccggtgataatgacccctgttgtttgtgttgttggtcttggactattccaacttggctttccccaggttgggaaatgtgtggagattgggcttccaatgctaattcttgcggtggttgtgcaacagtatgtgccaaattacttcagttatatccatcaacgggtcaccttcttgtttgagaggtattcgttgcttctttgtatcggcatcgtgtgggcctttgcagctatccttactgctgcgggtgcatatgaccatgcttcacctaagacacaacagcactgccgcactgataagtctttcctcatgtcatcggcaccatggattaaaattccattaccattcgaatggggtcctccaatcttcactgctggtcattcatttggaatgatgggtgctgtacttgttgcagccttcgagtcaactggagcacactttgctactgctcgtctagcgggtgctacaccacctccagcttatgtccttagtcggagcgttggcttgcagggtattggaatgttcttggaggggatctttagtgttccagcaggttcatctgtatcagttgaaaacattggcctccttgggctgacaaaagttggaagtaggagggtgatccagatatcaactgggtttatgatattcttctccatatttgggaaatttggggccttctttgcatcgatcccactgccgatctttgcagcaatttactgcatcttgttcggcattgtagctgctgtgggagtctcgttcatgcagtttgccaacaagaactcgatgaggaacatctatatcatcggactctcgttgttccttggcatctcggtccctcaatacttcaacggatacacttcttcagctggcggccacggacctgcccggacaaatgctggatggttcaacgacattataaacaccgtgtttgcttccgggccgacggtggcgctaattgtcgcttctgtcctggacaacacgctggagttcaggggctacgaggccgaccgggggctctcgtggttccagccgttcctgcgccgccataagggatactcggaccccagaaacgaggagttctacagcttcccaatcagcgtctatgacgtcatcccagaccgatttcggcgctgactccaaatgaccgctgttaccccgcagctgtgcatgtaaatccccgtgagtcttgttagtcttactcctgtgacttgtagcggctggttctagggggatatgggtaaaagaatgcttagggcaattgcttggtttgactcttttcgggataagaaacgggttacatgataatgtagagctctgtgccggatacattggttttgggaagggttacagaagaatactagcaccttacatgttgatgggcatttagttgaaggcattggctatttgtttttttgcccaatatatggctgttggagcttgatctgctgactgggaaaagggggcagtactttgga

SEQ ID NO: 1108 - DNA, 679 bp, Secale cereale
aacgaccgacgaaggtacaatggggaccgtggcgactacgcccacccaaccccaaaacgaacaacccaaccaccaacgacgtccaacgaaaggactcttcggactcgagaggaaggagccatggcgctcggcaagcttgcggtggccgcgctggtggcgtctctcctcctgctcagcaccatcaaggctgccgactcccctgctccagctgctgctcccctcgggcctcctccccacaacatcgtagacccctctaaagactgcgggtgggcatgcaacctgcggtgcagcgccaactcgcggccgaacctgtgcagccgggcgtgcctcaagtgctgcagcgtgtgccgctgcgtgccggcgggcacggccggcaacaaggagacctgcggcaagtgctacaccgactggaccacgcacggcaacaagaccaagtgcccctgactgcctcctcatatcttcagccgccctaaatatcttagtactagtagctacctttgctcatggctgtcgttagcgccaccggtgaccttgctgatttcgtcttggtgtggaaggaacggtgttgactagcactagctagcagcagtgttcttgtcttgtgtaaaaagtatgtattgtcccgtaggtgggcgtatttctcgtgtaataaaattaaaacccatccggaggtttatgt

SEQ ID NO: 1109 - DNA, 643 bp, Triticum aestivum
catggcgctcggcaagcttgcggtggccgcgctggtggcatctctcctcctgctcagcaccatcaaggctgccgactctcctgctccggctgctgctccgctcgggcctcctccccacaacatcgtagacccctctaaagactgcgggtgggcgtgcaacctgcggtgcagcgccaactcgcggccgaagctgtgcagccgggcatgcctcaagtgctgcagcgtgtgccgctgcgtgccggcgggcacggccggcaacaaggagacctgcggcaagtgctacaccgactggaccatgcacggcaacaacaccaagtgcccctgaatatcttcggccaacctaaatatcttagtagagtagctaagctttgctcatgattgtcgttagcgttaccggtgaccttcgtgatttcgtcttggtgtggaaggaacggtgttgactagactagcactagctagctggtgaacctggtcctggtgtgttcttgtgtaaagagtaagtacgtgttgtcctgtaggtgggcgtatttctcgtgtaataaagcccatccgaaggtttatgtggtgaatgcatggttctcttgctagccgtatacatcacctttgtttgagatgaaaagttggcgcttcgtgcgtccccctc

SEQ ID NO: 1110 - DNA, 603 bp, Lolium multiflorum
  misc_feature (593)..(593): n is a, c, g, or t
gtcagaggaaccatggcgctcggcaaggtcgcggtggccgccttggtggcgtccctcctcctgctcagcaccatcaaggctgccgactaccctcccgcggccgctccgtccctcgggcctcctccccacaagatcgtcgaccccctcaaagactgcggcgacgcgtgcgacatcaggtgcagcgccaactcgcgcaagaacatgtgcagccgcgcgtgcctcaagtgctgcagcgtctgccgctgcgtgccggcgggcaccgccggcaacaaggagacctgcggcaagtgctacaccgactggaccacgcacggcaacaagaccaagtgcccgtgaaccctctatggcatcctaaatcccttgccgaaagcccctcctgcttgttccatgtgtttgtttgatcgatcggcatcggcatacctatattagctagctagcttgttcatggctttcctctgattgtacgtttggagtgttttcttgtgtaaaaatgagtgccctgtagctgagtgagtattcttctcttgtaaaacccgtgtggggtttggtttatgtgatcactgatctacagatcagtgcacggtttggcgtcnaaaaaaaaaa

SEQ ID NO: 1111 - DNA, 910 bp, Brachypodium distachyon
aaagtgtaaactcttcttcccttggctctcctatttagccatctctcacgcaggccagctaccattgccaccgagacccaagtaccctcggtcctcactctccaagaaagcacttgttgctacagatcactccggaggcatacccatggcggtcggcaagcttgcggtggtcgccttagtggcgtcgtctctcctcatgctcagcaccatcaaggctgccggatacgctcctgcacctgctccccttgggcctcctccccacaagatcgtagacccctccaaagactgcgggggggcgtgcgacgtgcggtgcagcgagaacaagcgcaagaacatgtgctcccgggcgtgcctcaagtgctgcagcgtgtgccactgcgtgccggcgggcacggccggcaaccaggagacctgcggcaagtgctacacggactggaccacgcacggcaacaggaccaagtgcccgtgaacggacgaggctccgcgacaccgcatatgcatgcctgtgtcgtatgtctgtcccttctagaaatcttagctagctctagcttgctcagggttgatgttggtgtgtgtgtgtgttaccttcttcggaaccaggctcttccccatttttactaccggcgtgttgggggttcatcttggttaggaagggtgttttggcgagctggtgcctgttgtttttcttgtgtaaaaatgagtgtcttctactgtatgtcatcatgtttctcctctaaaactttatgtgatcagtgcgcggtttgcgcagtaacctgtacggcgtacctcacatgcaacagatttcacgttcgacgctgctttgctccactgaagcagcgctgacacgtcaccaaaacgagcagtgccattaagaagaggagaagctaagccaaatgtaagaggaggatcg

SEQ ID NO: 1112 - DNA, 906 bp, Brachypodium distachyon
atggggcttggttggagtgcagtgtgcagagttttattgtttgaaaaacaatccaattcccgtagaaatctagagaaactcgtatggtcatatctcaaaaccaaaacaagttttagatccaaatgtgctcgtaagcagagcatggaggtagaagaacggatatgcctccatctctcacgcaggccagctaccattgccaccgagacccaagtaccctcggtcctcactctccaagaaagcacttgttgctacagatcactccggaggcatacccatggcggtcggcaagcttgcggtggtcgccttagtggcgtcgtctctcctcatgctcagcaccatcaaggctgccggatacgctcctgcacctgctccccttgggcctcctccccacaagatcgtagacccctccaaagactgcgggggggcgtgcgacgtgcggtgcagcgagaacaagcgcaagaacatgtgctcccgggcgtgcctcaagtgctgcagcgtgtgccactgcgtgccggcgggcacggccggcaaccaggagacctgcggcaagtgctacacggactggaccacgcacggcaacaggaccaagtgcccgtgaacggacgaggctccgcgacaccgcatatgcatgcctgtgtcgtatgtctgtcccttctagaaatcttagctagctctagcttgctcagggttgatgttggtgtgtgtgtgtgttaccttcttcggaaccaggctcttccccatttttactaccggcgtgttgggggttcatcttggttaggaagggtgttttggcgagctggtgcctgttgtttttcttgtgtaaaaatgagtgtcttctactgtatgtcatcatgtttctcctctaaaactttatgtgatcagtgcgcggtttgcgcagtaacctgt

SEQ ID NO: 1113 - DNA, 1229 bp, Triticum aestivum
ggctaggccccaaatggcgaaccagcttctgtccaccgtcgcgcaccgcgataccctcccggagggttacacgcggcctgagaacgaccggccgcagctcgcggatgtggtgactgacagcaacatccccctcatcgacctcgcctcgccggacaagcatctcgtcatcgctgagatcgaccaggcttgccgcacctacggcttcttccagatcgtaaatcatgggatatcagaggagctgctggagaaggtgatggctgtggggcttgagtttttccggctcccgccggaagagaaggccaagctctattctgatgagccatccaaaaagataaggctttctacaagcttcaacgtccgcaaggagacagtgcacaactggcgggactatctgcgccttcattgccacccgttggaggagttcgtgccggactggccgtccaatcctgaaacgttcaaggagatcatcagcacctactgccgcgaagtccggctgctggggctccgactcctgggcgcgatctccctgggcctgggcctcgaggaagactacatcgagaatgtgctgggcgagcaggaacagcacatggccgtcaacgactacccgcggtgccccgagccggacctcacctacggcctgcccaagcacacggaccccaacgccctcaccattctcctcatggacccccacgtctccggcctccaggtcctcaagaacggcgcccagtggatcgccgtcgacccccggcccaacgccctcgtcgtcaacctaggcgaccagttgcaggcgctgagcaacggcgcgtacaagagcgtctggcaccgcgcggtggtcaatgcggcgcgggagcgcctgtcggtggcatctttcctgtgcccgtgcaacagcgcggtgatcggcccggcggccaagctcgtcggcgacggggacgagcccgtgtaccgcagctacacctacgacgagtactacaagaagttctggagcaggaacctggaccaggaccattgcctggagctcttcacgggtcagaagtgatccgtgtgcacaagcttgcctcatctacggctgggtgcagtggacatccacgacgtagcattactcaaataataaatgccctcaatgtgcggggttactcgagttgtttgaacttgtttttgcttgagcacaacgtatttatcgatgtccatcttgtattgtaatccctatatactagtgggtgtgcgcgcgc

SEQ ID NO: 1114 - DNA, 1317 bp, Triticum aestivum
ggctaggccccaaatggcgaaccagcttctgtccaccgtcgcgcaccgcgatacccttccggagggttacacgcggcccgagaacgaccggccgcagctcgccgatgttgtgactgacagcaacatccccctcatcgacctcgcctcgccggacaagcatcgcgtcatcgctgagatagaccaggcttgccgcacctacggcttcttccagatcataaaccatgggatatcagaggagctgctggagaaggtgatggctgtggggcttgagtttttccggctcccgccggaagagaaggccaagctctattctgatgagccatccaaaaagataaggctttctacaagcttcaacgtccgcaaggagacagtgcacaactggcgggactatctgcgccttcattgccacccgttggaggagttcgtgcccgactggccatccaatcctgaaacgttcaaggagatcatcagcacctactgccgcgaagttcggctgctcggcctccgactcctgggcgcgatctccctgggcctgggcctcgaggaggactacatcgagaatgtgctgggcgagcaggagcagcacatggccgtgaactactacccgcggtgccctaagccggacctcacctacggcctgcccaagcacacggaccccaacgccctcaccattctcctcatggacccccacgtctccggcctgcaggtcctcaaggacggcgcccagtggatcgccgttgacccccggcccaacgccctcgtcgtcaacctaggcgaccagttgcaggcgctgagcaacggcgcgtacaagagcgtctggcaccgcgcggtggtcaatgcggcgcgggagcgcctgtcggtggcatctttcctgtgcccgtgcaacagcgcggtgatcggcccggtggccaagctcgtcggcgacggggacgagcccgtgtaccgcagctacacctacgacgagtactacaagaagttctggagcaggaacctggaccaggaccattgcctggagctcttcacgggtcagaagtgatccgtgtgcacaagcttgcctcatccacgacgcagcattactcaaataataaatgcccccaatgtgcggggttactcgagttgtttgaacttgtttttgcttgagcacaacgtatttatcgatgttcatcttgtattgtactccctatatactagtgtgtgcgcgcgcgcgcgcgcacgcgcttgtttattaattgtgatcctacttgtaacgacatatggtacaccagtgcaagagaaaacactatgtaataaatttgctgtccaggagctgagctcacc

SEQ ID NO: 1115 - DNA, 1445 bp, Triticum aestivum
ctcgccggcctcaccgagtcttccggtactcgatatatggcgatccccctcgctcctcccccttcttctaccgccgcgcgagactgagcctcgcctaggccccgaatggcgaaccagcttctgtccaccgtcgcgcaccgcgatacccttccggagggttacacgcggcccgagaacgaccggccgcagctcgccgatgttgtgactgacagcaacatccccctcatcgacctcgcctcgccggacaagcatcgcgtcatcgctgagatcgaccaggcttgccgcacctacggcttcttccagatcataaaccatgggatatcagaggagctgctggagaaggtgatggctgtggggcttgagtttttccggctcccgccggaagagaaggccaagctctattctgatgagccatccaaaaagataaggctttctacaagcttcaacgtccgcaaggagacagtgcacaactggcgggactatctgcgccttcattgccacccgttggaggtgttcgtgcccgactggccatccaatcctgaaacgttcaaggagatcatcagcacctactgccgcgaagtccggctgctcggcctccgactcctgggcgcgatctccctgggcctgggcctcgaggaggactacatcgagaatgtgctgggcgagcaggagcagcacatggccgtcaactactacccgcggtgccccgagccggacctcacctacggcctgcccaagcacacggaccccaacgccctcaccattctcctcatggacccccacgtctccggcctgcaggtgctcaaggacggcgcccagtggatcgccgtcgacccccggcccaacgccctcgtcgtcaacctaggcgaccagttacaggcagtgagcaacggcgcgtacaagagcgtctggcaccgcgcggtggtcaatgcggcgcgggagcgcctgtcggtggcatctttcctgtgcccgtgcaacagcgcggtgatcggcccggcggacaagctcgtcggcgacggggacgagcccgtgtaccgcagctacacctacgacgagtactacaagaagttctggagcaggaacctggaccaggaccactgcctggagctcttcacgggtcagaagtgatccgtgtgcgcaagcttgcctcatctacggttgggtgcagtggacatccacgacgcagcattactcaaataaaaaatgcccccaatgtgcggggttactcgagttgtttgaacttgtttttgcttcagcacaacgtatctatcgatgttcatcttgtattgtattccctatatactagtacgtgtgtgtgtgtgtgtttgtttattaattgtgatcctacttgtaaagaattatggtacactggtccaagaggaaacgctgtgtaataaatttgctgtcgaggagctgagctaactaaaccaaaatgttagagcaac

SEQ ID NO: 1116 - DNA, 1498 bp, Triticum aestivum
tccggtactcgatatatggcgatccccctcgctcctcccccttcttctaccgccgcgcgagactgagcctcgcctaggccccgaatggcgacccagcttctgtccaccgtcgcgcaccgcgataccctcccggagggctacacgcggcccgagaacgaccggccgcagctcgccgatgttgtgactgacagcaacatccccctcatcgacctcgcctcgccggacaagcatcgcgtcatcgctgagatagaccaggcttgccgcacctacggcttcttccagatcataaaccatgggatatcagaggagctgctggagaaggtgatggctgtggggcttgagtttttccggctcccgccggaagagaaggccaagctctattctgatgagccatccaaaaagataaggctttctacaagcttcaacgtccgcaaggagacagtgcacaactggcgggactatctgcgccttcattgccacccgttggaggagttcgtgcccgactggccgtccaatcctgaaacgttcaaggagatcatcagcacctactgctgcgaagttcggctgctcggcctccgactcctgggcgcgatctccctgggcctgggcctcgaggaggactacatcgagaatgtgctgggcgagcaggagcagcacatggccgtgaactactacccgcggtgccctaagccggacctcacctacggcctgcccaagcacacggaccccaacgccctcaccattctcctcatggacccccacgtctccggcctgcaggtcctcaaggacggcgcccagtggatcgccgttgacccccggcccaacgccctcgtcgtcaacctaggcgaccagttgcaggcgctgagcaacggcgcgtacaagagcgtctggcaccgcgcggtggtcaatgcggcgcgggagcgcctgtcggtggcatctttcctgtgcccgtgcaacagcgcggtgatcggcccggtggccaagctcgtcggcgacggggacgagcccgtgtaccgcagctacacctacgacgagtactacaagaagttctggagcaggaacctggaccaggaccattgcctggagctcttcacgggtcagaagtgatccgtgtgcacaagcttgcctcatccacgacgcagcattactcaaataataaatgcccccaatgtgcggggttactcgagttgtttgaacttgtttttgcttgagcacaacgtatttatcgatgttcatcttgtattgtactccctatatactagtgtgtgcgcgcgcgcgcgcgcacgcgcttgtttattaattgtgatcctacttgtaacgacatatggtacaccagtgcaagagaaaacactatgtaataaatttgctgtccaggagctgagctcaccaaaccaaaatgttagagcatatataataagccctattaagtaggctgtagtgtgtttcctaccatcatcagaatcctatttggaagtgagaatgtaagagaagagaaaga

SEQ ID NO: 1117 - DNA, 1446 bp, Secale cereale
gactacccggtcttcgagtactcgatatatggcgatccccctcgctcctccctcttctaccgccgcccgagactgagcctaggctacacctcaaatggcgaaccagctactttccaccgtcgcgcaccacgataccctcccgaagggttacacgcggcccgagaacgaccgcccgcagctcgccgatgtggtgactgacaacaacatccccctcatcgacctcggctcgccggacaagcatcgcgtcatcgcggagatcgatcaggcttgccgcacctacggcttcttccagatcataaaccatgggatatcagaggagctgatggagaaggtgatggctgtggggcttgagtttttccggctcccgccggaagagaaggccaagctctattcggatgagccatccaaaaagataaggctttctacaagcttcaacgtccgcaaggagacagtgcacaactggcgggactatctgcgccttcattgccacccgttggaggagttcgtgcccgactggccgtccaatcctgaaacgttcaaggagatcatcagcacctactgtcgcgaagtccggctgctcggcctccgactcctgggcgcgatctccctgggcctgggcctcgaggaggactacatcgagaatgtgctgggcgagcaggagcagcacatggccgtgaactactacccgcggtgccccgagccggacctcacctacggcctgcccaagcacacggaccccaacgccctcacccttctcctcatggacccccacgtctccggcctgcaggtcctcaaggacggcgcccagtggatcgccgtcgaccccaggcccaacgccctcgtcgtcaacctaggcgaccagttgcaggcactgagcaacggcgcgtacaagagcgtctggcaccgcgcggtggtcaatgcggcgcgggagcgcctgtcggtggcatctttcctgtgcccgtgcaacagcgcggtgatcggcccggcggccaagctcgtcggcgacggggacgagcccgtgtaccggagctacacctacgacgagtactacaagaagttctggagcaggaacctggaccaggaccattgcctggagctcttcacgggtcagaagtgatccgtgtgcacaagcttgcctcctctacagttggttgcagaccagctggcttacctgttgcttggattgggtcatccacggcgcagtattactcaaataataaatgccccaaatgtgcggggttactctagttgtttgaacttgtttttgcttgagcacaaacgtattgatcgatgttcatcgatcttgtatcttactccctccgtctcaaaataaatgactcactttgtattaactttggagggagtattccctatatactagtagtatgtgtgtgtgtttttgttaactgtgatcctacttgtaacgaattatggtacatcagtgta

SEQ ID NO: 1118 - DNA, 1447 bp, Avena sativa
tcttctccgcttattacagctagagtgtgcctctgctcggcggggcttcggcatggcgaaccagcttctatccaccgtcgcctaccgcgacagcctgcccgagggttacacccggcccgagcacgaccggccgcggctcgccgatgtggcgaccgacacaaacatccctctcatcgatctcgcctcgccggacatgcatcgcgtcatcgcccagatcgatcaggcttgccgcacctacggcttcttccaggtcataaaccatgggatatcagaggagttgctggcgaaggtgatggccgtggggctggagttcttccggctcccgccggaggagaaggcgaagctctactcagacgagccgtccaagaagataaggctttccaccagcttcaacgtccgcaaggagacggtgcacaactggcgggactatctgcgccttcattgccatcccttggaggagttcgtgcccgactggccgtccaatcctgaaactttcaaggagaccatcagcgcctactgccgggaggtccggcagctggggctccgcctcctgggcgcgatctcgctggggctgggcctggaggcggactacgtggagaaggtgctgggcgagcaggagcagcacatggccgtgaactactacccgcgctgccccgagccggacctcaccttcggcctgcccaagcacacggaccccaacgccctcaccatcctcctcatggacccccgcgtctccggcctccaggtcctcaaggacggagcccactggatcgccgtcgaccccaggcccaacgccctcgtcatcaacctaggcgaccagctacaggcgttgagcaacggcgcgtacaagagcgtgtggcaccgggcggtggtgaacgcggcgcaggagcgcctgtcggtggcgtctttcctgtgcccgtgcaacagcgcggtcatcggccccgcggcgaagctcgtcggggacggcgaggagcccgtctaccggagctacacctacgacgagtactacaagaggttctggagcaggaacctggaccaggagcactgcctcgagctcttcaggggtcagcagtgattatcatcgtacgtatgtgggcgcgagcaaacttgctccaagtagctaataaaagctgcttgaccgtgcagatccatggcgaaagaatgccccgcttgcccggttaccagggtttgtttcgcttgtgtgcttaataataatattccacgacatattactgtagtatttatttgcttgacattatgacgttgcacatgctaggtactctatcttattatttttttatcaaaacatatatgatgtagaccaccttgctaccgcaatgcgcacatgcaatgcataagaaatatttgtgtaataaatctggtcttctgccattgagcctattgagggagattagaatgcaacaatatatatgacgtttatctattc

SEQ ID NO: 1119 - DNA, 1361 bp, Brachypodium distachyon
actcggccggggatccacatggcgaaccagcttctttccactgtttcgtgccacgacaccctcccggagggctatgcccggcccgagtccgaccggcctcgcctcgccgaggtggccaccgacagcaacatccccctcatcgacctcgcctcgccggacaagctccgcgtcatcgccgagatcgaccgggcttgccgcacctacggtttcttccaggtcataaatcatggaatatcagaggagttactggagaaggtgatggccgtcgggctagagttcttccggctcccgccggaagagaaagcgaagctctactcggacgagccttccaagaaaataaggctttccacaagcttcaacgtccgcaaggagacggtccacaactggcgggactatctgcgccttcattgccacccgttggaggagttcgtgcccgactggccttccaatcctgaagcgttcaaggagatcatcagcacctactgccgcgaagtccggctcctggggctccggctcatgggcgcgatctccctcagcctgggcctcgatgaaaactacgtggagaatgtgctcggcgaacaggagcagcacatggccgtcaactactacccacggtgcccggaacccgatctcacctacggcctgcccaagcacaccgaccccaacgcactcaccgtgctcctgcaggaccccaacgtctcgggcctccaggtcctcaaagacggccaatggatcgccgtcgacccccggcccaacgccctcgtcatcaacctcggcgaccagctgcaggcgctgagcaacggcgcgtacaagagcgtgtggcaccgggccgtggtgaacgcggcgcaggagcgcatgtcggtggcatctttcctgtgcccgtgcaacagcgccgtgatcggccccgcggcgaagctcgtcggcgacggggacgagcccgtgtaccggagctacacctacgacgagtactacaacaagttctggagcaggaacctcgaccaggagcactgcctggagctcttcagaggccagaagtaattcgtacgtgccgtgcgcacggacttgcttcgagtagcccgcacggggtgcttgctttggttaagatttatggcggagcattagctattgcgcatctctcctaagttgtttaaaaatttgaacgggttttacgcgtttctcgatctttgtcttttcttgtatccaagcaataatctatatgctcggatgcatataataagtgtgaccttagactatatgccggggaagattggtctatctataagaaatataagcgtggtcttacgtgttatcacatcatgatattcctcaatcgacgatgatagcagtccaatcacgatctt

SEQ ID NO: 1120 - DNA, 1434 bp, Brachypodium distachyon
agacgcgcgatccccttctccgcttaattaccagcgagactgagactcggccggggatccacatggcgaaccagcttctttccactgtttcgtgccacgacaccctcccggagggctatgcccggcccgagtccgaccggcctcgcctcgccgaggtggccaccgacagcaacatccccctcatcgacctcgcctcgccggacaagctccgcgtcatcgccgagatcgaccgggcttgccgcacctacggtttcttccaggtcataaatcatggaatatcagaggagttactggagaaggtgatggccgtcgggctagagttcttccggctcccgccggaagagaaagcgaagctctactcggacgagccttccaagaaaataaggctttccacaagcttcaacgtccgcaaggagacggtccacaactggcgggactatctgcgccttcattgccacccgttggaggagttcgtgcccgactggccttccaatcctgaagcgttcaaggagatcatcagcacctactgccgcgaagtccggctcctggggctccggctcatgggcgcgatctccctcagcctgggcctcgatgaaaactacgtggagaatgtgctcggcgaacaggagcagcacatggccgtcaactactacccacggtgcccggaacccgatctcacctacggcctgcccaagcacaccgaccccaacgcactcaccgtgctcctgcaggaccccaacgtctcgggcctccaggtcctcaaagacggccaatggatcgccgtcgacccccggcccaacgccctcgtcatcaacctcggcgaccagctgcaggcgctgagcaacggcgcgtacaagagcgtgtggcaccgggccgtggtgaacgcggcgcaggagcgcatgtcggtggcatctttcctgtgcccgtgcaacagcgccgtgatcggccccgcggcgaagctcgtcggcgacggggacgagcccgtgtaccggagctacacctacgacgagtactacaacaagttctggagcaggaacctcgaccaggagcactgcctggagctcttcagaggccagaagtaattcgtacgtgccgtgcgcacggacttgcttcgagtagcccgcacggggtgcttgctttggttaagatttatggcggagcattagctattgcgcatctctcctaagttgtttaaaaatttgaacgggttttacgcgtttctcgatctttgtcttttcttgtatccaagcaataatctatatgctcggatgcatataataagtgtgaccttagactatatgccggggaagattggtctatctataagaaatataagcgtggtcttacgtgttatcacatcatgatattcctcaatcgacgatgatagcagtccaatcacgatcttcttatctctttgtacttgcacatatattg

SEQ ID NO: 1121 - DNA, 1411 bp, Oryza sativa
gcgcattcacccttcaagtattccctcgcgtgatctccggccggcctctcgctccccttctctcttagcttgctagctgatgtacttgccgcgatccagcgacctcgcgcttcgtctcccatggcaacgacgcagttgctgtccaccgtcgagcaccgggagacgctcccggagggctatgctcggcctgagtccgaccggccgcggctcgccgaagttgccacggacagcaacatcccgctcatcgacctcgcctcgccggacaagccgcgggtcatcgccgagattgctcaggcctgtcgcacctacggcttcttccaggtcaccaaccacgggatagcagaggagctactggagaaggtgatggccgtggcgttggagttcttcaggctgccgccggaggagaaggagaagctgtattccgatgagccatccaagaaaatcagactctctacgagctttaacgtccgcaaggagacagtacacaactggagagattatctccgccttcactgccacccgctggaggaattcgtacccgagtggccctctaatccggcacagttcaaggagattatgagcacgtactgccgagaagtccggcaactggggctccggcttctcggcgccatctctgtcagcctcggcctcgaggaggactacatcgagaaggtgctcggcgagcaggagcagcacatggctgtgaactactacccgcggtgtccggagccggacctgacctacggccttcccaagcacacggaccccaacgccctcaccatcctcctccccgatccccatgtcgccggcctccaggtcctcagggacggcgaccagtggatcgtcgtcaacccacgccccaacgctctcgtcgtcaacctaggcgaccagatacaggctctgagcaatgacgcgtacaagagcgtgtggcaccgtgcggtggttaacgcggtgcaagagcgcatgtcggtggcatctttcatgtgtccgtgcaacagcgcggtgatcagcccggcgaggaagctcgtcgcggacggggacgcgcccgtgtaccggagcttcacctacgacgagtactacaagaagttctggagcaggaacctggaccaggagcactgcctagagctcttcaaaggccagtagtaacgactaatgaactcgatcgtgtgcagaaacttcagacttgcgcttcactacccaagttaaaattgcttgccgctcgttgctgcagtgcagatatcctcgtcgtttgacggttgtgtgtggttgtctggtgcacttaatttatcggttcagtacttaattatgtcgggcaatgctttacttattttatcgatgttatgtatcacataatgctttggttattcctaaaacttccaataaaattggtatgcctaattaccctcaaaaa

SEQ ID NO: 1122 - DNA, 1366 bp, Oryza sativa
ctctcgctccccttctctcttagcttgctagctgatgtacttgccgcgatccagcgacctcgcgcttcgtctcccatggcaacgacgcagttgctgtccaccgtcgagcaccgggagacgctcccggagggctatgctcggcctgagtccgaccggccgcggctcgccgaagttgccacggacagcaacatcccgctcatcgacctcgcctcgccggacaagccgcgggtcatcgccgagattgctcaggcctgtcgcacctacggcttcttccaggtcaccaaccacgggatagcagaggagctactggagaaggtgatggccgtggcgttggagttcttcaggctgccgccggaggagaaggagaagctgtattccgatgagccatccaagaaaatcagactctctacgagctttaacgtccgcaaggagacagtacacaactggagagattatctccgccttcactgccacccgctggaggaattcgtacccgagtggccctctaatccggcacagttcaaggagattatgagcacgtactgccgagaagtccggcaactggggctccggcttctcggcgccatctctgtcagcctcggcctcgaggaggactacatcgagaaggtgctcggcgagcaggagcagcacatggctgtgaactactacccgcggtgtccggagccggacctgacctacggccttcccaagcacacggaccccaacgccctcaccatcctcctccccgatccccatgtcgccggcctccaggtcctcagggacggcgaccagtggatcgtcgtcaacccacgccccaacgctctcgtcgtcaacctaggcgaccagatacaggctctgagcaatgacgcgtacaagagcgtgtggcaccgtgcggtggttaacccggtgcaagagcgcatgtcggtggcatctttcatgtgtccgtgcaacagcgcggtgatcagcccggcgaggaagctcgtcgcggacggggacgcgcccgtgtaccggagcttcacctacgacgagtactacaagaagttctggagcaggaacctggaccaggagcactgcctagagctcttcaaaggccagtagtaacgactaatgaactcgatcgtgtgcagaaacttcagacttgcgcttcactacccaagttaaaattgcttgccgctcgttgctgcagtgcagatatcctcgtcgtttgacggttgtgtgtggttgtctggtgcacttaatttatcggttcagtacttaattatgtcgggcaatgctttacttattttatcgatgttatgtatcacataatgctttggttattcctaaaacttccaataaaattggtatgcctaattaccctcaaaca

SEQ ID NO: 1123 - DNA, 1338 bp, Sorghum bicolor
gagcaaaccttgccagttgtttccgtgacgctcactgcgcgcgtcaactctgctaggtctccggcttctgccgtgggcgatcctctttcctttaattcattccccaacctttgaaacaattaagcatagtatctcttgcaatccgatgggaagccagcttctgtccaccgtcgagcgtcgcgaggtcctcccggagtgctatatccggccggagttcgacaggccgcgactcgccgaagtgacgacggacagcgacgtcccgctcatcgacctcgcgtcgccggataagcaacgagtcatcggccagattggtctggcttgccggacctatggcttcttccaggtcataaaccatggaatagaagaggagctactggagaagatgatggccgttggtctggagttcttccgtctgccgccggaggagaaggagaagctgtactcagatgaaccgttcaagaagataaggctctccaccagcttcaacgtccgcaaggagacggtgcgcaactggcgggactatctgcgccttcactgccacccgctggaggagttcttgcccgaatggccgtccaatcctgaatccttcaaggaggtagtcagcgcgtactgccgcgaggtccggctgctcggtctccggcttctcggcatgatctccctcagcctaggcctcgaggaggactacatcgagaaggccctcggcgagcaggagcagcacatggccgtgaactactacccgcagtgcccggaacccgacctcacctacggtctgccgaagcacacggatcccaacgccctcaccgtcctcctccaggaccccaacgtcgccggccttcaggtcctcaagggcggcgaccaatggatcgccgtcagcccccggcgaaacgctttcgtcatcaacctaggcgatcagttacaggcgctgagcaacggcgcgtacaagagcgtgtggcaccgtgcggtggtgaacgccgcgcaagagcgcatgtcggtggcatctttcctgtgcccgtgcaacagcgcggtgatcagccccgcggcggcgctcgtcggcgaaggggacgcgcccgtgtaccggagctacacctacgaagagtactacaagaagttctggagcaggagcctggaccaggagcactgcctggagcttttcagaagcacccagcagctccagtaaaggcaggaaatgtattgcacgtacgtttgagggctttgcttgaactaagtttatttgcttttggttttgtttcctgacataccatttccttgtgttgtgtaataagcttgtcccagcaatctttcttgtactttcaagttagtaaaacttcgccttcccgt

SEQ ID NO: 1124 - DNA, 1327 bp, Sorghum bicolor
gagcaaaccttgccagttgtttccgtgacgctcactgcgcgcgtcaactctgctaggtctccggcttctgccgtgggcgatcctctttcctttaattcattccccaacctttgaaacaattaagcatagtatctcttgcaatccgatgggaagccagcttctgtccaccgtcgagcgtcgcgaggtcctcccggagtgctatatccggccggagttcgacaggccgcgactcgccgaagtgacgacggacagcgacgtcccgctcatcgacctcgcgtcgccggataagcaacgagtcatcggccagattggtctggcttgccggacctatggcttcttccaggtcataaaccatggaatagaagaggagctactggagaagatgatggccgttggtctggagttcttccgtctgccgccggaggagaaggagaagctgtactcagatgaaccgttcaagaagataaggctctccaccagcttcaacgtccgcaaggagacggtgcgcaactggcgggactatctgcgccttcactgccacccgctggaggagttcttgcccgaatggccgtccaatcctgaatccttcaaggaggtagtcagcgcgtactgccgcgaggtccggctgctcggtctccggcttctcggcatgatctccctcagcctaggcctcgaggaggactacatcgagaaggccctcggcgagcaggagcagcacatggccgtgaactactacccgcagtgcccggaacccgacctcacctacggtctgccgaagcacacggatcccaacgccctcaccgtcctcctccaggaccccaacgtcgccggccttcaggtcctcaagggcggcgaccaatggatcgccgtcagcccccggcgaaacgctttcgtcatcaacctaggcgatcagttacaggcgctgagcaacggcgcgtacaagagcgtgtggcaccgtgcggtggtgaacgccgcgcaagagcgcatgtcggtggcatctttcctgtgcccgtgcaacagcgcggtgatcagccccgcggcggcgctcgtcggcgaaggggacgcgcccgtgtaccggagctacacctacgaagagtactacaagaagttctggagcaggagcctggaccaggagcactgcctggagcttttcagaagcacccagcagctccagtaaaggcaggaaatgtattgcacgtacgtttgagggctttgcttgaactaagtttatttgcttttggttttgtttcctgacataccatttccttgtgttgtgtaataagcttgtcccagcaatctttcttgtactttcaagttagtaaaactt

SEQ ID NO: 1125 - DNA, 1781 bp, Secale cereale
ctgtctgactccgcactgagtctactgaccagggcagccccccgtccctcccctccgctccctccgctagccgccacgtccccggccaacccgaccacccctcgccgtcggccggaccgcatctcctccgctaaccccgcacctccagatccgcgcgctaccctagcctccctccgcccgccgtcgcccccccgggaacttccttccgaggtcgatccatccagtggccggcgacagcgaccgcccgccgcgcggatcgatccagcgagcaaccggctgctagccgtcacctctccagtcaacccaagtcgcaccacgtgccaccattttgaccagctccgccgctgctatttttctccctaaagtcctcccctcacgccgacggcgccccagccgctcctccccgtccgccgcgcctccgccccgcgtccgtctcccgccccagaaaccctagccagaggaaggaggacgccatgagggggaagaagccgctcaaggagctcacgctctccgtgccggcgcaggagacgcccgtcgataagttcctgacggcgagtggtacgttcaaggacggtgaactgcgacttaatcaaagaggtttgcagcttatctccgaggaaaacggagatgaacatcaatcaacaaaaatgaaggtggaagatgtgcagttatcaatggatgacctcgagatgattcaggtcattggtaagggaagtggtggtgtcgtccaactagtgcggcacaagtgggtgggcacattttatgccttgaagggcattcaaatgaacattcaggagtcagttcgcaaacaaatagtacaggagctcaaaataaatcaagcaacacagagcccacatatagtcctttgccatcaatctttttaccacaatggtgtaatatatcttgttctggaatatatggatcgtggatctcttgcagacataattaaacaagttaaaaccattctggagccatacctcgcagtactttgcaagcaggttttggagggactgttatatcttcatcatgaaaggcatgtgattcacagagacataaagccttctaacttgttagtcaaccataaaggtgaagtaaagattactgattttggggtgagtgctgtgctagcaagttcgattggtcagcgtgatacatttgttggaacctacaactatatggcgcctgagcggattagtggcagctcctatgactacaagagtgatgtatggagtttgggcttggtaatacttgaatgtgccattggtcgcttcccttatactcctccagagggagaaggttggttaagcttctatgaactattagaagcaattgttgaccagccaccaccttctgcacctgcagatcagttctctccagaattctgctcatttatctcttcctgcatacaaaaggaccctgccgagcggaagtctgcttcagaactcttgaaccacgccttcatcaagaagtttgaggacaaggacctagacctccggatcctggtggagagcctcgagcagcccatgaacgtgcccgagtgaggccgtcggtcgctcgtagcggcgatgctttgcggcagagtttcttccagggcttgcccccgtaacggcaattgtgtatttgctgtgaacctgatgatgagtgacagtgaccccccaccccctgtatgtgatgatgttgtgccggaaaaattcccagaggattcgaatggattgttatcaatgtatggtaatggattaatttaaggcccttttgttgcgtgtcttgttatgaatagatga

SEQ ID NO: 1126 - DNA, 1715 bp, Pseudoroegneria spicata
  misc_feature (120)..(120): n is a, c, g, or t
  misc_feature (232)..(232): n is a, c, g, or t
  misc_feature (475)..(475): n is a, c, g, or t
gtccccggccgacccgaccacccctcgccgccggaccgcatctccgctcacccctcacgcctccagatccgcgcgcctccctagcctccctccgcccgccgccgccgggaactttcctcngagctcgatcgatccagtggccggcgagagcgaccgaccgccgcgcggatcgatccagcgaccaacctggagcacggctgctgtcccctctcagccagtcaactcaagtcgnaccacgtgctaccattttgaccagctctgccgctgctatctttctccctaaattcctccccgggctttccctcacaccgacggcgccccggccgctcctccccgtccgacgcgcctccgctacgcgtccatctcccgcccgagaaaccctagccagaggaaggaggacaccatgagggggaagaaaccgctcaaggagctcaccctctccgtgccggcgcaggagacgcccgtggataagttnctgacggcgagcggtacatttaaggatggtgagctgcgacttaatcaaagaggtttgcagcttatctccgaggaaaacggagatgaacatcaatcaacaaaaatgaaggtggaagatgtgcagttatcaatggatgacctcgagatgattcaggtcattggtaagggaagtggtggcgtcgtccaactagtgcggcacaagtgggtgggcacattttatgccttgaagggcattcaaatgaacattcaggagtcagttcgcaaacaaatagtgcaggagctcaaaataaatcaagcaacacagagcccacatatagtcctttgccatcaatctttttaccacaatggtgtaatatatcttgttctggaatatatggatcgtggatctcttgcagacataattaaacaagtcaaaaccattctggagccatacctcgcagtactttgcaagcaggttttggagggactgttatatcttcatcatgaaaggcatgtgattcacagggacataaagccatctaacttgttagtcaaccataaaggtgaagtaaagattactgattttggtgtgagtgcagtgttagcaagttcgatcggtcagcgtgatacatttgttggaacctacaactatatggcgcctgagcggattagtggcagctcctatgactacaagagtgatgtatggagtttgggcttggtaatacttgaatgcgccattggtcgcttcccttatactcctccagagggagaaggttggttaagcttctatgaactattagaagcaattgttgatcagccaccaccttctgcacctgcagatcagttctctccagaattctgctcatttatctcttcctgcatacaaaaggaccccgccgaacgaatgtctgcttcagagctcttgaaccatgccttcatcaagaagttcgaggacaaggatctagacctccggatcctggtcgagagccttgagcagcccatgaacgtgcccgagtgaggccgttgctcgtagaggtgaggctttgcagcgagtttcttccagggctgccctcctaacggcaattgtgtattgctgtgaacctgatgagtgatgaatggccccccacccctgtatgtgatgatgttatgttggaaaaattcccagaggattcgaatggattattaatgtatggtaatgacttgaggcccttttgttgtgtgtcttgttatgaatgaatgggtgattgaatctggtgtggtta

SEQ ID NO: 1127 - DNA, 1367 bp, Triticum aestivum
tctcccgcccgagaaaccctagccagaggaaggaggacaccatgagggggaagaagccgctcaaggagctcacactctccgtgccggcgcaggagacgcccgtcgataagttcctgacggcgagcggtacgttcaaggacggtgaactgcgacttaatcaaagaggtttgcagcttatctccgaggaaaacggagatgaacatcaatcaacaaaaatgaaggtggaagatgtgcagttatcaatggatgacctcgagatgattcaggtcattggtaagggaagtggtggtgttgtccaactagtgcggcacaagtgggtgggcacattttatgccttgaagggcattcaaatgaacattcaggagtcggttcgcaaacaaatagtacaggagctcaaaataaatcaagcaacacagagcccacatatagtcctttgccatcaatctttttaccacaatggtgtaatatatcttgttctggaatatatggatcgtggatctcttgcagacataattaaacaagttaaaaccattctggagccatacctcgcagtactttgcaagcaggttttggagggattgttatatcttcatcatgaaaggcatgtgattcacagagacataaagccttctaacttgttagtcaaccataaaggtgaagtaaagattactgattttggggtgagtgcagtgctagcaagttcgattggtcagcgtgatacatttgttggaacctacaactatatggcgcctgagcggattagtggcagctcctatgactacaagagtgatgtatggagtttgggcttggtaatacttgaatgcgccattggtcgcttcccttatactcctccagagggagaaggttggttaagcttctatgaactattggaagcaattgttgaccagccaccaccttctgcacctgcagatcagttctctccagaattctgctcatttatctcttcctgcatacaaaaggaccccgccgagcggatgtctgcttcagaactcttgaaccacgccttcatcaagaagtttgaggacaaggacctagacctccggatccttgtcgagagcctggagcagcccatgaacgtgcccgagtgaggccaccggtcggagaggtgaggctttgcagcgtgtttcttccggggctgccctcccgaacggcaatcgtgtattgctgtgaacctgatgaatgagtgaccccccacccctgtatgttgatgtttatgttggaaagattcccagaggattctcatggacatatacatacacttggatgaaaccatgttgtaatcttgaaaccaacatacatgctacgtacttgttattattgactaggtaattccccatgtgttgcaa

SEQ ID NO: 1128 - DNA, 1414 bp, Triticum aestivum
tcgcaccgacggcgccccggccgctcctctccgtccgtcgtgcctccgctccgcgtccatctcccgccccagaaaccctagccagagggaggaggacaccatgagggggaagaagccgctcaaggagctcaccctctccgtgccggcgcaggagacgcccgtcgataagttcctgactgcgagcggtacattcaaggatggtgaactgcggcttaatcaaagaggtttgcagcttatctccgaggaaaatggagatgaacatcaatcaacaaaaatgaaggtggaagatgtgcagttatcaatggatgacctcgaaatgattcaggtcattggtaagggaagtggtggcgtcgtccaactagtgcggcacaagtgggtgggcacattttatgccttgaagggcattcaaatgaacattcaggagtcagtacgcaaacaaatagtacaggagctcaaaataaatcaagcaacacagagcccccatatcgtcctttgccatcaatctttttaccacaatggtgtaatatatcttgttctggaatatatggatcgtggatctcttgcagacataattaaacaagttaaaaccattctggagccataccttgcagtactttgcaagcaggttttggagggtctgttatatcttcatcatgaaaggcatgtgattcacagggacataaagccatctaacttgttagttaaccataaaggtgaagtaaagattactgattttggggtgagtgcagtgctagcaagttcaatcggtcagcgtgatacatttgttggaacctacaactatatggcgcctgagcggattagtggcagctcctatgactacaagagtgatgtatggagtttgggcttggtaatacttgaatgcgccattggccgcttcccctatactcctccggaaggagaaggttggctaagcttctatgaactattagaagcaattgttgaccagccaccaccttctgcaccagcagatcagttctctccagaattctgctcatttatctcttcctgcatacagaaggaccccgccgaacggatgtctgcttcagaactcttgaaccatgccttcatcaagaagttcgaggacaaggacctagacctgcggatcctcgtcgagagcctcgagcagcccatgaacgtgcccgagtgaggccgtcgctcggagaggtgaggctttgcagcgagtttcttccagggctgccctcctgacggcaattgtgtattgctgtgaacctgatgaatgagtgaccgaccccccacccctgtatgtgatgatgtttatgttggaaaaattcctagaggattggaatggattattaatgtatggtaatgacttgaggcccttttgttgcgcgtcttgttatgaatgaatctggtgtggttagtaaaaaaaaaa

SEQ ID NO: 1129 - DNA, 1388 bp, Triticum aestivum
acaccgacggcgccccggccgctcctctccgtccgtcgtgcctccgctccgcgtccatctcccgccccagaaaccctagccagaggaaggaggacaccatgagggggaagaagccgctcaaggagctcacgctctccgtgccggcgcaggagacgcccgtcgataagttcctgactgcgagcggtacattcaaggatggtgaactgcggcttaatcaaagaggtttgcagcttatctccgaggaaaatggagatgaacatcaatcaacaaaaatgaaggtggaagatgtgcagttatcaatggatgacctcgaaatgattcaggtcattggtaagggaagtggtggcgtcgtccaactagtgcggcacaagtgggtgggcacattttatgccttgaagggcattcaaatgaacattcaggagtcagtacgcaaacaaatagtacaggagctcaaaataaatcaagcaacacagagcccccatatcgtcctttgccatcaatctttttaccacaatggtgtaatatatcttgttctggaatatatggatcgtggatctcttgcagacataattaaacaagttaaaaccattctggagccataccttgcagtactttgcaagcaggttttggagggtctgttatatcttcatcatgaaaggcatgtgattcacagggacataaagccatctaacttgttagttaaccataaaggtgaagtaaagattactgattttggggtgagtgcagtgctagcaagttcaatcggtcagcgtgatacatttgttggaacctacaactatatggcgcctgagcggattagtggcagctcctatgactacaagagtgatgtatggagtttgggcttggtaatacttgaatgcgccattggtcgcttcccttatactcctccggaaggagaaggttggctaagcttctatgaactattggaagcaattgttgaccagccaccaccttctgcaccagcagatcagttctctccagaattctgctcatttatctcttcctgcatacagaaggaccccgccgaacggatgtctgcttcagaactcttgaaccatgccttcatcaagaagttcgaggacaaggacctagacctgcggatcctcgtcgagagcctcgagcagcccatgaacgtgcccgagtgaggccgtcgctcggagaggtgaggctttgcagcgagtttcttccagggctgccctcctgacggcaattgtgtattgctgtgaacctgatgaatgagtgaccgaccccccacccctgtatgtgatgatgtttatgttggaaaaattcctagaggattggaatggattattaatgtatggtaatgacttgaggcccttttgttgcgcgtcttgttatgaatgaat

SEQ ID NO: 1130 - DNA, 1650 bp, Leymus cinereus x Leymus triticoides
  misc_feature (31)..(31): n is a, c, g, or t
  misc_feature (33)..(33): n is a, c, g, or t
  misc_feature (36)..(37): n is a, c, g, or t
  misc_feature (39)..(39): n is a, c, g, or t
  misc_feature (43)..(43): n is a, c, g, or t
  misc_feature (47)..(47): n is a, c, g, or t
  misc_feature (52)..(52): n is a, c, g, or t
  misc_feature (55)..(56): n is a, c, g, or t
  misc_feature (59)..(59): n is a, c, g, or t
  misc_feature (63)..(63): n is a, c, g, or t
  misc_feature (66)..(66): n is a, c, g, or t
  misc_feature (73)..(73): n is a, c, g, or t
  misc_feature (76)..(76): n is a, c, g, or t
  misc_feature (93)..(93): n is a, c, g, or t
  misc_feature (112)..(112): n is a, c, g, or t
  misc_feature (150)..(150): n is a, c, g, or t
  misc_feature (162)..(162): n is a, c, g, or t
  misc_feature (173)..(174): n is a, c, g, or t
  misc_feature (179)..(179): n is a, c, g, or t
  misc_feature (206)..(207): n is a, c, g, or t
  misc_feature (222)..(223): n is a, c, g, or t
  misc_feature (606)..(606): n is a, c, g, or t
  misc_feature (681)..(681): n is a, c, g, or t
  misc_feature (837)..(837): n is a, c, g, or t
  misc_feature (984)..(984): n is a, c, g, or t
  misc_feature (1337)..(1337): n is a, c, g, or t
  misc_feature (1394)..(1394): n is a, c, g, or t
  misc_feature (1409)..(1409): n is a, c, g, or t
  misc_feature (1415)..(1415): n is a, c, g, or t
  misc_feature (1436)..(1436): n is a, c, g, or t
  misc_feature (1454)..(1455): n is a, c, g, or t
  misc_feature (1478)..(1478): n is a, c, g, or t
  misc_feature (1496)..(1496): n is a, c, g, or t
  misc_feature (1506)..(1506): n is a, c, g, or t
  misc_feature (1514)..(1514): n is a, c, g, or t
  misc_feature (1522)..(1522): n is a, c, g, or t
  misc_feature (1527)..(1527): n is a, c, g, or t
  misc_feature (1536)..(1536): n is a, c, g, or t
  misc_feature (1543)..(1545): n is a, c, g, or t
  misc_feature (1553)..(1553): n is a, c, g, or t
  misc_feature (1557)..(1557): n is a, c, g, or t
  misc_feature (1560)..(1560): n is a, c, g, or t
  misc_feature (1568)..(1568): n is a, c, g, or t
  misc_feature (1572)..(1572): n is a, c, g, or t
  misc_feature (1593)..(1593): n is a, c, g, or t
  misc_feature (1599)..(1599): n is a, c, g, or t
gcacgaggccccggccgacctgaccaccccncnccnncngacngcgnctccnctnnccncccnccnccagccnccnccccccgggaactttcntccgaggtcgatccagtgnccggcgagagcgaccgccgcgcggatcgatccagcgancaacctggagcncggctgctgtnncctcncagtcaacccaagtcgcaccacgtgcnnccattttgaccagcnntgccgctgctactaaagtcctcccccggccttcgcaccgacggcgccccggccgctcctccccgtccgccgcgcctccgctccgcgtccatctcccgcccgagaaaccctagccagaggaaggaagagaccatgagggggaagaaaccgctcaaggagctcacgctctccgtgccggcgcaggagacgcccgtcgataagttcctgacggcgagcggtacattcaaggatggcgaactgcgacttaatcaaagaggtttgcagcttatctccgaggaaaacggagatgaacatcaatcaacaaaaatgaaggtggaagatgtgcagttatcaatggatgacctcgagatgattcaggtcattggtaagggaagtggtggcgtngtccaactagtgcggcacaagtgggtgggcacattttatgccttgaagggcattcaaatgaacattcaggagtcngttcgcaaacaaatagtacaggagctcaaaataaatcaagcaacacagagcccacatatagtcctttgccatcaatctttttaccacaatggtgtaatatatcttgttctggaatatatggatcgtggatctcttgcagacataattaaacaagtnaaaaccattctggagccataccttgcagtactttgcaagcaggttttggagggactgttatatcttcatcatgaaaggcatgtgattcacagggacataaagccatctaacttgttagtcaaccataaaggtgaagtaaagattacngattttggggtgagtgcagtgctagcaagttcgatcggtcagcgtgatacatttgttggaacctacaactatatggcgcctgagcggattagtggcagctcctatgactacaagagtgatgtatggagtttggcttggtaatacttgaatgcgccattggtcgcttcccttatactcctccagagggagaaggttggttaagtttctatgaactattagaagcaattgttgaccagccaccaccttctgcacctgcagatcagttctctccagaattctgctcatttatctcttcctgcatacaaaaggatcccgccgaacggatgtctgcttcagaactcttgaaccatgcnttcatcaagaagttcgaggacaaggatctagacctccggatcctcgtcgagagcctngagcagcccatgaangtgccngagtgaggccagaggtgaggntttgcagcgagtttcttnnagggctgccctcctaacggcatngtgtattgctgtgaaccngatgaatgantgaccccncacccctntatgngatgatgtnatgttgnnnaaattccnagangantcgaatgnattnttaatgtatggtaatgacttnaggccnttttgttgtgtgtcttgttatgaatgaatgtggtgtggctagttgtttgta

SEQ ID NO: 1131 - DNA, 1433 bp, Brachypodium distachyon
ccgtcgggaactttcgctaaccaaaatccaaaatcagtccatccgatctccaacctacttcccaactagaccttgggctttgaccagtcccggcgtatccatctcccacccgagaaaccctaaccagaggagaggagaccatgagggggaagaaaccgctcaaggagctcaagctctctgtgccggcgcaggagacatccgtcgataaatttctgacggcgagtggcacattcaaggatggagaactgcgacttaatcaaagaggtttgcggctgatctccgaggaggaaaacggagatgaacatcaatcaacaaacatgaaggtggaagatgtgcagttgtcaatggatgacctcgagatgattcaagtcattggtaagggaagtggtggcgtcgtccaactcgtgcagcacaagtgggtgggcacattttatgcgttgaagggcattcaaatgaacattcaggaggcagttcgcaaacaaatagtacaggagctcaaaataaatcaagcaacacagagcccacatatagtttcttgccatcaatcgttttaccacaatggtgtaatatatcttgttctagaatacatggatcgtggatctcttgcagacataattaaacaagttaaaaccattctggagccatacctcgcagtactttgcaagcaggttttggagggtcttctatatctgcatcatgaaaggcatgtgattcacagggacataaagccatctaacttgttagtcaatcataaaggtgaagtaaagattactgattttggggtaagtgcagtgctagcaagttcgattggccagcgtgatacatttgttggaacctacaactacatggcgcctgagcggataagtggcagctcctatgactacaagagtgacgtatggagtttgggcttagtaatacttgaatgtgccattggccgcttcccctatactccttcagaaggagaaggttggctaagcttctatgaactattagaagcaattgttgaccagccaccacctggtgcacctgcagatcagttctctccagaattctgctcatttatctctgcctgcatacaaaaggatcccgcggaacgcatgtctgcttcagaactcttgaaccatgctttcattaagaagttcgagggcaaggatctagacctacgaattcttgtcgagagccttgaaccacctatgaatgtacctgaataaggatgaggctttgcagtgagtttcagggtcgccctcctgacagcatcacatattcgtcctgaactgtaaaatcttccctaaatgtggtgtatgttcaaaattcccaagaggagtcggattattattaatgtacgactcacggcccttttgttgtgtgcggtcatatgaatctgtgactagttgagcatgagaatacaaggaacctgagatgttgcttgcctt

SEQ ID NO: 1132 - DNA, 1900 bp, Brachypodium distachyon
gagaagcttgctggaaccaggattattttttggccttctgctctaccctaaccccatttccctctttcccccgttcggccgttcccatcgcgagcgactggagactcgagtgagctagtgttcgccgcagcgtgcgtccccggcggccgctccctcccctcccttctcgcgcctcgcagcccctcaagtagctacccgcctctcctgcaagtcccgggccgaccagcaccgctctctcgccgcctccccacgccgcccctcgccgtcggactgcatctccgccgggcccccatctccagatccgcgcgtccccaacctccctccgccagccgccgccgtcgggaccccgacatccagccgtggccgtcgggaactttcgctaaccaaaatccaaaatcagtccatccgatctccaacctacttcccaactagaccttgggctttgaccagtcccggcgtatccatctcccacccgagaaaccctaaccagaggagaggagaccatgagggggaagaaaccgctcaaggagctcaagctctctgtgccggcgcaggagacatccgtcgataaatttctgacggcgagtggcacattcaaggatggagaactgcgacttaatcaaagaggtttgcggctgatctccgaggaggaaaacggagatgaacatcaatcaacaaacatgaaggtggaagatgtgcagttgtcaatggatgacctcgagatgattcaagtcattggtaagggaagtggtggcgtcgtccaactcgtgcagcacaagtgggtgggcacattttatgcgttgaagggcattcaaatgaacattcaggaggcagttcgcaaacaaatagtacaggagctcaaaataaatcaagcaacacagagcccacatatagtttcttgccatcaatcgttttaccacaatggtgtaatatatcttgttctagaatacatggatcgtggatctcttgcagacataattaaacaagttaaaaccattctggagccatacctcgcagtactttgcaagcaggttttggagggtcttctatatctgcatcatgaaaggcatgtgattcacagggacataaagccatctaacttgttagtcaatcataaaggtgaagtaaagattactgattttggggtaagtgcagtgctagcaagttcgattggccagcgtgatacatttgttggaacctacaactacatggcgcctgagcggataagtggcagctcctatgactacaagagtgacgtatggagtttgggcttagtaatacttgaatgtgccattggccgcttcccctatactccttcagaaggagaaggttggctaagcttctatgaactattagaagcaattgttgaccagccaccacctggtgcacctgcagatcagttctctccagaattctgctcatttatctctgcctgcatacaaaaggatcccgcggaacgcatgtctgcttcagaactcttgaaccatgctttcattaagaagttcgagggcaaggatctagacctacgaattcttgtcgagagccttgaaccacctatgaatgtacctgaataaggatgaggctttgcagtgagtttcagggtcgccctcctgacagcatcacatattcgtcctgaactgtaaaatcttccctaaatgtggtgtatgttcaaaattcccaagaggagtcggattattattaatgtacgactcacggcccttttgttgtgtgcggtcatatgaatctgtgactagttgagcatgagaatacaaggaacctgagatgttgcttgccttcgtattttcgcagcctgcttttatgtggttcatattgggagtataaccttaattatgccgtgtcccttatgttttttgcttattatttttgagggaaaaatgtt

SEQ ID NO: 1133 - DNA, 1770 bp, Avena sativa
cgtcgcccccctctcctgctagccgcctcaccctccccgccccaccagcgtcgctcccccactccaccggactgcatcgccgctcctccccccacctccagatccgccttccgccacccgccacagtcgtcgggatcttcgccgtcgaccgggagggagggagaggtcgattcaatccccggcgagagcaacggccgcgcggatcgagccaggcctgaaaaactcggagcgaggctgccgccagtccaccccaggtcgcagcacgtgcccaccattttgaccaaccgtgctgctatttttccgcttctgtcctgccgaaaatcgcgcctcgacctcgctcgctccttcacaccggctgctcctcccccgtccgccgtacccccgagttgtctgggcttttgaccagttccgtacccatctcccgcccgaggaaccctagccggagggagagaccatgagggggaagaaaactctcaaggacctcaagctcgatgtgccggcgcaggagacgcccgtcgacaagttcctgactgcgagcggtacattcaaggatggtgaactgcgacttaatcaaagaggtttgcagcttatctccgaggaaaacggcgatgaacatcaatccacaaacatgaaggtggaagatgtacagttatcaatggatgacctcgagatgatccaggtcattggtaagggaagtggtggtgtcgtccaactagtgcagcacaagtgggtgggcacattttatgccttgaagggcattcaaatgaacattcaagaggcagttcgcaagcaaatagtacaggagctcaaaataaatcaagcaacacagagcccacatatagtttcttgccatcaatcgttttaccacaatggtgtaatatatcttgttctggaatacatggaccgtggatctcttgcagacataattaaacaagttaaaaccattctggagccatacctcgcagtactttgcaagcaggttttggagggtctattataccttcaccatgataggcatgtgattcacagggacataaagccatctaacttgttagttaaccataaaggtgaagtaaagattactgattttggtgtaagtgcagtgctagcaagttccataggtcagcgtgatacatttgttggcacctacaactacatggcgcctgagcggatcagtggcagctcctatgactacaagagtgatgtatggagtttgggcttagtaatacttgaatgtgccattggccgcttcccctatattcctccggaaggagaaggttggttaagcttctatgaactattagaagcaatcgttgaccagccaccaccttctgcacctgcagaccagttctctccagagttctgttcattcatctcttcctgcatacaaaaggatccggctgaacggatgtctgcttcagaactcttgaaccatcctttcatcaagaagttcgagggtaaggatctggacctgaagatcctggtggagaccctggagccacccatgaacgtgccagaataaggtctgtcacctggaggcgtgaggcttcggagtgagtttgagggtgggtcattctgacagcgtcaccacatgtttgtcccggaccgcatcatcttctccctcccctatatgtgaagatgtatgttcgaatttggcatagtcgtcggatcattaatgtatgacttaaggcccttttgttgtgtgtgtgtgtgtgtcttgacatgaacggatctatgactagttgagcatgagaatagaaggaaccccgt

SEQ ID NO: 1134 - DNA, 1921 bp, Oryza sativa
caagaatcgagaatgaagggaataacggtaagtgcccaaggtcattgcctgcgaagacgagatgaccgtgtcccagaatcagccgcatacgtaggcgggccccgcaagttttttgatttttccaactcgtgcgttcccacagagcaacccccctccccatcgtcagcatctttctttctcttcccatcccactcccttccccacacgctctccttccttccttccttcttcgcttcttccgacgccacttcacctctccttcctccctccctcgccgccgcgggctgcttcctccctccctcccgccgcgtcccgccactcccggctgattactcgagccgccgcggggcagatccgtgccgggataggcctctcgctcgcgcttcggtcccccgtctcttaccggcggataaaccctaaccggagaggaggaggagggggaggccatgagggggaagaagccgcacaaggagctcaagctctccgtgcctgcgcaggagacgcccgtcgacaagttcctgaccgcgagtggtacattcaaggatggtgaactgcggcttaatcaaagaggtttgcagcttatatccgaggaaactgcagatgaacctcagtcaacaaacctgaaggtggaagatgttcagttgtcaatggatgaccttgagatgattcaagtcattggtaaggggagtggtggtatcgtccaactagttcggcacaagtgggtggggacattatatgccttgaagggcatacaaatgaacattcaagaggcagttcgcaaacaaatagtacaagagctcaaaataaatcaagcaacacagaacgcacatatagtcctttgccaccaatctttctaccataatggtgtaatatatcttgttctagaatacatggaccgtggatctcttgcagatatcattaaacaagtcaaaacaattctggagccatacctggcagtactttgcaaacaggttttggagggtctactgtatcttcatcatgaaaggcatgtgattcacagggatataaagccatctaacttgttagttaaccgtaaaggtgaagtaaagattaccgattttggggtaagtgcggtgctagcaagttcaatgggtcagcgggatacgtttgttggaacctacaactatatggcgcctgagcgtattagtggaagctcctatgactacaagagtgacatatggagtttgggcttagtaatactcgagtgtgccattggtcggttcccctatataccttcagaaggggaaggttggttaagcttctacgaattattagaagcaattgttgaccagccaccaccctctgcaccagcggaccagttctctccagaattttgtgcatttatctcctcctgcatacaaaaggatcctgcggagcggatgtctgcttcagaactcttgaatcatcctttcatcaagaagtttgaggataaggatttagacctgcgcattcttgtcgagagccttgaacctccaatgaatatatccgagtaacttgtcattgggaggaatgaggttttgtcggtctcttggtagcggcacatgttccctgcatgcgatgtagtgtgtatgatgttgaaaattcgggaggagttgcagtaatgtatcggtataatttttctttacctaaggcccttttgttgcctctttttatggtcctgtgacttgcgagcatgacaatagagggaatcatgatttcaccttcgtattgcatggtgtcttatcgtagttcttgctgcgagtaattggtccccaatgtccttttgatccgtggtcttgcttattgtcggctctacttttggattcagtaccgaaatattacgtgctgtttgaagaacacaacgtgtcttaatgcagcaggaataaaaaacactttggcgctttccaaaaaaaaaaaaaaa

SEQ ID NO: 1135 - DNA, 1583 bp, Oryza sativa
aacccccctccccatcgtcagcatctttctttctcttcccatcccactcccttccccacacgctctccttccttccttccttcttcgcttcttccgacgccacttcacctctccttcctccctccctcgccgccgcgggctgcttcctccctccctcccgccgcgtcccgccactcccggctgattactcgagccgccgcggggcagatccgtgccgggataggcctctcgctcgcgcttcggtcccccgtctcttaccggcggataaaccctaaccggagaggaggaggagggggaggccatgagggggaagaagccgcacaaggagctcaagctctccgtgcctgcgcaggagacgcccgtcgacaagttcctgaccgcgagtggtacattcaaggatggtgaactgcggcttaatcaaagaggtttgcagcttatatccgaggaaactgcagatgaacctcagtcaacaaacctgaaggtggaagatgttcagttgtcaatggatgaccttgagatgattcaagtcattggtaaggggagtggtggtatcgtccaactagttcggcacaagtgggtggggacattatatgccttgaagggcatacaaatgaacattcaagaggcagttcgcaaacaaatagtacaagagctcaaaataaatcaagcaacacagaacgcacatatagtcctttgccaccaatctttctaccataatggtgtaatatatcttgttctagaatacatggaccgtggatctcttgcagatatcattaaacaagtcaaaacaattctggagccatacctggcagtactttgcaaacaggttttggagggtctactgtatcttcatcatgaaaggcatgtgattcacagggatataaagccatctaacttgttagttaaccgtaaaggtgaagtaaagattaccgattttggggtaagtgcggtgctagcaagttcaatgggtcagcgggatacgtttgttggaacctacaactatatggcgcctgagcgtattagtggaagctcctatgactacaagagtgacatatggagtttgggcttagtaatactcgagtgtgccattggtcggttcccctatataccttcagaaggggaaggttggttaagcttctacgaattattagaagcaattgttgaccagccaccaccctctgcaccagcggaccagttctctccagaattttgtgcatttatctcctcctgcatacaaaaggatcctgcggagcggatgtctgcttcagaactcttgaatcatcctttcatcaagaagtttgaggataaggatttagacctgcgcattcttgtcgagagccttgaacctccaatgaatatatccgagtaacttgtcattgggaggaatgaggttttgtcggtctcttggtagcggcacatgttccctgcatgcgatgtagtgtgtatgatgttgaaaattcgggaggagttgcagtaatgtatcggtataatttttctttacctaaggcccttttgttgcctctttttatggtcctgtgacttgcgagcatgacaatagagggaatcatgatttcaccttcgta

SEQ ID NO: 1136 - DNA, 1599 bp, Setaria italica
tccctgtcccgaagaaacaggcttttcctcctcacattcccccggtctactcgccttcttcgtttcttcctccccgagcacgagcagccagccagtcccgtcccaaaccctacagcgccgacgacgacgaggccatgaaggggaagaagccgctcaaggagctcaagctctccgtgccggcgcaggagatccccgtcgacaagttcctgacggcgagtggtacattcaaggatggcgaactgcgccttaatcagagcggcttgcggcttacctccgaggaaaatggggatgaagatgaatcaacaaagctgaaagtggaagatgtgcaattatcaatggatgatcttgagatgattcaagtcattggtaaaggaagtggtggtgttgtccagctagtgaggcacaaatgggtggggacattgtatgccttaaagggtattcaaatgaacattcaggagtcagttcgcaaacaaatagtacaagagctcaaaataaaccaggcaacacagagccctcatatagttttgtgccatcaatctttttaccacaatggtgtaatatatcttgttcttgagtacatggatcgtggatcacttgcagacatcattaagcaagtgaagacagttctggagccataccttgcggtactttgtaagcaggtattggagggtttattatatcttcatcatgaaaggcacgtgattcacagggacataaagccttctaacttgttagtcaaccgtaaaggggaagtcaagattactgacttcggggtaagtgccgtgctagcaagctcagtgggtcagcgagatacttttgttggaacctacaactatatggcgcctgaacgcattagtgggagctcgtatgactacaagagtgacatatggagtttgggcttagtaatacttgagtgtgcaattgggcgattcccctatataccttcagaaggagaaggttggtcaagcttttatgaactactggaggctattgtcgatcagccaccaccttctgcacctgcagatcagttctctccagaattctgctcatttatctcctcttgcatacaaaaggatccagctcagcggatgtctgctgcagaactcttgaatcaccctttcctgaagaagttcgaggataaggatttagacctacggatacttgtggagagcctcgaacctccaatgaatatacccgagtaatcatgtcgtcagccttcaggggtattgagtctttgttgtttcagggtcgaggcggctcttggcatcaggcatctggcatcagcacatattctcctgaactgcaacctccacatgaacgtgccagaacatcattgtatggtcaagtcccttttgactgtttgagcataagaatagagggaatcatgcagcattccttctggtcgccttattgtagctattgttgcgacgggccttgtgattgtgaagctgtgttttacctttttcttattagcaagggatgaatcaaactgaatattcaaaacatgcttgccagtgttctgcgaggaggatacagacgttttgaggtcaaatatgacgcatttcgagtaatcttaaacgtcaatttcgacttctgaga

SEQ ID NO: 1137 - DNA, 1526 bp, Setaria italica
ccttcttcgtttcttcctccccgagcacgagcagccagccagtcccgtcccaaaccctacagcgccgacgacgacgaggccatgaaggggaagaagccgctcaaggagctcaagctctccgtgccggcgcaggagatccccgtcgacaagttcctgacggcgagtggtacattcaaggatggcgaactgcgccttaatcagagcggcttgcggcttacctccgaggaaaatggggatgaagatgaatcaacaaagctgaaagtggaagatgtgcaattatcaatggatgatcttgagatgattcaagtcattggtaaaggaagtggtggtgttgtccagctagtgaggcacaaatgggtggggacattgtatgccttaaagggtattcaaatgaacattcaggagtcagttcgcaaacaaatagtacaagagctcaaaataaaccaggcaacacagagccctcatatagttttgtgccatcaatctttttaccacaatggtgtaatatatcttgttcttgagtacatggatcgtggatcacttgcagacatcattaagcaagtgaagacagttctggagccataccttgcggtactttgtaagcaggtattggagggtttattatatcttcatcatgaaaggcacgtgattcacagggacataaagccttctaacttgttagtcaaccgtaaaggggaagtcaagattactgacttcggggtaagtgccgtgctagcaagctcagtgggtcagcgagatacttttgttggaacctacaactatatggcgcctgaacgcattagtgggagctcgtatgactacaagagtgacatatggagtttgggcttagtaatacttgagtgtgcaattgggcgattcccctatataccttcagaaggagaaggttggtcaagcttttatgaactactggaggctattgtcgatcagccaccaccttctgcacctgcagatcagttctctccagaattctgctcatttatctcctcttgcatacaaaaggatccagctcagcggatgtctgctgcagaactcttgaatcaccctttcctgaagaagttcgaggataaggatttagacctacggatacttgtggagagcctcgaacctccaatgaatatacccgagtaatcatgtcgtcagccttcaggggtattgagtctttgttgtttcagggtcgaggcggctcttggcatcaggcatctggcatcagcacatattctcctgaactgcaacctccacatgaacgtgccagaacatcattgtatggtcaagtcccttttgactgtttgagcataagaatagagggaatcatgcagcattccttctggtcgccttattgtagctattgttgcgacgggccttgtgattgtgaagctgtgttttacctttttcttattagcaagggatgaatcaaactgaatattcaaaacatgcttgccagtgttctgcgaggaggatacagacgttttgaggtcaaatatgacgcatttcgagtaatcttaaac

SEQ ID NO: 1138 - DNA, 1513 bp, Pennisetum glaucum
ccccgttctactcgctttcttcgtttcttcctccccgaggcccgaccacaagcagccagccagtcccggccccgtcccaaaccctacagcgccgacgacgaggaggccatgaaggggaagaagccgctcaaggagctcaagctctccgtgccggcgcaggagacccccgtcgacaagttcctgacggcgagtggtacattcaaggatggcgaactgcgcctcaatcaaagcggcttgcggcttatctccgaggaaaatggtgatgaagatgaatcaacaaagctgaaagtggaagatgtgcagttatcaatggatgatcttgagatgattcaagtcattggtaaaggaagtggtggtgttgtccagctagtgaggcacaaatgggtggggacattgtatgccttaaaggctattcaaatgaacattcaggagtcaattcgcaaacaaatagtacaagagctcaaaataaaccaggcaacacagagccctcatatagttatgtgccatcaatctttttaccacaatggtgtaatatatctagttcttgagtacatggatcgtggatctcttgcggacattattaagcaagtgaagactgttctggagccataccttgcggtactttgcaggcaggtcttggaaggtttgttatatcttcatcatgaaaggcacgtgattcacagggacataaagccttctaacttgttagtcaaccgcaaaggggaagtcaagattactgacttcggggttagtgctgtgctagcaaactcaataggtcagcgagatacttttgttggaacctacaactatatggcgcctgaacgcataagtggaagctcatatgactacaagagtgacatatggagtttgggcttagtaatacttgagtgtgcaattgggcgattcccctatataccttcagaaggagaaggttggttaagcttttatgaattactggaggctattgttgatcagccaccaccttctgcacctgcagatcagttctctccagaattctgctcatttatctcttcttgcatacagaaggatccagctcagcggatgtctgcttcagaactcttgaatcaccctttcctgaagaagtttgaggataaggatttagacctgaggattcttgtggagagcctggaacctccaatgaatatacccgagtaatcatgttgtcagccttcaaggggatatgcctttgttgtttcagcctttcaggatcgccgtcgacgtctcttggcatcaggcatccggaatcagcacgtattctgctgaactgcaacctccacatgaacatgcaacatcattgtatggtcaagtcccatttgactaagttgagcatataagaatagagggaatcatgcagcattccttctggtcgccttgttgtagctattgttgtgatgggccttgtgatttgtgaagctgtgttttacctttttcttattagcaagggatgaattaaattgaatattcaaaacatgcctgccaatgttctgcgcgg

SEQ ID NO: 1139 - DNA, 1557 bp, Panicum virgatum
gaggctttatttccctggtctactcgccttcttcggttcttcctccccgagcacgagcagccagtccggtgactccggtcccgtctctaaccctacagcgccgacgacgacgaggccatgagggggaagaagccgctcaaggatctcaagctctccgtgccggtgcaggagagccccgtcgacaagttcctgacggcgagtggcacattcaaggatggcgaactgcggcttaatcaaagcggcttgcggcttatctccgaggaaaatggggatgaagatgaatcaacaaagctgaaagtggaagatgtgcagttatcaatggatgatcttgagatgattcaagtcattggtaaaggaagtggtggtgttgtccagctagtgaggcacaaatgggtgggtacattgtatgccttaaagggtattcaaatgaacattcaggagtcagttcgcaaacaaatagtacaagagctcaaaataaaccaggcaacacaaagccctcatatagttctgtgccatcaatctttttaccacaatggtgtaatatatcttgttcttgagtacatggatcgtggatctcttgcagacatcattaagcaagtgaagacagttctggaaccataccttgcggtactctgtaagcaggtcttggagggtttattatatcttcatcatgaaaggcacgtgattcacagggacataaagccttctaacttgttagtcaaccgtaaaggggaagtcaagattactgactttggggtaagtgcggtgctagcaagctcaatgggtcagcgagatacatttgttggaacctacaactatatggcgcctgaacgtattagcggaagctcatatgactacaagagtgacatatggagtttgggcttagtaatacttgagtgtgccattgggcggttcccctatataccttcagaaggagaaggttggttaagcttttatgaactacttgaggctattgtcgatcagccaccaccttctgcacctgcagatcagttctctccagaattctgctcatttatctcctcctgcatacaaaaggatccagctcagcggatgtctgcttcggaactcttgaaccaccctttcttgaagaagttcgaggataaggatctagacctgcggggtcttgtggagaccctggaacctccaatgaatatacccgagtaaccctgtcgtcaaccttcagtgtgggtatgcgtgggcttttgttgtgttttcagggtcgtcctggcggacggccctcggcatcaggcatcagcgcatattctcctgaactgcaaccgccacatgaacatgccagaacaccatcgtgtggtccaagtccacaggaatagagggaatcgtgcttcgttccttcttgtcgcctttattgtagctattgttgcgacgtgcgacgggccctgttattgtgaagtcgtgtgttaccttttttttttggtcttgtgagtaagggatgaattgaaatattcacatcatgcttgccaatatgctgcgaagactgccccgccttttaccgaaatttgacctcaaacttcattt

SEQ ID NO: 1140 - DNA, 1602 bp, Sorghum bicolor
accgtgcagtgtcacgggcgtccaggtcccgaaaaaactggcttttctcctccctcccggtctactcgccgagtagtactcctctctactcgccttcttcggttcttcctccccgagcagccacttccgtctctaaccctactgcgacgacgagagcgaggccatgagggggaaaaagccgctcaaggacctcaggctctccgtgccggcgcaggagacccccgtcgacaagttcctgacggcaagtggtacgttcaaggatggtgagctgcggctcaatcaaagtggcttgcgacttatctccgaggaaaatgggggtgaagatgaatcaacaaagctgaaggtggaagatgtgcagttatcaatggatgatcttgagatgattcaagtcattggcaaaggaagtggtggcattgtccagctagtgaggcacaaatgggtggggacattgtatgccttaaagggtatacaaatgaacattcaggagtcagttcgtaaacaaatagtacaggagctcaaaataaaccaagcaacacagtgccctcatatagttatgtgccatcaatctttttaccacaatggtgtaatatatcttgttcttgagtacatggaccgtggatcacttgcagacattgttaagcaagtgaagactgttctggagccataccttgcggtactttgtaagcaggtcttggagggtttattgtatcttcatcatgaaaggcacgtgattcacagggacataaaaccatctaacttgttggtcaaccgtaaaggtgaagttaagattactgacttcggcgtgagtgctgtgctagcaagctcaataggacagcgagatacatttgttggaacctacaactatatggcgcctgagcggattagtggtagttcttatgactacaaaagtgacatatggagtttgggcttagttatacttgagtgtgccattggccggttcccttatataccttcagaaggtgaaggttggttaagcttttatgaactactggaggctattgtcgatcagccaccaccttctgcacctgcagatcagttctctccagaattctgctcatttatctcctcttgcatacaaaaagatccggctcagcggatgtctgcttcagaactcttgaaccacccttttttgaagaagtttgaggataaggatctagacctgcggattctcgtcgaggacctggaacctccaatgaatatacccgaatagcctgccttgttgggtgatgaagcctttgttgtgccttcagggtttgacatcgatgcatctagcagcagggcatctgctcctgaactgcagcctccaattccctacatgaacatgccataacatcgatcattgtatgatccaagacccttgtggctagctgagcataagagcagaggaagtcatgctgcgttccgtatggtcaccttattgtagctattgttgcgttggccttgtgattgcgagtcttgttttaacttttgcagtcttattattggcagacgattcaaaagggacgaactgaatattcaaaacatgcttgccaacatgattcaaggatgctatgttggttcaggatggggaccgggtgggat

SEQ ID NO: 1141 - DNA, 1784 bp, Sorghum bicolor
ccaccgtgcagtgtcacgggcgtccaggtcccgaaaaaactggcttttctcctccctcccggtctactcgccgagtagtactcctctctactcgccttcttcggttcttcctccccgagcagccacttccgtctctaaccctactgcgacgacgagagcgaggccatgagggggaaaaagccgctcaaggacctcaggctctccgtgccggcgcaggagacccccgtcgacaagttcctgacggcaagtggtacgttcaaggatggtgagctgcggctcaatcaaagtggcttgcgacttatctccgaggaaaatgggggtgaagatgaatcaacaaagctgaaggtggaagatgtgcagttatcaatggatgatcttgagatgattcaagtcattggcaaaggaagtggtggcattgtccagctagtgaggcacaaatgggtggggacattgtatgccttaaagggtatacaaatgaacattcaggagtcagttcgtaaacaaatagtacaggagctcaaaataaaccaagcaacacagtgccctcatatagttatgtgccatcaatctttttaccacaatggtgtaatatatcttgttcttgagtacatggaccgtggatcacttgcagacattgttaagcaagtgaagactgttctggagccataccttgcggtactttgtaagcaggtcttggagggtttattgtatcttcatcatgaaaggcacgtgattcacagggacataaaaccatctaacttgttggtcaaccgtaaaggtgaagttaagattactgacttcggcgtgagtgctgtgctagcaagctcaataggacagcgagatacatttgttggaacctacaactatatggcgcctgagcggattagtggtagttcttatgactacaaaagtgacatatggagtttgggcttagttatacttgagtgtgccattggccggttcccttatataccttcagaaggtgaaggttggttaagcttttatgaactactggaggctattgtcgatcagccaccaccttctgcacctgcagatcagttctctccagaattctgctcatttatctcctcttgcatacaaaaagatccggctcagcggatgtctgcttcagaactcttgaaccacccttttttgaagaagtttgaggataaggatctagacctgcggattctcgtcgaggacctggaacctccaatgaatatacccgaatagcctgccttgttgggtgatgaagcctttgttgtgccttcagggtttgacatcgatgcatctagcagcagggcatctgctcctgaactgcagcctccaattccctacatgaacatgccataacatcgatcattgtatgatccaagacccttgtggctagctgagcataagagcagaggaagtcatgctgcgttccgtatggtcaccttattgtagctattgttgcgttggccttgtgattgcgagtcttgttttaacttttgcagtcttattattggcagacgattcaaaagggacgaactgaatattcaaaacatgcttgccaacatgattcaaggatgctatgttggttcaggatggggaccgggtgggatgtgacaataccacttgcagtgctgtttggtttggggataggagggacagggtcatacctcagactcagaggcaatattcgctaggcgtgttaggattcctcgttcctgtttgccttccctacctcgttatcttcccttcaagatttctcctttgtgatttcttatcacattgaatcttta

SEQ ID NO: 1142 - DNA, 1387 bp, Saccharum officinarum
ctcgccttcttgggttcttcctccccgagcagccacttccatctctaaccctacagcgacgacgcgagcgaggccatgagggggaaaaagccgatgaaggagctcaagctctccgtgccggcgcaggagacccccgtcgacaagttcctgacggcaagtggtacgttcaaggacggtgaactgcggctcaatcaaagcggtttgcggcttatctccgaggaaaatggggatgaagatgaatcaacaaagctgaaggtggaagatgtgcagttatcaatggatgatcttgagatgattcaagtcattggcaaaggaagtggtggtgttgtccagctagtgaggcacaaatgggtggggacattgtatgccttaaagggtattcaaatgaacattcaggagtcagttcgtaaacaaatagtacaggagctcaaaataaaccaagcaacacagagccctcatatagttatgtgtcatcaatctttttaccacaatggtgtaatatatcttgttcttgagtacatggaccgtggatcacttgcagacattgttaagcaagtgaagactgttctggagccatatcttgcagtactttgtaagcaggtcttggagggtttattgtatcttcatcatgaaaggcatgtgattcacagggacataaaaccatctaacttgttggtcaaccgtaaaggtgaagtcaagattactgacttcggtgtgagtgctgtcctagcaagctcaataggtcagcgagatacatttgttggaacctacaactatatggcgcctgagcggattagtggtagctcatatgactacaaaagcgacatatggagtttgggtttagttatacttgagtgtgccattggccggttcccttatataccttcagaaggtgaaggttggttaagcttttatgaactactggaggctattgtcgatcagccaccaccttctgcacctgcagatcagttctctccagaattctgctcatttatctcctcttgcatacaaaaagatccggctcagcggatgtctgcttcagaactcttgaatcatccttttttgaaaaagttcgaggataaggatttagacctgcggattcttgtggagaacctggaacctcaatgaatatacccgaatagcctggcgtgttgggtgataaaaccttgttgtgcccttggggttttggcctccatgcccttttgggattaggttcttgaaactggagccttccttacatgaaaatggcaaaacaattgatcatttgatgaaccaaaccccttgtggtttgatgagaacttttaaaagggatcatggctgcattccgtaggggcaccggaattggacctattggtggggaccggcccttggtaaatgggaagctttg

SEQ ID NO: 1143 - DNA, 1686 bp, Avena sativa
ccccactcccccggactgcatcgccgctcctccccccacctccagatccgccttccgccacccgccacagtcgtcgggatcttcgccgtcgaccgggagggagggagaggtcgattcaatccccggcgagagcaacggccgcgcggatcgagccaggcctgaaaaactcggagcgaggctgccgccagtccaccccaggtcgcagcacgtgcccaccattttgaccaaccgtgctgctattttccgcttctgtcctgccgaaaatcgcgcctcgacctcgctcgctccttcacaccggctgctcctcccccgtccgccgtacccccgagttgtctgggcttttgaccagttccgtacccatctcccgcccgaggaaccctagccggagggagagaccatgagggggaagaaaaccctcaaggacctcaagctcgatgtgccggcgcaggagacgcccgtcgataagttcctgacggcgagcggtacattcaaggatggtgaactgcgacttaatcaaagaggtttgcagcttatctccgaggaaaatggcgatgaacatcaatccacaaacatgaaggtggaagatgtacagttatcaatggatgacctcgagatgatccaggtcattggtaagggaagtggtggtgtcgtccaactagtgcagcacaagtgggtgggcacattttatgccttgaagggcattcaaatgaacattcaagaggcagttcgcaagcaaatagtacaggagctgaaaataaatcaagcaacacagagcccacatattgtttcttgccatcaatcgttttaccacaatggtgtaatatatcttgttctggaatacatggaccgtggatctcttgcagacataattaaacaagttaaaaccattctggagccatacctcgcagtactttgaccatgataggcatgtgattcacagggacataaagccatctaacttgttagttaaccataaaggtgaagtaaagatcactgattttggtgtaagtgcagtgctagcaagttcaataggtcagcgtgatacatttgttggaacctacaactacatggcgcctgagcggatcagtggcagctcctatgactacaagagtgatgtatggagtttgggcttagtaatacttgaatgtgccattggccgcttcccctatattcctccggaaggagaaggttggttaagcttctatgaactattagaagcaattgttgaccagccaccaccttctgcacctgcagaccagttctctccagagttctgttcattcatctcttcctgcatacaaaaggatccggctgaacggatgtctgcttcagaactcttgaaccatcctttcatcaagaagttcgagggtaaggatctggacctgaagatcctggtggagaccctggagccacccatgaacgtgccagaataaggtctgtcacctggacgcgtgagaggcctcggagtgagtttgagggtgggttgccattctgacagcgtcaccacatgtttgtcccggaccgcatcatcttctccctcccctatatgtgaagatgtatgttcgaatttggcatagtcgtcggatcattaatgtatgacttaaggcccttttgttgtgtgtgtgtgtgtgtcttgacatgaacggatctatgactagttgagcatgagaatagaaggaaccccgt

SEQ ID NO: 1144 - DNA, 1442 bp, Setaria italica
gtaatggagctgaagctcgcggtgccggcgcaggagacccccgtcgacaaattcctgacggcgagtggtacattcaaggatggtgaactacggcttaatcaaagaggcttgcggcttatctccgaggaaaatggagatgaaaatcaatcgacaaacctgaaggtggaagatgtacagttatcaatggatgatcttgagatgattcaagtcattggtaaagggagtggtggtgttgtccagctagtgcggcacaaatgggtggggacattgtatgccttgaagggtattcaaatgaacattcaggagtcagtgcgcaaacaaatcgtacaagagctcaagattaatcaagcaacacagagtccacatatagttatgtgccatcaatctttttaccacaatggtgtgatatatcttgttcttgagtacatggatcgcggatctcttgcggacatcattaagcaagtgaagactgttctggagccataccttgcagtactttgcaagcaggtattggagggtttgttgtatcttcatcatgaaaggcatgtgattcacagggacataaagccgtctaacttgttagtcaaccgtaaaggtgaagtaaagattactgatttcggggtcagtgcagtgctagcaagttcaatgggtcagcgggatacatttgttggaacctacaactatatggcacctgagaggattagtggaagctcttacgactacaagagcgacatatggagtttgggactggtgatacttgagtgtgccattggccggttcccctatataccttcagaaggagaaggttggataagcttctatgaacttcttgaagcaattgttgatcagccaccaccttctgcacctgcagatcagttctctccagaattctgctcatttatctcctcttgcatacagaaggatccagcagagaggatgtctgcttcagaactcttgaatcaccctttcatcaagaagtttgagggtaaggatttggacctgcggactcttgtggagagcctggagcctccgatgaacatacccgagtagactgccattaggatggatcgatgatccttttgcaatgtattcaggatcaccgtggtggcctcttgatatccgcacatatttctcctgaaccgcgtgcatcatgtccctaatcgtgggatgctgtgtgtatgttcttgattgccgcagaaaaatgtcccatggatcattttgacacccaagctccttttattgtgttccttaatagaatgtttcttgtagcagagtatctcttgaaaaggctctccatctagttcctgatgcattagactggtttcactgtgaatgtttcttgtgacaaatttgatttttcattgtaagttgcatgagtctacgcatcaaatggagggagaaaatgtgatgggagttgaaacaagacagaaaatgcaggatat

SEQ ID NO: 1145 - DNA, 1543 bp, Elaeis guineensis
gataaaaccctagaaacctagcgagggttcgccgccctcgaaatcctagatcatgaagggcccgaagccgttgaagcagctcaaggtcgccgtgccggcccaagaaacccctgtcgacaagttcttgacagcgagcgggacgttcacggacggaggcttgcggctgaatcagagagggttgcggttgatctctgaacaaaccgagaatcgcgtgcggcaaccagatgttaaggaggaggatatgcagttctcgttggaagaccttgagaccattaaagttattgggaaggggagtggaggtgttgttcagcttgtgcggcacaaatggttgggaacactctatgccctaaagggcattcagatgaatattcaagagacagttcgtaaacaaatagttcaagagcttaaaataaatcaagcatcacagtgtccacatgttgttgtttgttaccattctttctaccataatggtgtaatttctcttgtcctggaatacatggatcgaggatctctggctgatgtaattaaacaagtgaaaacaattcttgagccatatctttcagttgtttgcaaacaggttttgaagggtttagtatacctgcaccatgaaagacatgtgattcacagagacataaaaccatcaaacttgttagtaaataacaaaggtgaggtaaagataacggattttggagtgagcgcggtgcttgctaactccatgggtcaacgagatacatttgtaggcacctacaattatatgtcgcctgagcggatcagtggaagctcatatgattataagagtgacatttggagtttgggcttggtaatacttgagtgtgctataggctgctttccttatataccatctgaacaagaggaaggttggccaagcttttatgagcttttggaggctattgtggatcagccaccaccttctgccccatcagatcaattttctccagagttttgttcgtttatatcagcttgcatacaaaaggatcctcatgaaagaatgtcgtctttggagctcttgaatcatccattcatcaaaaagtttgaggagaaagacattgatctggcaatccttgttggcagcttagatcctcctgtagatgtacctggtgatgtgtaattatgtgatggtttctgcataatgtaaaataacaacgggagctaaagatgttgccagttcactttgccctcctgcagctctctggtttgttgctgctctagttgaagtcatgcatatactctgcatgagattcacgcgagcatccacggaggtgcgtaaatgtaccacttagttctccagcaaagagctattaaaatccatattgcgatgtcaatcgctacgcagtaatatatgcggatccagccacggtcaaaaaattggcaatttatattccaatcaaacgcaaaacatgtaagcagtggagtataatttatcagaaagactcgctaggattggatctggaacatctgagtgcaacataagaaatttttatatttcttgttgcactgaacttgttttatctaaaaaatccac

SEQ ID NO: 1146 - DNA, 1845 bp, Triticum aestivum
atcttcactagctctatcttacctcttctcatcgtgttcgcctccgcattgcctgccaactccacctccatggcgctagccggcgccgccaacgccaccttccggccccgcctggtcaccgccgccgctgacacctccgacactaatactcgccgccgccactggaaggccggcgagttcccattccccaccacctccccctcctccggcacgcagcagcgccggagaccccggaccacggagcgcccgcccccacctccaccgtccaagggggaagacccggaggggagagggcgccagaggcactggaaggcgggggaagacccggaggggggagggcgccagagacactggagggcgggcgagttcccggcggcggccgagtcccaatcccagtccgggaggaggggccgcgctcgcacccctatcaagaacgtccagaagaggctcgacgcgcgcgccgatgccaaggcctgggcctgcaccgtcaccgaggccctcgccgaccgcatcgccgccaagaactggcgagaggcgcttcaggtcttcgagatgctcaaggagcaaactttctactatcccaaagagggcacctacatgaagctcctcctgttgctggggagatcaggccagccttctctagcacaacaccttttcaccgagatgcagcagcaaggatgccagccaacacccgagctttacacggccttgatcggagcctactgccggaacggcctcctagacgaggcactcaagcttcttgaagacatgaaagccgccccgctgtgccagcctgatgtctacacctatagtatcctcatcaaggccttcgtggacgcctcaaggttcgacctcgttgatgctatgtacaaagagatggctgagcgctccgtgacacccaacacggtcacgcagaacattgttctcagtggctactgcagagcaggaaggctggacgatatggagaagctactctcggcgatgctcgaaagtgcaaattgtaaaccggatgtctggaccatgaacattatcctaagcctgtttgggaacagtggccaggttgagctgatggagaagtggtatgagaaattccgaggctatgggatcgagccggagactcggacgttcaacattctcattggtgcttacgggaagaagcggatgtatgacaagatgtctgcggtgatggaatacatgcgcaggctagcatttccatggacgaccgccacttacaacaacgtgatcgaggcatttgctgaggctggcgatgcaaagaacatggaggacacatttaaccagatgcgctcagaggggatgaagccggatacaaagaccttctgttgtctcataaacgggtttagcaatgcagcccttttccacaaggtggtaggcatggtaaagcttgctgagaggctcgatgtaccggcaaatacatcttttcacaactctgttcttgcggcatgtgcgaaagcggaggatctgatggaaatggagagggtcttcaggcacatgaagcatatgcagtgtgaaccagatgccatcacatactccatcttgttggaagcttatcggaaggaaggaatgttcgacaagatgtacgctctgcaacaggaaaacccaagtttggtttcgactgagcttgtcatggtgtaactgacctcatgaattgattatggtgttgagttcatctgactggaatgaaaaatccgttcctcttcatgtctggaatccatattgcaaccaagcaaattaactactgccagaaatgtttcatttctgttgacctacaagattagtatgtactccgtccgtcccatattaattgatgctcaaacggatgtatct

SEQ ID NO: 1147 - DNA, 2053 bp, Brachypodium distachyon
tccctgccgattcgtcccccatggcgctcgccgccgctaacgccaccttccgccctcgcctcgtcagcgcctctgccgccgccgacacctccgacacccacacccgccgccgccactggaaggccggcgagttccccttccccaccacctccccttcctcctccggccggagaccccggccgaccaccacgaaggagcgcccgcctccgccgtccaagggcaagaaggaagacccaatcccatccccacaggggagaggccagaggcactggaaggcgggggagttcccggaatcccaatccgggggcagccggtcccgctctcgcacccccatcaagaacatccggaagcggcaggacgcccgctccgacgccaaggcctgggcccccaccgtcaccgaggccctctccgaccgcatcgccgccaagaactggccggaggcgctccaggtgttcgagatgctcaaggagcagcccttctactacccgaaagagggcacctacatgaagctcctgctgctgctgggcaggtccggccagcctgctctggcgcaccgcctcttcgccgatatgcagcagcaagggtgccagccgacaccggagctctacacggcactcatcgccgcctactgccgcagcggcctcctggacgacgcgctccggctgctcggtgacatgaaggccgcgccgctctgccagcccgatgtctacacctacagcaccctcatcaaggccttggtcgacgcctcgaggtttgacctcgtcgacgccatgtacaaagagatggccgaacgcggcgtcgcgcccaacacagtcacgcagaacattgttctcagtgggtacggcagggccgggaggatggacgacatggagaagctgctctctgctatgctcgacagcacggctagtaagccggatgtctggaccatgaacatcatcctcagcctgtttgggaacagtggacaggttgatctcatggagaagtggtatgagaagttccgaggctacgggatcgagcccgagacccggacgctcaacattctcattggtgcttacgggaagaagcggatgtatgacaaaatgtctgcggtgatggagttcatgcgcaagctagcgttcccgtggacgacctccacatacaacaatgtgatcgaagcatttgccgaggccggcgacgagaagaacatggagcaaacatttaaccagatgcgctccgaggggatgaagccggacaccaagaccttctgttgtctcataaacgggtttagcaaagcaggccttttccataaggtggtgggcatggtaaagcttgctgagaggctcgatgtaccagcaaatacgtcttttcacaactctgttctcgcggcatgcgcgagagcaggggatctggtggaaatggagagggtctttaggcacatgaagcatgttcagtgcgctccagatgccacaacatattctatcttggtggaagcttatcggaaggaaggaatgactgacaaggtgtatgatctgcaacaggagaacccgagcctggtttcgactgagcttgtcatggtgtaactgaccccatttacttgattatgatgttgagttcatctaactggtatgatgaaaaagaaaaccgtttttgttcatccgtgtctggaattcataataatgctgtaaagctaattatctactgcccagaattgtttcatgatactataaacctgggatccatttaagataatagacctgatgaagcctcaagagatacagttagtcagttgcaaggatgggtgctacaaatgtctcctggccggctacaaacatcatcagttcaattgttcaaatgcaggtgcttctagcataaacaaagcttgtgtaaaatctatttctagctgcatttgaacctgatgaagacagactgcagcccagaatcttgctggaggaactgaaggtttagatatcactgtaatgtactgattgaagtgtggtcaacactcgataagtatgatctgaaagccgtaccttttatagaacagaagctactgatttgcagtagattgaagttt

SEQ ID NO: 1148 - DNA, 2112 bp, Brachypodium distachyon
attatcttatataagctgctcctctatcttcttcccagtctctcagcgccttcttccctgccgattcgtcccccatggcgctcgccgccgctaacgccaccttccgccctcgcctcgtcagcgcctctgccgccgccgacacctccgacacccacacccgccgccgccactggaaggccggcgagttccccttccccaccacctccccttcctcctccggccggagaccccggccgaccaccacgaaggagcgcccgcctccgccgtccaagggcaagaaggaagacccaatcccatccccacaggggagaggccagaggcactggaaggcgggggagttcccggaatcccaatccgggggcagccggtcccgctctcgcacccccatcaagaacatccggaagcggcaggacgcccgctccgacgccaaggcctgggcccccaccgtcaccgaggccctctccgaccgcatcgccgccaagaactggccggaggcgctccaggtgttcgagatgctcaaggagcagcccttctactacccgaaagagggcacctacatgaagctcctgctgctgctgggcaggtccggccagcctgctctggcgcaccgcctcttcgccgatatgcagcagcaagggtgccagccgacaccggagctctacacggcactcatcgccgcctactgccgcagcggcctcctggacgacgcgctccggctgctcggtgacatgaaggccgcgccgctctgccagcccgatgtctacacctacagcaccctcatcaaggccttggtcgacgcctcgaggtttgacctcgtcgacgccatgtacaaagagatggccgaacgcggcgtcgcgcccaacacagtcacgcagaacattgttctcagtgggtacggcagggccgggaggatggacgacatggagaagctgctctctgctatgctcgacagcacggctagtaagccggatgtctggaccatgaacatcatcctcagcctgtttgggaacagtggacaggttgatctcatggagaagtggtatgagaagttccgaggctacgggatcgagcccgagacccggacgctcaacattctcattggtgcttacgggaagaagcggatgtatgacaaaatgtctgcggtgatggagttcatgcgcaagctagcgttcccgtggacgacctccacatacaacaatgtgatcgaagcatttgccgaggccggcgacgagaagaacatggagcaaacatttaaccagatgcgctccgaggggatgaagccggacaccaagaccttctgttgtctcataaacgggtttagcaaagcaggccttttccataaggtggtgggcatggtaaagcttgctgagaggctcgatgtaccagcaaatacgtcttttcacaactctgttctcgcggcatgcgcgagagcaggggatctggtggaaatggagagggtctttaggcacatgaagcatgttcagtgcgctccagatgccacaacatattctatcttggtggaagcttatcggaaggaaggaatgactgacaaggtgtatgatctgcaacaggagaacccgagcctggtttcgactgagcttgtcatggtgtaactgaccccatttacttgattatgatgttgagttcatctaactggtatgatgaaaaagaaaaccgtttttgttcatccgtgtctggaattcataataatgctgtaaagctaattatctactgcccagaattgtttcatgatactataaacctgggatccatttaagataatagacctgatgaagcctcaagagatacagttagtcagttgcaaggatgggtgctacaaatgtctcctggccggctacaaacatcatcagttcaattgttcaaatgcaggtgcttctagcataaacaaagcttgtgtaaaatctatttctagctgcatttgaacctgatgaagacagactgcagcccagaatcttgctggaggaactgaaggtttagatatcactgtaatgtactgattgaagtgtggtcaacactcgataagtatgatctgaaagccgtaccttttatagaacagaagctactgatttgcagtagattgaagttttgtct

SEQ ID NO: 1149 - DNA, 1661 bp, Triticum aestivum
gaagacccggaggggagagggcggcagaggcactggagggcgggggagttcccggcggcggccgagtcccaatcccagtccgggaggaggggccgcgctcgcacccctatcaagaacgtccagaagaggctcgacgcgcgcgccgatgccaaggcctgggcctgcaccgtcaccgaggccctcgccgaccgcatcgccgccaagaactggcgagaggcgcttcaggtcttcgagatgctcaaggagcaaactttctactatcccaaagagggcacctacatgaaactcctcctgttgctggggagatcaggccagccttctctagcacaacaccttttcaccgagatgcagcagcaaggatgccagccaacacccgagctttacacggccttgatcggggcctactgccggaacggcctcctagacgaggcactcaagcttctcgaagacatgaaggccgccccgctgtgccagcctgatgtctacacttatagcatcctcctcaaggccttcgtcgacgcctcaaggttcgacctcgtcgatgctatgtacaaagagatggctgagcgctccgtgacacccaacacggtcacgcagaacattgttctcagtggctactgcagagcaggaaggctggacgatatggagaagctactctctgcgatgctcgaaagtgcaaattgtaaaccggatgtctggaccatgaacattatcctaagcctgtttgggaacagtggccaggttgagctgatggagaagtggtacgagaaattccgaggctatgggatcgagccggagactcggacgttcaacattctcattggtgcttacgggaagaagcggatgtatgacaagatgtctgcggtgatggaatacatgcgcaggctagcatttccatggacgactgctacatacaacaatgtgatcgaggcatttgctgtggcaggtgatgccaaaaacatggaggacacatttaaccagatgcgctcagaggggatgaagccggatacaaagaccttctgctgtctcataaatgggtttagcaacgcagcccttttccacaaggtggtaggcatggtaaagcttgctgagaggctcgatgtaccggcgaatacgtctttccacaactctgttcttgcggcatgtgcgaaagcggaggatctgatggaaatggagagggtcttcaggcacatgaagcatatgcagtgtgaaccagatgccatcacatactccatcttgttggaagcttatcggaaggaaggaatgaccgacaagatgtacgctctacaacaggagaacccaagtttggtttcgactgagcttgtcatggtgtaactgacctcatgaattgattatggtgttgagttcatctgactgaaatgaaaaatccgttcctcttcatgtctggaattaatagtgcaacctagcaaattaactactgccagaattgttttatttctgttgacctacaagattagtatgtatgataactgtattgctgtaaggacagagaagcttcattatatcaactctcaagtgatatgccactatttagtacctcctttgttccaaataagtgacgtgctttagttcaaattgtttgaactaaatcatgacacttattatggaatggagggagtatacattttgatcctagcagt

SEQ ID NO: 1150 - DNA, 1609 bp, Triticum aestivum
cactggagggcgggcgagttcccggcggcggccgagtcccaatcccagtccgggaggaggggccgcgctcgcacccctatcaagaacgtccagaagaggctcgacgcgcgcgccgatgccaaggcctgggcctgcaccgtcaccgaggccctcgccgaccgcatcgccgccaagaactggcgagaggcgcttcaggtcttcgagatgctcaaggagcaaactttctactatcccaaagagggcacctacatgaaactcctcctgttgctggggagatcaggccagccttctctagcacaagaccttttcaccgagatgcagcagcaaggatgccagccaacacccgagctttacacggccttgatcggagcctactgccggaacggcctcctagacgaggcactcaagcttctcgaagacatgaaagccgccccgctgtgccagcctgatgtctacacttatagcatcctcctcaaggccttcgtcgacgcctcaaggttcgacctcgtcgatgctatgtacaaagagatggctgagcgctccgtgacacccaacacggtcacgcagaacattgttctcagtggctactgcagagcaggaaggctggacgatatggagaagctactctcggcgatgctcgaaagtgcaaatggtaaaccggatgtctggaccatgaacattatcctaagcctgtttgggaacagtggccaggttgagctgatggagaagtggtacgagaaattccgaggctatgggatcgagccggagactcggacgttcaacattctcattggtgcttacgggaagaagcggatgtatgacaagatgtctgcggtgatggaatacatgcgcaggctagcatttccatggacgacagctacttacaacaacgtgatcgaggcatttgctgaggcaggtgatgcaaaaaacatggaggacacatttaaccagatgcgctcagaggggatgaagccggatacaaagaccttctgttgtctcataaacgggtttagcaatgcagcccttttccacaaggtggtaggcatggtaaagcttgctgagaggctcgatgtaccggcaaatacatcttttcacaactctgttcttgcggcatgtgcgaaagcggaggatctgatggaaatggagagggtcttcaggcacatgaagcatatgcagtgtgaaccagatgccatcacatactccatcttgttggaagcttatcggaaggaaggaatgaccgacaagatgtacgctctgcaacaggaaaacccaagtttggtttcgactgagcttgtcatggtgtaactgacctcatgaattgattatggtgttgagttcatctgactggaatgaaaaatccgttcctcttcatgtctggaatccataatgcaaccaagcaaattaactactgccagaattgcttcatttctgttgacctacaagattagtatgtactccgtccgtcccatattaattgacgctcaaacggatgtatctcgacgtatttcagactttcagtgctagatacatccgttcgagtgtcaattaatatgggatggaggtagtatatctcttgataattgtattgctgtaaggacagagaagcttc

SEQ ID NO: 1151 - DNA, 922 bp, Secale cereale
gaccgttgcttcccaatgttcccatggtcaccgtcgctttcggctgcttccttgggttgaacctttgaacgagaggagggcgctttgcgccgttgagctgtggagcacgtgaaaggtcgtgggtgccaaccagcccccacgttcccacccgattagaaaatccccccgctgctttccaacgccacccaccgccgccgccgccgtcaaccaacgccagacgcgccttgtttcccactccacccacgataaagagcaccccctccgctagttggcggccaggctagcccgctcgctccttcgtcctcgtaaccatcgcagcagatccaccggtaggagaaagcaaggaagcgagatccacccaccaatggcggccgctgcttcctccagcgcgtggaaggcgaggtggctccgccccgaggcgtacccgatcttcgcggcgacgggcgtggccgtggggatctgcgtgatgcagctggtgcgcaacatcaccaccaaccccgaggtgagggtgaccaaggagaaccgggcggccggggtgctggacaaccacgacgagggccgccgctacgcgcgccaccccttccggaggttcatcgacggcaagtccgccgagatcatgcccggcatcaacagcttcttcaccgccccaccaaagaactagacgtcgtcgacctcttgtccaagagaggaaccagataattcctccgcgagataatttttttcccttctgaaggaatacagaaataccgttgttttttactcgaattcaagtatattattcgccatggctaattgtctggctgtacaccattgattcttgggatcatacacacaaaccttgatccgaataatccctatatatgtcttgaagaactattgggtgtgtgtgtgcatttttctattaattacaaagtgttcaagt

SEQ ID NO: 1152 - DNA, 543 bp, Secale cereale
tggggaggctagctcgctcgctccatcgtcctcgcaaccatcgcaccagatccaccggtaggagagagcaaggaagcgagatccacctaacccaccaatggcggccgctgcttcctccagcgcgtggaaggcgaggtggctccgccccgaggcgtacccgatcttcgcggcgacgggcgtggccgtggggatctgcgtgatgcagctggtgcgcaacatcaccaccaaccccgaggtccgggtgaccaaggagaaccgggcggccggggtgctggacaaccacgacgagggccgccgctacgcgcgccaccccttccggaggttcatcgacggcaagtccgccgagatcatgcccggcatcaacagcttcttcaccgccccaccaaagaactagaggtcgccgtcgtcgtcggacagctcgttattcttgaagggtggaatcaatcccttcgcgagaaattttttttaatactgaaacggaattacgttttcccccatgaattcaagtattattcgccatgattgattgtcgggcgctgtact

SEQ ID NO: 1153 - DNA, 593 bp, Secale cereale
ggctagcccgctcgctccttcgtcctcgcaaccatcgcagcaccagatccaccggtaggagaaagcaaggaagcgagatccacctaacccaccaatggcggccgctgcttcctccagcgcgtggaaggcgaggtggctccgccccgaggcgtacccgatcttcgcggcgacgggcgtggccgtggggatctgcgtgatgcagctggtgcgcaacatcaccaccaaccccgaggtccgggtgaccaaggagaaccgggcggccggggtgctggacaaccacgacgagggccgccgctacgcgcgccaccccttccggaggttcatcgacggcaagtccgccgagatcatgcccggcatcaacagcttcttcaccgccccaccaaagaactagacgtcgtcgacctcttgtccaagagaggaaccagataattcctccgcgagataatttttttcccttcagaaggaatacagaaataccgttgtttttactcgaattcaagtatattattcgccatgactaattgtctggctgtacaccattgattcttgtgatcatacacacaaaccttgatccgaataatccctatatatgt

SEQ ID NO: 1154 - DNA, 615 bp, Triticum aestivum
ctcgtgccgaattcggcacgaagcttcgtcctcgcaagcatcgcaccagatccaccggtaggagcgagcaagggagatccacctaacccaccaatggcggccgctgcttcctccagcgcgtggaaggcgaggtggctccgccccgaggcgtacccgatcttcgcggcgacgggcgtagccgtggggatctgcgtcatgcagctggtgcgcaacatcaccaccaaccccgaggtccgggtgaccaaggagaaccgggcggccggggtgctggacaaccacgacgagggccgccgctacgcgcgccaccccttcaggaggttcatcgacggcaagtccgccgagatcatgcccggcatcaacagcttcttcaccgacccaccaaagaactagacctggtcgccgtcgccggagacctcttgtccaagccaagaggaaggaaggaattcctccgcgagattttttttcccttctgaaggaatacaggaatactgttgttgtttttcctcgaattcaagtatattattcgccatgactaattgtctggctgtacaccattgattgttgtgatcatacacacaaaactcggcctgaataatccctatatgtcttgaggaa

SEQ ID NO: 1155 - DNA, 742 bp, Triticum aestivum
cgcgccttgcttcctactccaagatcccacgctacgtataaagagcacccctttgctagttggcagccaggctagctctctccttcgtcctcgcaagcatcgcaccagatccaccggtaggagcgagcaagggagatccacctaacccaccaatggcggccgctgcttcctccagcgcgtggaaggcgaggtggctccgccccgaggcgtacccgatcttcgcggcgacgggcgtagccgtggggatctgcgtcatgcagctggtgcgcaacatcaccaccaaccccgaggtccgggtgaccaaggagaaccgggcggccggggtgctggacaaccacgacgagggccgccgctacgcgcgccaccccttcaggaggttcatcgacggcaagtccgccgagatcatgcccggcatcaacagcttcttcaccgacccaccaaagaactagacctggtcgccgtcgccggagacctcttgtccaagccaagaggaaggaaggaattcctccgcgagattttttttcccttctgaaggaatacaggaatactgttgttgtttttcctcgaattcaagtatattattcgccatgactaattgtctggctgtacaccattgattgttgtgatcatacacacaaaactcggcctgaataatccctatatgtcttgaggaactatgcgtgcgtgtgcctttctctatcatcacattcgcaatttgtcatggctgttgacggattgtttc

SEQ ID NO: 1156 - DNA, 539 bp, Festuca arundinacea
  misc_feature (17)..(17): n is a, c, g, or t
  misc_feature (35)..(35): n is a, c, g, or t
  misc_feature (83)..(83): n is a, c, g, or t
  misc_feature (197)..(197): n is a, c, g, or t
  misc_feature (257)..(257): n is a, c, g, or t
  misc_feature (358)..(358): n is a, c, g, or t
  misc_feature (376)..(376): n is a, c, g, or t
  misc_feature (420)..(420): n is a, c, g, or t
  misc_feature (435)..(436): n is a, c, g, or t
caatggcggcggctgcntccagcgcctggaagacnaggtggctccggcccgaggcctacccgatcttcgccgccaccggcgtngccgtcgggatctgcgtcatgcagctcgtgcgcaacatcaccaccaaccctgaagtcagggtgaccaaggagaacagggcggccgggatcctcgacaaccacgacgagggccgncgctactcccgccaccccttcaggaggttcatcgacggcaagtcttccgagatcatgccngccatcaacaacttcttcaccgacccgtcaaagtcgtagacgagtacatcttctcaaggaatggaattctttcacagcaagtttccttcttgaaccaaatnaatgcccattattttccnagaattcaagtattgttattagccatgattgtcttggctgtacnctattaatctttttnntcatataaaagcattgatccgaataatctgcaaggattctgtgcctttctcatttactcatggtgtcgagtaagctctatagtcgacttataatcatggatta

SEQ ID NO: 1157 - DNA, 569 bp, Avena sativa
gcctttccgaaccctacccaccaccgtcacccagaacgcgccgcccaccccctcccatctgtataaaagtccgtcccgtcccccttcggcagccaggctagttatcgcatcgctcgcagatcgacgaccacccgtgtaggaagaggaggaagagaagcaacagcaatggcgggggctgcctccaacgcgtggaagaccagatggctccgccccgaggcctacccgatcttcgcggcgactggcgtggcggtctcgatctgcgtcatgcagctcgtgcgcaacatcaccaccaacccagaagtcagggtcaccaaggagaacagggcggccgggatcctcgacaaccacgacgagggacgacgctactcccgccacccattcaggaggttcatcgacggcaagtcgtccgagatcatgcccgggatcaacagcttcttcaccgacccgccaaagtagacgtacgcgacggaacagcttctccaagaaagaaaggaattctggaatttcctcacaactaatttttccttttaattaaaaactaatttccattgtttattctcaattcaagg

SEQ ID NO: 1158 - DNA, 741 bp, Avena sativa
gcctttccgaaccctacccaccaccgtcacccagaacgcgccgcccaccccctcccatctgtataaaagtccgtcccgtcccccttcggcagccaggctagttatcgcatcgctcgcagatcgacgaccacccgtgtaggaagaggaagaggaggaagagaagcaacagcaatggcgggggctgcctccaacgcgtggaagaccagatggctccgccccgaggcctacccgatcttcgcggcgactggcgtggcggtctcgatctgcgtcatgcagctcgtgcgcaacatcaccaccaacccagaagtcagggtcaccaaggagaacagggcggccgggatcctcgacaaccacgacgagggacgacgctactcccgccacccattcaggaggttcatcgacggcaagtcgtccgagatcatgcccgggatcaacagcttcttcaccgacccgccaaagtagacgtacgcgacggaacagcttctccaagaaagaaaggaattctggaatttcctcacaacaattttccttttattaaaaactaaatttccattgttattattctccaattcaaggggagtactattatttggccatgaatgattgtctggctgtgcgcttttgatcttgtctgatcttattatatacaaacatcgatctgaataatatgtatgtcctgaaaatgtcgtgacttgtataactcaacgtcaagtcatatatttaatatgtcttattataacc

SEQ ID NO: 1159 - DNA, 590 bp, Avena sativa
cgcatcgctcgccgatcgacgacgacccgacccgtgtaggaagaggaccaggagaagcaacagcaatggcgggggcagcctccaacgcgtggaagaccagatggctccgccccgaggcctacccgatcttcgcggcgacgggcgtggcggtctcgatctgcgtcatgcagctcgtgcgcaacatcaccaccaacccggaagtcagggtcaccaaggagaacagggcggccgggatcctcgacaaccacgacgagggacgacgctactcccgccacccattcaggaggttcatcgacggcaagtcgtccgagatcatgcccgggatcaacagcttcttcaccgacccgccaaagtagacgcgacggaacagcggggcccgagatcttcttctccaagaaagaaaggaattctggaatttcctttcacaacaattttcctcttattaaaaactaaatttccatttgtttattctccaattcaaggggagtactattatttggccatgaatgattgtctggctgtgcgctattgatcttgtctgatcttattatatacaaacatcgatctgaataatatgtatgtcctgaagg

SEQ ID NO: 1160 - DNA, 460 bp, Avena sativa
gagaagcaacagcaatggcgggggctgcctccaacgcgtggaagaccagatggctccgccccgaggcctacccgatcttcgcggcgacgggcgtggcggtctcgatctgcgtcatgcagctcgtgcgcaacatcaccaccaacccggaagtcagggtcaccaaggagaacagggcggccgggatcctcgacaaccacgacgagggacgacgctactcccgccaccctttcaggaggttcatcgacggcaagtcgtccgagatcatgcccgggatcaacagcttctcaccgacccacccaagtagacgcgacggaacagcggggcgccgagatcttcttctccaagaaagaaaggaattctggaatttcctttcacaacaattttcctcttattaaaaactaaatttccattgttcattctccaattcaagggggtactattatttggccacgaaaaaaaa

SEQ ID NO: 1161 - DNA, 826 bp, Triticum aestivum
ctcgcacctgtttttgttggctagcatagccacatcctgacaggctgacacgtccatcctccactcctgctccgctttcggttttcagtccacctccctctcctgcatcgaccctgcagtccagagcccggacgcgtgagccacctccgcttccagtagcttctcgaagggaggccgccgatgaccctctgatcgtccgtcgccatgggctgcgccggatccacccctaaatctgacgatagcagtaagaagctgaaaaaaccaaagccttggaagcacactcagtcaataacaccagcacaactcaaacagatgcgcgaagaattctgggacactactcctcactatggtggacagaaagagatctgggatgcacttcgggccgctgcagaagctgatttatctcttgcgcaaaccatagtagacagtgctggcatcattgtctcaaattctgacatgacactctgctacgacgaaagaggtgccaaatacgaactaccaaagtacgttctgagcgagccgactaatttgatccgggagaaatgaattcatagaccacgaaggattcgtgtaaatcatgtaaatctcatttgttcggcaactttagtctttacttgctcaaaacttcaatggagatgccacattcggtttacagttctggtctgagttgttatggacttgtagtgctcgcatctctttctaggccgacacctgagtatggtacactgagctgtcgaaacccagaaataggaaaaatatagaatggcaatgttatatgttttttttcagacaaattgcaatgttatatgtacatttatttaggcaa

SEQ ID NO: 1162 - DNA, 673 bp, Secale cereale
cagtccagagcccagacgcgcgagccacctccgcttccaggagcttcttgaagggtggccgccgatgaccttctgatcgtccgccgccatgggctgcgccggatccacccctaaatctgacgatagcagtaagaagctaaaaaaaaccaagccttggaagcacactcaatcaataacaccagcacaactcaaacagatgcgcgaagaattctgggacactactcctcactatggtggacagaaagaaatctgggatgcacttcgggccgctgcagaagctgatttatctcttgctcaaaccatagtagacagtgctggcatcatcgtctcaaattctgacatgacactctgctacgatgaaagaggtgccaaatacgaactaccaaagtacgttctgagcgagccgactaatttgagccgggaggaatgaattcatagaccacgaaggattcgtgtaaatcatgtaaatctcatttgttcagcggctttagtctttacttgctcaaaacttcaatggaaataccgcactcggtttacaattctggtctgagttggtctgagttgttaacttgttatggattcgtagtactcgcatctctttctaggccgacacctgagtatggtacactgagctgtggaaaccgagaaataggaaaaatttggaattgcaatg

SEQ ID NO: 1163 - DNA, 785 bp, Secale cereale
catgggtaccagctatactcgcaccagtctttgttggctagcatagccacatcctgacaggctgacacgtccatcctcccctcctgctccgctttcggttttcagtccacctccctcttctgcatcgaccctggcagtccagagcccagacgcgcgagccacctccgcttccaggagcttctcgaagggtggccgccgatgaccttctgatcgtccgtcgccatgggctgcgccggatccacccctaaatctgacgataccagtaagaagctgaaaaaaccaaagccttggaagcacactcaatcaataacaccagcacaactcaaacagatgcgcgaagaattctgggacactactcctcactacggtggacagaaagagatctgggatgcacttcgggccgctgcagaagctgatttatctcttgctcaaaccatagtagacagtgctggcatcatcgtctcaaattctgacatgacactctgctacgatgaaagaggtgccaaatacgaactaccaaagtacgttctgagcgagccgactaatttgagccgggaggaatgaattcgtagaccacgaaggattcgtgtaaatcatgtaaatctcatttttttcagcgactttagtctttacttgctcaaaacttcaatggaaataccgcactcggtttacaattctggtctgagttggtctgagttgttatggattcgtagtactcgcatctctttctaggccgacacctgagtatggtacactgagctgtggaaaccgagaaataggaaaaa

SEQ ID NO: 1164 - DNA, 742 bp, Triticum aestivum
atcgaccctgcagtccagagcccggaagcgtgagccacctccgcttccaggagcttctcgaagggggccgccgatgaccctctgatcgtccgtcgccatgggctgcgccggatccacccctaaatctgacgatagcagtaagaagctgaaaaaaccaaagccttggaagcacactcagtcaataacaccagcacaactcaaacagatgcgcgaagaattctgggacactactcctcactatggtggacagaaagagatctgggatgcacttcgggccgctgcagaagctgatttagcacttgcgcaaaccatagtagacagtgctggcatcattgtctcaaattctgacatgacactctgctacgacgaaagaggtgccaaatacgaactaccaaagtacgttctgagcgagccgactaatttgatccgggagaaatgaattcatagaccacgaaggattcgtgtaaatcatgtaaatctcatttgttcggcaactttagtctttacttgctcaaaacttcaatggagatgccacattcggtttacagttctggtctgagttgttatggacttgtagtgctcgcatctctttctaggccgacacctgagtatggtacactgagctgtcgaaacccagaaataggaaaaatatagaatggcaatgttatatgtttttttcaagacaaattgcaatgttatatgtacatttttttaggcaagtgttgtatgtatactttttttt

SEQ ID NO: 1165 - DNA, 555 bp, Avena sativa
aagcgaggccgccgatgatcgtctgatcggccgtcgccatgggctgcgccggatccacccctacatctgacgataccagtaagaagctgaaaaagccaaagccttggaagcacactcaagcaataacaccagcacaactcaaacagatgcgcgaggaattctgggacactactcctcactatggtggacagaaagagatttgggatgcacttcgagccgctgcggaagctgaattatctcttgcacagaccatagtggacagtgctggcatcatcgtctcaaatgctgacatgacactttgctacgacgaaagaggtgccaaatacgaactgccaaagtatgttctgagtgagccaagtaatttgatcaaggaggcatgaagtcatggaccatgaaggattcgtgtaaattatgtatatctcatttttgttcagtgacatttgttgttacttgctcgacacttcaatggagagaccgcacttaggttcagttatagctgttgttgaaccgtgacatgcttatttcataatcggatttacaagattagcctggtaa

SEQ ID NO: 1166 - DNA, 629 bp, Festuca arundinacea
  misc_feature (27)..(27): n is a, c, g, or t
  misc_feature (110)..(110): n is a, c, g, or t
  misc_feature (176)..(176): n is a, c, g, or t
  misc_feature (234)..(234): n is a, c, g, or t
ggcacgaggctccgctttcggttttcngtccaccgccctctcccgcatcgcccctgcagtccagacgagagggccacctccgctcgcagaagcttctcgaagtgaggccnccgatgatcgtctgatcggccgtcgccatgggctgcgccggatccacccctacatctgatgataanagtaagaagctgaaaaagccaaagccttggaagcacactcaggcaataacaccagcanaactcaaacagatgcgcgaggaattctgggacactactcctcactacggtggacagaaagagatttgggatgcacttcgagccgctgcagaagctgaattatatcttgcacagaccatagtggacagtgctggcatcatcgtctcaaattctgacatgacactttgctacgatgaaagaggtgccaaatacgaactaccgaagtatgttctgagtgagccaagtaatttgatcaaggaggaatgaaggcatgcaccatgaaggatttgtgtaaattatgtaaatctcatttgttcagtcacattagtcgttgcttgctcgaaacttcaatggagataccgcacttaggctcaatttgcggttgttgaaccgtgatgtacttatttcataatctgc

SEQ ID NO: 1167 - DNA, 762 bp, Avena sativa
tatccagctgctctttcggttttcagtccgccgccctctcccgcatcgcccctcaagtccagacgcgagaggggcgcatccgcttgcagaagcttctcgaagcgaggccgccgatgatcgtctgatcggccgtcgccatgggctgtgccggatccacccctacatctgacgatatcagtaagaagcttaaaaagccaaaggcttggaagcacactcaagcaataacaccagcacaactcaaacagatgcgcgaggaattctgggacactactcctcactacggtggacagaaagagatttgggatgcacttcgagctgctgcggaagctgaactgtctcttgcacagaccatagtggacagtgctggcatcatcgtctcaaatgctgacatgacactttgctacgatgaaagaggtgccaaatacgaactaccgaagtatgttctgagtgagccaagtaatttgatcaaggaggcatgaagtcatggaccatgaaggattcgtgtaaattatgtatatctcatttttgttcagtgacatttgtcgttacttgctcagatacttcaatggagtcgataccgcaattaggttcagtttgttgttgtttcataatctgatttacaagattagcctggtaatagataaaaacacgaaagaggtaaaagtttgttgaggatatgggattaccataacctggtgagatctcttgccgagagtgccaaacgcaacctcagtttagttctggtacaaaaaaaaaaaaaaa

SEQ ID NO: 1168 - DNA, 652 bp, Avena sativa
ccctctcccgcatcgcccctcaagtgcagacgcgagaggggcgcatccgcttgcagaagcttctcgaagcgaggccgccgatgatcgtctgatcggccgtcgccatgggctgcgccggatccacccctacatctgacgatatcagtaagaagcttaaaaagccaaaggcttggaagcacactcaagcaataacaccagcacaactcaaacagatgcgcgaggaattctgggacactactcctcactatggtggacagaaagagatttgggatgcacttcgagccgctgcggaagctgaattatctcttgcacagaccatagtggacagtgctggcatcatcgtctcaaatgctgacatgacactttgctacgatgaaagaggtgccaaatacgaactaccgaagtatgttctgagtgagccaagtaatttgatcaaggaggcatgaagtcatggaccatgaaggattcgtgtaaattatgtatatctcatttttgttcagtgacatttgttgttacttgctcgacacttcaatggagagaccgcacttaggttcagttatatagctgttgttgaaccgtgacgtgcttatttcataatcggatttacaagattagcctggtaacagataaaaacatgaatgaaagaaggtaa

SEQ ID NO: 1169 - DNA, 971 bp, Oryza sativa
ttctagtcgcagggaacggtgaacgctgctgctccatcgcggtgcatcgagaaggccaaggaaatcggggaaaaagaaatactagtactgacgaattcggccttcggctcggcgccacctctgcacccccgcaccggtttttgttggttagctagctaatcacatgccgagatgcgtccctcccccccactgctgctccacttccccccttttaatccaccgctttttctctcgcatcgtcctctcccccgaacccgcagccgccaatccacacgccagaagccgcgccagcttccagaagcttccccagggggaaggtcgctctcactcatgagcgtctgaccggccgtcgccatgggttgcgccggatccacacctaaaaccgatgataacagcaagaagctgaaaaagcccaagccttggaagcacaatcaagcaataacaacaacacaactcaaacagatgcgtgatgaattctgggacactgctccacattatggtgggcagaaagagatttgggatgcgcttcgagctgctgcagaagctgagttatctcttgcacaaacgatagtggacagtgccggaatcattgtatcaaattctgacatgacaatttgctacgatgaaagaggtgccaaatatgaattaccaaagtatgttctgagtgagccaacaaatttgatcagggaaggctaagtaatataatttgaagggcccatgtaaattatgtaaatctcatttgttcactgacatcagtctttgacttgctcgaaatttgaatgaagatattgttcgcactttaattctggtactcctatatcatcttgacctgactcctgtatacactttattgggctgtaagactacatcaataacagtgagccccgattcacagtaaaagttgacttgttgcgttttcaaacacgcgtgtgagaatgcaataaactttggtgcattagttgttttgatcg

SEQ ID NO: 1170 - DNA, 803 bp, Oryza sativa
gagatgcgtccctcccccccactgctgctccacttccccccttttaatccaccgctttttctctcgcatcgtcctctcccccgaacccgcagccgccaatccacacgccagaagccgcgccagcttccagaagcttccccagggggaaggtcgctctcactcatgagcgtctgaccggccgtcgccatgggttgcgccggatccacacctaaaaccgatgataacagcaagaagctgaaaaagcccaagccttggaagcacaatcaagcaataacaacaacacaactcaaacagatgcgtgatgaattctgggacactgctccacattatggtgggcagaaagagatttgggatgcgcttcgagctgctgcagaagctgagttatctcttgcacaaacgatagtggacagtgccggaatcattgtatcaaattctgacatgacaatttgctacgatgaaagaggtgccaaatatgaattaccaaagtatgttctgagtgagccaacaaatttgatcagggaaggctaagtaatataatttgaagggcccatgtaaattatgtaaatctcatttgttcactgacatcagtctttgacttgctcgaaatttgaatgaagatattgttcgcactttaattctggtactcctatatcatcttgacctgactcctgtatacactttattgggctgtaagactacatcaataacagtgagccccgattcacagtaaaagttgacttgttgcgttttcaaacacgcgtgtgagaatgcaataaactttggtgcattagttgttttgatcg

SEQ ID NO: 1171 - DNA, 722 bp, Festuca arundinacea
  misc_feature (62)..(62): n is a, c, g, or t
  misc_feature (72)..(72): n is a, c, g, or t
  misc_feature (77)..(79): n is a, c, g, or t
  misc_feature (101)..(101): n is a, c, g, or t
  misc_feature (103)..(103): n is a, c, g, or t
  misc_feature (106)..(106): n is a, c, g, or t
  misc_feature (148)..(148): n is a, c, g, or t
  misc_feature (196)..(196): n is a, c, g, or t
  misc_feature (247)..(247): n is a, c, g, or t
  misc_feature (561)..(562): n is a, c, g, or t
  misc_feature (570)..(570): n is a, c, g, or t
  misc_feature (605)..(605): n is a, c, g, or t
  misc_feature (615)..(615): n is a, c, g, or t
  misc_feature (620)..(620): n is a, c, g, or t
  misc_feature (631)..(631): n is a, c, g, or t
  misc_feature (655)..(655): n is a, c, g, or t
ggcacgaggcacatgcggtgccgctgatcgcttccgccccaatccaccgcgctctcctttcncggacgaccngcttnnnccgccgcgagatccggctccgntncgnggagggcggagggctcgtcgcatgagcgtctgatcggcggangccgccatgggctgcgctggatccacgcccaaagtcgatgagagcagnaagaagctaagaaagccaaagccttggaagcacactcaaccaataacaccngcggaactcaagcagatgtgtgatgaattctgggacacagccccacactatggtggacagaaagagatctgggatgcactcagggctgccgctacggaagctgacttgactcttgcacagaccatagtggacagtgctggaatcatcgtttcgaatcccgatcttacagtttgttatgatgagagaggtgccaagtacgagctgcctaattacgttttgagcgagccaacaaatctgatacgtgatggctgaataaaaaattgcagcatcagcacaaaacatatctctggtgcgaaacgatgcgcatttagcgnngcacgttngagaaaagtacatattatagatgtatgtaaattgngtgaaatcgntcatntgggcacttgntcagcatcatattcacatccatgnatgatagaagctcactataatctatgctatttctaggccagggctctagtccttgagctgtatttgt

SEQ ID NO: 1172 - DNA, 678 bp, Setaria italica
attttagcttggttggcaactcccctggagttgctcttctgccgctctctgccttgcccctccacccgcccctcccgccgcgagatccggctccgctcgcagaagcttctcgaacgcccgttccatgagcgtcagatcggccgtcgccatgggctgcgctggatccactcccaaagtcgatgagaacagtaagaagctgaaaaagcccaaggcttggaagcacactcagccaattacaccagcacaactgaaacagatgcgtgatgaattctgggacacggctccgcattatggtggccaaaaagagatttgggatgctcttaaagttgctgcagaatctgatttagcccttgcacaaaccatagtggacagtgctgggatcatcgtttcaaatcctgacatgacgctttgctacgacgagagaggtgccaagtacgagctgccgaagtatgttttgagcgagccaacaaatttgatccgccaaggttgaacgttcatttggtcgctgattctcgattgtaactttcggagacaatgaacctccttttagcactgtatagtaatcttattggtcacgttgtagacctgccactgaaatcgcttatacatggcagtgctgactttgctgcatatatacaacagctccatcagttgcacttgaagggaaaactgcacccc

SEQ ID NO: 1173 - DNA, 634 bp, Setaria italica
cgagatccggctccgctcgcagaagcttctcgaacgcccgttccatgagcgtcagatcggccgtcgccatgggctgcgctggatccactcccaaagtcgatgagaacagtaagaagctgaaaaagcccaaggcttggaagcacactcagccaattacaccagcacaactgaaacagatgcgtgatgaattctgggacacggctccgcattatggtggccaaaaagagatttgggatgctcttaaagttgctgcagaatctgatttagcccttgcacaaaccatagtggacagtgctgggatcatcgtttcaaatcctgacatgacgctttgctacgacgagagaggtgccaagtacgagctgccgaagtatgttttgagcgagccaacaaatttgatccgccaaggttgaacgttcatttggtcgctgattctcgattgtaactttcggagacaatgaacctccttttagcactgtatagtaatcttattggtcacgttgtagacctgccactgaaatcgcttatacatggcagtgctgactttgctgcatatatacaacagctccatcagttgcacttgaagggaaaactgcaccccgtgcctgttacgaaatggcagtcattgtatctgcaa

SEQ ID NO: 1174 - DNA, 739 bp, Pennisetum glaucum
ggctctcacatgccgctgatgcttcgcctctcctactccctcttgcttccactcaataatccgccgctcttgccttccccctccacccgccgctcccgccgcgagatccggcaccacttctagaagcatctggaacgcccgttccatgagcatctgatcggccgtcgccatgggctgcgctggatccactcccaaagtcgatgagaacagtaagaagctgaaaaagcctaaggcttggaagcacacccagccaattacactagcacaactaaaacagatgcgtgatgaattctgggacacggctccgcattatggtggccagaaagagatctgggatgctcttaaagttgctgcagaatctgatttagcccttgcacaaaccatagtggacagtgctgggatcatcgtctcaaatcctgacatgacgctttgctacgacgagagaggtgccaagtacgaactgccgaagtatgttttgagcgagccaacaaatttgatccgcgaaggttgaaccttgaaagaaaacttacaacaagagcagggatatcatgggaatgttcatttggtcgctgattctcgattgtaacttctacaggagacaatgaacctccttttagcaatgtacagtaatcttattggtcacgttgtggacctgccactgaaatcgcttacacattgcagtgctgactttgctgcatatatacaaatacaacagctgcatcagttgcgcttgaagggg

SEQ ID NO: 1175 - DNA, 876 bp, Oryza sativa
ctggctttgccgctcgtatgccgctgaatttgctgctgctgctgatgctttgccgtctcctactcctactcgtccactttattaacccttattaaatccaccgtcctcttcctcgtctcccactactacaccccgcctctcccgccgcgagatccggctccgcttccggaagcttctggaagggcgtcccccccacatgagcgtctgatcgatcggccgtcgtcgccatgggctgcgctggatccactcccaaagttgatgagaacagtaagaagctcaaaaagccaaaaccttggaagcacactcaggcaataacaccaacacaactctcaaagatgcgtgaagaattctgggacacggctccacactatggaggccagaaagagatttgggatgcacttagggctgctgctgaagctgaattacctcttgcacaaaccatagtgaacagtgctgggattgttgtttcaaattctgacatgacgctttgttatgacgagagaggtgccaagtatgaactgcccaagtacgttttgagtgagccaacaaatttgatccgtgaaccgtgatggttgagtgaagatttatgttatgtgaatagaaaaacagatcctgtaaatgatgtaaatcgttcattgatcgctgactcaggactgtatttctcagaacataaatgaagtttaagttactttcgtagttctgcagttactctataattaggctttttctgtgcagcattgtctctgaacttgcttgcgctagagttgtacacttgttacttgtacgacctcattacatatataaacccatatacaggatgttgcactgctgcaacatgctggggttgtgacttgtgatgggaactaacgagtccag

SEQ ID NO: 1176 - DNA, 670 bp, Oryza sativa
gaatttgctgctgctgctgatgctttgccgtctcctactcctactcgtccactttattaacccttattaaatccaccgtcctcttcctcgtctcccactactacaccccgcctctcccgccgcgagatccggctccgcttccggaagcttctggaagggcgtcccccccacatgagcgtctgatcgatcggccgtcgtcgccatgggctgcgctggatccactcccaaagttgatgagaacagtaagaagctcaaaaagccaaaaccttggaagcacactcaggcaataacaccaacacaactctcaaagatgcgtgaagaattctgggacacggctccacactatggaggccagaaagagatttgggatgcacttagggctgctgctgaagctgaattacctcttgcacaaaccatagtgaacagtgctgggattgttgtttcaaattctgacatgacgctttgttatgacgagagaggtgccaagtatgaactgcccaagtacgttttgagtgagccaacaaatttgatccgtgaaccgtgatggttgagtgaagatttatgttatgtgaatagaaaaacagatcctgtaaatgatgtaaatcgttcattgatcgctgactcaggactgtatttctcagaacataaatgaagtttaagttactttcgt

SEQ ID NO: 1177 - DNA, 888 bp, Sorghum bicolor
tgggatagcgagcaaggtgacgtggccgggcacctcacctgcgcgctgacgtcacctcgccggctcttttccccctcacatgccgctgatgcttcgcgtctcctactcgctcctgcttccacctattaatcaaccgcactctcttccctccccgttccacccgcctctcccgccgcgagatccggctccgcttccagaatcttctggaacgggcgttccatgagcgtctgatcggccgccgccatgggctgcgctggatccactcccaaagtcgatgagaacagcaagaagttgaaaaagcctaaggcttggaagcatactcaaccaattacaccagcacaacttaaacagatgcgtgatgaattctgggacactgctccacactatggtggccaaaaagagatttgggatgctctaagagttgccgcagaatctgatttagcccttgcgcaaaccatagtggacagtgctggaatcatcatttccaatcctgacatgacgctttgctacgacgagagaggtgccaagtatgaactgccgaagtatgttttgagcgagccaacaaacttgatccgcgacgggtgaatctggacccccacgagcagggccacgtaaattatgtgaatgttgatttggtcgctgattctgggctgcaactttcagtctttcagagataatgaagcttctttccgcgctgtatagtaatcttattggacatgctgtagacctgccactgaactcggttatacaggagagtgccgactatggtgcatatacatatgtaatcatcagtccatcctttgcacgtggagaaaaactacacatgtgcctgtctgcgaaatgtaagtgtcatttatgtgcaattcgcatcgaagttgctgttgtctt

SEQ ID NO: 1178 - DNA, 742 bp, Avena sativa
ggactcacacagtcacatgccggtgccgctgatcgcttccgcaccaatccaccgcgctctcctttcccaggcccctccgcctcccccgccgcgagatccggctccgcttcgtgttgctccggcgctgggctcgtcgcatgagcgtttgatcggcggccgccgccatgggctgcgctggatccacacccaaagttgatgagagcagcaagaaactaaggaagccaaagccttggaagcatactcaaccaataacaccagctcaagtcaaacagatgcgtgatgaattctgggacacagctccgcactatggtggacagaaagagatttgggatgcacttagggctgctgccacagaagctgatttaacccttgcacagaccatagtggacagcgctgggatcatcgtttcgaatcccgaccttacggtttgttatgatgagagaggtgccaagtacgaactgcccaattatgttctgagcgagccaacgaatttgatccgtgatggctgagtaaagacctgcagcgtcaacataaaacggatatctcttctaatacagaccggacacacatatagaaatgcgtgttcaagaaaaggaaaaaaggacataaaataggatcgtgtaaaatgatgtagtagtaaaattgttcgtttggtcgctggttcttcaggatcatatattcacatcattgtgcattgaagaatataaggtccttcgcacttcgcagttcgctctctacagtc

SEQ ID NO: 1179 - DNA, 760 bp, Avena sativa
ggactcacacagtcacatgccggtgccgctgatcgcttccgcaccaatccaccgcgctctcctttcccaggcccctccgcctcccccgccgcgagatccggctccgcttcgtgtagctccggcgctgggatcgtcgcatgagcgtttgaccggcggccgccgccatgggctgcgctggatccacacccaaagttgatgagagcagcaagaaactaaggaagccaaagccttggaagcatactcaaccaataacaccagctcaagtcaaacagatgcgtgatgaattctgggacacagctccgcactatggtggacagaaagagatttgggatgcacttagggctgctgccacagaagctgatttaacccttgcacagaccatagtggacagcgctgggatcatcgtttcgaatcccgaccttacggtttgttatgatgagagaggtgccaagtacgaactgcccaattatgttctgagcgagccaacgaatttgatccgtgatggctgagtaaagacctgcagcgtcaacataaaacggatatctcttctaatacagaccggacacacatatagaaatgcgtgttcaagaaaaggaaaaaaggacataaaataggatcgtgtaaaatgatgtagtagtaaaattgttcgtttggtcgctggttcttcaggatcatatattcacatcattgtgcattgaagaatataaggtccttcgcacttcgcagttcgctctctacagtcaaaaaaaaaaaaaaaaaa

SEQ ID NO: 1180 - DNA, 735 bp, Setaria italica
gtatccgccgagacccgcaccggtttgttgggtagcagcgtgcgcgaccacctaccgatgcctccgccccgtccaccgccccccactcctgctccgtgtccgctttttcagttctccacagctctctcgcacgtcctcccaagtctcatccctccgcccgcggcgcccgcctctgcgtccagaggagggaggtggtcgccgatgaccgtttgatcggccgtcgccatgggatgcgccggatccactccaaagactgacgataatggtaagaagctgaaaaaaccaaagccttggaagcacacccaagcaataactctggcacaactcagacagatgcgtgatgaattttgggacacagctcctcactatggtggacagaaagagatttgggacgcacttagagctgctgcagattctgatttagcacttgcacagaccatagtggatagtgctggcatcatcgtatcaaattctgacatgacactttgctatgatgaaagaggtgccaaatatgaacttccaaagtatgttctaagcgagccgacaaacttgattcgggaaggttaaattcatagaatgtaaatggtccaatgtaaattatgtaaatcacatttattcactgacacaaatcttgaactgattggaactgcaataaagttatgtaccaaatttctgatttcagctgttctccttctagtcacttttcctggattgtagcgcattgaactctcatac

SEQ ID NO: 1181 - DNA, 589 bp, Setaria italica
ctccgtgtccgctttttcagttctccacagctctctcgcacgtcctcccaagtctcatccctccgcccgcggcgcccgcctctgcgtccagaggagggaggtggtcgccgatgaccgtttgatcggccgtcgccatgggatgcgccggatccactccaaagactgacgataatggtaagaagctgaaaaaaccaaagccttggaagcacacccaagcaataactctggcacaactcagacagatgcgtgatgaattttgggacacagctcctcactatggtggacagaaagagatttgggacgcacttagagctgctgcagattctgatttagcacttgcacagaccatagtggatagtgctggcatcatcgtatcaaattctgacatgacactttgctatgatgaaagaggtgccaaatatgaacttccaaagtatgttctaagcgagccgacaaacttgattcgggaaggttaaattcatagaatgtaaatggtccaatgtaaattatgtaaatcacatttattcactgacacaaatcttgaactgattggaactgcaataaagttatgtaccaaatttctgatttc

SEQ ID NO: 1182 - DNA, 895 bp, Zea mays
aactcacctgcgcggtgacagcacctcgccggcttttcttccctcaggcttgcactttgcacagcctctcacatcacatgccgctgatgcttcgcgtctcctactccttcctgcttccacctattaatccaccccactctcttccctccccgttccacccgcctctaccgccgcgagatccggctccgcttccagaagcttctggaacgcccgttccatgagcgtctgatcggccgccgccatgggctgcgctggatccacccccaaagtcgacgagaacagcaagaaactgaaaaggcctaaggcttggaagcatacccaaccaattacaccggcacggctgaaacagatgcgtgatgagttctgggacacggctccgcactacggaggccaaaaagagatctgggatgctctgagggttgccgcggagtccgatctagcccttgcacagaccatcgtggacagtgctggaatcatcgtgtcgaaccctgacatgacgctctgctacgacgagagaggcgccaagtacgagctgcccaagtatgtcttgagcgagccagcgaacctgatccgcgacgggtgattctggaccccaaaaggttttgcagcagcacgaaacagggccacgtgaatttatgcggatggttgattcggtcgctggttctggattgtaactttcagggacagtgaaagctcgtttcagcgctggatgttgtatagtgatgttattggacacgatgtgtagtctctagacctgctactgctgaactcggtcattcagggacagtgaatgcagtgtcgtttaggctatatgctgcagacttattcacctcatatttcagacttcagacttaactgtatctatataaatagtgcagtttgcactcatatttca

SEQ ID NO: 1183 - DNA, 652 bp, Pennisetum glaucum
gcacgatgcaccgtagtctcccgctccatcacctcctccccgagcgcctccacggggtcgcccacccaccccacttgccgctttttcagttctccacagctctctcgcacgcccctccccgtccgcggtgccccgcctccgctttccagtccagaagcgtccggaggggggttcggccgccgccgatgaccgtttgatcggccgccgccatgggatgcgccgggtccaccccaaagactgacgataatggtaagaagctgaaaaaaccaaagccttggaagcacacccaagcaataactccggcacaactcagacagatgcgtgatgaattttgggacacagctcctcactatggtggacagaaagagatttgggatgcgcttagagctgctgcagattctgatttagcacttgcacagaccatagtggatagcgctggcatcatcgtatcaaattctgacatgacactttgttatgatgaaagaggtgccaaatatgaacttccaaagtatgttctaattgagccgacaaacttgatccgggaaggttaaattcatagaaagtaaatggtccagtgtaattatgtaaatcacatttattcactgacacaaatcttgaactgattggaactgcaataaagatatgtaccaaa

SEQ ID NO: 1184 - DNA, 561 bp, Saccharum officinarum
aagtcatcccatccctacgcccgcggtcgcgccaccgagtccagaagcttccagaagggggaggtggtcgcccatgaccgtctgatcgaccttcgccatgggatgcgctggatccactccaaagactgacgataatggtaagaagttgaaaaaaccaaagccttggaagcacacccaagcgataacgccggcacaactcagacagatgcgtgatgaattttgggacactgctcctcactatggtggacagaaagagatttgggacgcacttagagctgctgcagattctgatttagcacttgcacaaaccatagtggatagcgctggcatcattgtatcaaattctgacatgacactttgctatgatgaaagaggtgccaaatatgaacttccaaagtatgttctaagcgagccaacaaatttgatcagggacggttaaattcataaaataaaagtgggtccaatgtaaattatgtaaatcgcatttattcactgacatcaaccttgatctgattggaacttcaataatattatatgatgtggcagattctgatttcaaaa

SEQ ID NO: 1185 - DNA, 799 bp, Panicum virgatum
cacattcacctcacatgcccgctgatgcttcgcgtctcctactccctcctgcttccacttattaatccgccgctctctgccttccccctccacccgcctctcccggcgcgagatccgtctgcgcttccagaagcttctggaacgcccgtccgatgagcgtctgatcggccgtcgccatgggctgcgctggatccactcccaaagtcgatgagaacagtaagaagctgaaaaagcctaaggcttggaagcacactcaaccaattacatcagcacaactcaaacagatgcgtgatgaattctgggatacggctccgcattatggtggccaaaaagagatatgggatgctcttaaagttgctgcagaatctgatttagcccttgcccaaaccatagtggacagtgctgggatcatcgtttcgaaccctgacatgacactttgctacgacgagagaggtgccaagtatgaactgccgaaatatgttttgagcgaaccaactaatttgatccgcgacggttgaatcttgaatgaagacttagaagacaaacagagggccacgtgaattatgttaaaatgttcatctggtcgctgggctctgattgcaacttttggggtcaacgacctcattttagccactgtaaagtaattcttcttgggccttgtttagttgctgggtgtaaagtttttgaaagagaatatttctatatttgaagtactaaatatagactaatcacaaaactaattacagaactcgtcttgcgatttgcagacaaactgtgcaatgcattttttatttcgtct

SEQ ID NO: 1186 - DNA, 658 bp, Panicum virgatum
acctacagatgcatccgccaccgcccccactcctgctccgcttttcagttccccaccacagctctctcgcacgtcctcccaagtctcatccctccgcccgcggcgcccgcctccgcatccagtccagaagcgtctagagggggatccgccgtcgccgatgcccgtctgatcgggccgtcgccatgggatgcgccggatccactccaaagactgacgataatggtaagaagctgaaaaaaccaaagccttggaagcacacccaagcaataactccagcacaactcaaacagatgcgtgatgaattttgggacactgctcctcactatggtggacagaaagaaatttgggatgcacttagagctgctgcagattctgatttggaacttgcacagaccatagtggatagcgctggcatcatcgtatcaagttccgacatgacactttgctatgatgaaagaggtgccaaatatgaacttccaaagtatgttctaagtgagccgacaaacttgatcagggatggttaaattcgtatagtagaatataaatgatccaatgtatattatgtaaatctcatttaactgacacgaatcttgacctgattgggactttaataaagttacaatgtaccggaattccgatttcggctgttctccttaaa

SEQ ID NO: 1187 - DNA, 708 bp, Triticum aestivum
cctgatcggcggcggccatgggctgcgctggatccacacccaaagttgatgagagcagtaagaatctaaggaagcctaagccttggaagcacactcagccaataacaccagcgcaactcaaacagatgcgtgatgaattctgggacacagctccacactatggtggacagaaagagatttgggacgcactcagggccgctacagacgccgatttaacccttgcgcagaccatagtggacagtgccggaatcatcgtatcgaatcctgacctcacgctttgttacgacgagagaggtgcaaagtacgagctgcccaattacgttctgagtgagccgacaaacctgatccgtgatggctgaacaaataaaaactcggcgtcggcataaaacggacgcttgatacagaaacgatgctcgtctagacgtgcacacgtttgaggagagtagtacataaagctggtccgtgtaagttacgtaaaatcgttggtttgtcgctggttcggggtcgtgttcatatcatatcggtggaatgaatcatggaagggtcattggctatcaacagtcacgctgctggctattgctatttgctagggcggttgtagtccttgagctatctatctactcctttcctctgtcctgctgaagggagctgcaccagtggtgtcgctgtgattttgatccatgcgttgcgcttgctgattgctctata

SEQ ID NO: 1188 - DNA, 968 bp, Triticum aestivum
ccttgactctcgtcactctgccgctgatcctcggcgtctcgcttccgctgcaatccaccgtgctctatctcctttcccggtcccaggggcggagcctccgcttgctcccgccttgaagattcgatcgtcgcctgaatcctgatcggcggcggccatgggctgcgctggatccacactcaaagttgatgagagcagtaagaatctaaggaagcctaagccttggaagcacactcagccaataacaccagcgcaactcaaacagatgcgtgatgaattctgggacacagctccacactatggtggacagaaagagatttgggacgcactcagggccgctacagacgccgatttaacccttgcgcagaccatagtggacagtgccggaatcatcgtatcgaatcctgacctcacgctttgttacgacgagagaggtgcaaagtacgagctgcccaattacgttctgagtgagccgacaaacctgatccgtgatggctgaacaaataaaaactcggcgtcggcataaaacggacgcttgatacagaaacgatgctcgtctagacgtgcacacgtttgaggagagtagtacataaagctggtccgtgtaagttacgtaaaatcgttggtttgtcgctggttcggggtcgtgttcatatcatatcggtggaatgaatcatggaagggtcattggctatcaacagtcacgctgctggctattgctatttgctagggcggttgtagtccttgagctatctatctactcctttcctctgtcctgctgaagggagctgcaccagtggtgtcgctgtgattttgatccatgcgttgcgcttgctgattgctctatatagcaatcataatggggacagactgcttgattgctgcttcttgatttgtccctttaaactggtcctatgaaactgtaccaacaccactgttgttgtactgcccaaataatttgcttttacgta

SEQ ID NO: 1189 - DNA, 952 bp, Hordeum vulgare
gatcctattcgtctcgcctccgctgcaatccaccgcgctcgcctttccggctcctcccgccgcgagatccggctccgcctccgccgcgcgtcgtccgatcgcctggtcgatcggcggccatgggctgcgccggatccacgcccaaagtcgatgagagcagtaagaacctaaggaagcctaaaccttggaagcacacccagccaataacaccagcgcaactcaaacagatgcgtgatgaattctgggacacggctccacactatggcggacagaaagagatttgggatgcgcttcaggccgcgacagaagctgatttaactcttgcgcagaccatagtggacagtgctggaatcatcgtttcgaatcctgacctcacgctttgttacgacgagagaggtgcgaagtatgaactgcctaattatgttctgagtgagcccacaaacctggtccgtgatggctgaagaaatacaaacttgacaacgtctacattaagcaaatgtctggtacgtatcaacgtgtgttcagcggcgcatgttctgaggagagtagtacataaagcagatccgtgtgtaagttaggtgaaatctttggaggaggtcgctggtttggggtcgtattcgtattcatatcgatggaatgaaatcatggaaggtcattggccatcaacggttaggccgttggctattgctaagaccctgttgcacggcggttgtggtccttgagctgtcgtctatgtactccgttactctgtcctgctggagagagctgcagcactactgtcactgactttgatccatgcgttgcgcttactgaatgttctatatatagcaataataatgtggacatagtgattgattgcttcttgatttgtcccttgaaactggtcctgtggaactgtaccaacatcgatgctgttgtattgcccaaataatttgctttcaatactctgtgc

SEQ ID NO: 1190 - DNA, 966 bp, Hordeum vulgare
gatcctattcgtctcgcctccgctgcaatccaccgcgctcgcctttccggctcctcccgccgcgagatccggctccgcctccgccgcgcgtcgtccgatcgcctggtcgatcggcggccatgggctgcgccggatccacgcccaaagtcgatgagagcagtaagaacctaaggaagcctaaaccttggaagcacacccagccaataacaccagcgcaactcaaacagatgcgtgatgaattctgggacacggctccacactatggcggacagaaagagatttgggatgcgcttcaggccgcgacagaagctgatttaactcttgcgcagaccatagtggacagtgctggaatcatcgtttcgaatcctgacctcacgctttgttacgacgagagaggtgcgaagtatgaactgcctaattatgttctgagtgagcccacaaacctggtccgtgatggctgaagaaatacaaacttgacaacgtctacattaagcaaatgtctggtacgtatcaacgtgtgttcagcggcgcatgttctgaggagagtagtacataaagcagatccgtgtgtaagttaggtgaaatctttggaggaggtcgctggtttggggtcgtattcgtattcatatcgatggaatgaaatcatggaaggtcattggccatcaacggttaggccgttggctattgctaagaccctgttgcacggcggttgtggtccttgagctgtcgtctatgtactccgttactctgtcctgctggagagagctgcagcactactgtcactgactttgatccatgcgttgcgcttactgaatgttctatatatagcaataataatgtggacatagtgattgattgcttcttgatttgtcccttgaaactggtcctgtggaactgtaccaacatcgatgctgttgtattgcccaaataatttgctttcaatactctgtgcctgtccatccaagc

SEQ ID NO: 1191 - DNA, 554 bp, Panicum virgatum
ctccgaagtctcatccctcagcccgcggcgcccgcctccgcttctagtccagaagcgtctacagggggaggccgtcggccgatgaccgtctgatctgctgtcgccatgggatgcgccggatccactccaaagactgacgataatggtaagaagctgaaaaaaccaaagccttggaagcacacccaagcaataactccagcgcaactcagacagatgcgtgatgaattttgggacactgcccctcactatggtggacagaaagaaatttgggatgcacttagagctgctgcagattctgatttggcacttgcacagaccatagtggatagcgctggcatcatcgtatcaagttccgacatgacactttgctatgacgaaagaggtgccaaatatgaacttccgaagtatgttctaagcgaaccgacaaacttgatcagggatggttaaattcgtatagaatataaatgatccaatgtatattatgtaaatctcatttaactgatacgaaccctgacctgattgggaccttcaaataaagttacaatgtaccggaa

SEQ ID NO: 1192 - DNA, 695 bp, Triticum aestivum
cctgatcggcggcggccatgggctgcgctggatccacactcaaagttgatgagagcagtaagaatctaaggaagcctaagccttggaagcacactcagccaataacaccagcgcaactcaaacagatgagggacgaattctgggacacagctccacactatggtggacagaaagagatttgggacgcactcagggccgctacagacgccgatttaactcttgcgcagaccatagtggacagtgctggaatcatcgtttcgaatcctgacctcacgctttgttacgacgagagaggtgcaaagtacgagctgcccaattacgttctgagtgagccgacaaacctgatccgtgatggttgaacaaataaaaactcggcgtcgacataaaacggacgtgcacacgtttgaggagagtagtatataaagcagatcgatccgtgtaagttacgtaaaatcgttcatttgtcactggttcggggtagtattcatatcatatcgatggaatgggtcgtagaaggtcattggctatcaacagttaggctgctggctattgctatttgctaggccctgttgcagggctgttgtagtccttgagctgtctatatgtacccctttcctctgtcctgctgaagagagctgcaccagtggtgtcactgtgattttgacctatgcgttgcgcttgcgggttgctctata

SEQ ID NO: 1193 - DNA, 946 bp, Secale cereale
tacgccgctgatcctcggcgtctcgcttccactgcaatccaatccacggcgctcaatctcaggggaggagcctccgcttcctccgccgcgagatccggctccgcctcgaggactcgctcgcccgtccgatcgcctggtcggcggcggccatgggctgcgctggatccacgcccaaagttggcgagagcagtaagaatctaaggaagcctaagccttggaagcacagtcagccaataacaccagcgcaactcaaacagatgcgtgatgaattctgggatacagctccacactatggtggacagaaagagatttgggatgcacttagggccgctgcagacgccgatttaactcttgcgcggaccatagtggacagtgccggaatcatcgtttcgaatcctgacctgacgctttgttacgacgagagaggtgcaaagtacgagctgcctaattacgttctgagtgagccaacaaacctggtccgtgaaggctgaacaaatatatagaaacttcactcaacgtcttgtatagatgtctgattcgaatcgacgcgcgtttggcggtgcgcgctcgaggagagcgcataaaacagatccgtgcaggttcaggttgcatagggtagttggttcttcgctggtcccgggttgtattcatgcggatggaatgaatcatggaagggtcattggccatcagcagttaggccgttggctattgctaggctctgttgcagggtggttgtagtccttgagctgtcctgctgaagagagcttcagcagtactgtctgtcgctgatcttgatccatgcgttgcgcttgctgattgctctatgtatagcaataataataacggggacagagtgcttgattgcttcttgatttgtccctgtaaactggtccaatgaaactgtaccaacaccaatgttgttgtattgcccaaataatttgctttc

SEQ ID NO: 1194 - DNA, 717 bp, Musa acuminata
ggacctcgaggcagaagcttccccctcccgactccgaccccgactcctcttccctttcccatctcgagatcctcggcggagcccgaggcgccgaccaccgcaatctccgccccttcttgcccttctccctcttcggcagtgggtcccgatggtctgatctcccttctctccccgatcgcggctgggtagaattgggggcgcatcaggatgggctgcgctggatccactcccgccaaaggagacgagaatactaaaaaacttcaaaaaccaaagccctggaagcatacacagcaaataactcgcgcacagctcaagcagatgcgcgatgaattctgggatacagcccctcactatggcggccaaaaagaaatatgggatgcactccgagctgcagcagaagctgatttagaccttgcacaagctatcgtcgacagtgcaggcataattattccaaatgctgacatgactctttgttatgatgaaagaggtgccaaatatgaactaccaaagtatgttttaagtgagcctaccaacttgattcgagacagctgatcaaaaagggtgaagtgctcaagcatcaatgtagatcatgtaaattactcgacttccaacatctgttgggcacagtttgtgcttttgtgaagagaaagatttcattagttgacttgtcaagcttcctttcaagcaaacttgaccgtcgagtgaacaatagtgcgc

SEQ ID NO: 1195 - DNA, 695 bp, Panicum virgatum
ccacttattaatccgccgctctctgcctttacccctccacccgcctctcccggcccgagatccgggctgcgcttccagaagcttctggaacgcctgtcccatgagcgtctgatcgggcgtcgcaatgggctgcgctggatccactcccaaagtcaatgagaacaataagaagctgaaaaagcctaaggcttggaagcacagtcaaccaattacaccagcacaactcaaacagatgcgtgatgaattctgggacacggctccgcattatggtggccaaaaagagatattggatgctcttaaagttgctgcagaatctgatttagcccttgcacaaaccatagtggacagtgctgggatcatcgtttcgaaccctgacatgacgctttgctacgacgagagaggtgccaagtatgaactgccgaaatatgttttgagcgaaccaactaatttgatccgcgacggttgaatattgattgaagacttagaagacaaaacagagggccacgtaaattatgttaaaatgtccatctggtcgctgactctggttgcaactttcggggtcaacgacctcattttagccactgtatagtaaatcttattggttacgtcgtagacctgccacagaagtcgcttataccggagagtgctgactttgctgcatatatattctaccaatccatctgttgtgcttggag

SEQ ID NO: 1196 - DNA, 741 bp, Brachypodium distachyon
gccactcacatgccgctgaaggcctgaagctgatgcttcgcgtcaccggttctcctctgcttcaactttaacccaccgccctcgctctccttccccacgccccccgccgcgagatccggctccgcgcccagaagcttctggaggggctcgccgcatgtgcgcctgatcggcgaccgccgccatgggctgcgctggatccaaacccagagttgatgagagcggaaagaagctaagaaagccaaagccttggaaacatactcaaccattaacaccagctcaactcaaacagatgcgtgatgaattctgggacacagctccacactatggtggccagaaagagatttgggatgcgcttagggctgccacagaagctgatttacctcttgcccaaacaatagtggacagtgctggggtcatcgtctcgaattctgaccttacgctttgttacgatgagagaggtgcgaagtatgaactacccaagtatgttttgagtgagccaacaaacctgatccccgtcggctgaataagtacttgcaagatgaacatagaatagtctctagtacaaacatatatacgagtgttcgagaaagggaaaaacagaaaacagatccatgtaaatgatataagatcgcttgtttggtcgcctgattcagggtcatattcacatccacgaactagaagtgctctatggttatatgctgtttgctaaactgaaccgatattgtcaccgattctggtcta

SEQ ID NO: 1197 - DNA, 939 bp, Brachypodium distachyon
ttgcactctcgctccgccactcacatgccgctgaaggcctgaagctgatgcttcgcgtcaccggttctcctctgcttcaactttaacccaccgccctcgctctccttccccacgccccccgccgcgagatccggctccgcgcccagaagcttctggaggggctcgccgcatgtgcgcctgatcggcgaccgccgccatgggctgcgctggatccaaacccagagttgatgagagcggaaagaagctaagaaagccaaagccttggaaacatactcaaccattaacaccagctcaactcaaacagatgcgtgatgaattctgggacacagctccacactatggtggccagaaagagatttgggatgcgcttagggctgccacagaagctgatttacctcttgcccaaacaatagtggacagtgctggggtcatcgtctcgaattctgaccttacgctttgttacgatgagagaggtgcgaagtatgaactacccaagtatgttttgagtgagccaacaaacctgatccccgtcggctgaataagtacttgcaagatgaacatagaatagtctctagtacaaacatatatacgagtgttcgagaaagggaaaaacagaaaacagatccatgtaaatgatataagatcgcttgtttggtcgcctgattcagggtcatattcacatccacgaactagaagtgctctatggttatatgctgtttgctaaactgaaccgatattgtcaccgattctggtctacttgcatgtttgcacttacaacagttcagataaattaagctgcagacctgcagttgtactgaaatgtgaaaaaccggcgcacgagacttagcagcaatacagtcgtacagttttggctgtgcttctgtagatgtttttttttgggaagaaaagaagaggaaaaaagaattacgtatgcaaaaa

SEQ ID NO: 1198 - DNA, 624 bp, Sorghum bicolor
ccgctctctcgcacgtcgctccccaagtcatcccatccctacgcccgcggccgcgccaccgagtccagaagcttctagaagggggaggggtggtcgcccatgaccgtctgatcggccgtcgccatgggatgcgctggatccactctaaagcctgaagataatggtaagaagttgaaaaaaccaaagccttggaagcacacccaagcaataacgccggcacaactcagacagatgcgtgatgaattttgggacactgctcctcactatggtggacagaaagagatttgggacgcacttagagctgctgcagattctgatttagcgcttgcacaaaccatagtggatagcgctggcatcatcatatcaaattctgacatgacactttgctatgatgaaagaggtgcgaaatatgaacttccaaagtatgttctaagcgagccaacaaatttgatcaaggacggttaaattcataaaataaaaaggggtccagtgtaaattatgtaaatcacatttgttcactgacatcaacgttgaccttgattgggacttcaataatattatgattatgatgtgctagattctgatttgagctgttctcctacttattgtccagttgtcccttgt

SEQ ID NO: 1199 - DNA, 1251 bp, Sorghum bicolor
gtatccgccgaagccccgcaccggtttttgttggctagcatcgtgcgcgaccacctaccgatgcgtccgtcccgtccaccaccgccctccccctccccccccgctccgcgtctgcttttcagctctccaccgctctctcgcacgtcgctccccaagtcatcccatccctacgcccgcggccgcgccaccgagtccagaagcttctagaagggggaggggtggtcgcccatgaccgtctgatcggccgtcgccatgggatgcgctggatccactctaaagcctgaagataatggtaagaagttgaaaaaaccaaagccttggaagcacacccaagcaataacgccggcacaactcagacagatgcgtgatgaattttgggacactgctcctcactatggtggacagaaagagatttgggacgcacttagagctgctgcagattctgatttagcgcttgcacaaaccatagtggatagcgctggcatcatcatatcaaattctgacatgacactttgctatgatgaaagaggtgcgaaatatgaacttccaaagtatgttctaagcgagccaacaaatttgatcaaggacggttaaattcataaaataaaaaggggtccagtgtaaattatgtaaatcacatttgttcactgacatcaacgttgaccttgattgggacttcaataatattatgattatgatgtgctagattctgatttgagctgttctcctacttattgtccagttgtcccttgtcctggattgtagcgcggtgaactctcataaggtcataccttaaagaagcgctaaccataaacctcagtgtataataggtactgcttgtctcagctagtcaactggatatataggacacttgaagttttgtggtttccccaattatcaatcatgttcattattggtcacttttcactgaaccttgtttgagaacaatcttctttgctttggccttcaagtggtgtactaccagttcaaagcagcagtggttagcattgctgcatgcatcacatgctgcatttgtaaaggctaaagggcgctgacagttttagaggagaggacagtcagttggtgctggctatttttctgctgttttttggttgagccatcacctgtttttggttatagatcctttgcacctaaccagatcttttgcttgacctccagtactgtcgttcaatgtctgttgttaccctgaaattgctgcccgtgcaatgcttagggaggctcaattatctg

SEQ ID NO: 1200 - DNA, 604 bp, Triticum aestivum
gaggctctcgcacgtcgctccccaagtcatcccatccctacgcccgcggccgcgccaccgagtccagaagcttctagaagggggaggggtggtcgcccatgaccgtctgatcggccgtcgccatgggatgcgctggatccactctaaagcctgaagataatggtaagaagttgaaaaaaccaaagccttggaagcacacccaagcaataacgccggcacaactcagacagatgcgtgatgaattttgggacactgctcctcactatggtggacagaaagagatttgggacgcacttagagctgctgcagattctgatttagcgcttgcacaaaccatagtggatagcgctggcatcatcatatcaaattctgacatgacactttgctatgatgaaagaggtgcgaaatatgaacttccaaagtatgttctaagcgagccaacaaatttgatcaaggacggttaaattcataaaataaaaaggggtccagtgtaaattatgtaaatcacatttgttcactgacatcaacgttgaccttgattgggacttcaataatattatgattatgatgtgctagattctgatttgagctgttctcctaaaaa

SEQ ID NO: 1201 - DNA, 1312 bp, Secale cereale
cacacacaaccccgacgcagccgcgcgcgcgcacagagccggagagagggcgagagagaggcaccgggcccatcgcatgggagcgcggtcgacggcgaccgcgggggaggcggtggcgaggcggggcggcaggaagaagggagccatggcgccgtcggtgggcggcgtggaggcggcgatggcgggcggcaggcgcagcagggccccgccgcggctggtggggtacgaggagctccccgagtacctcaaggacaacgagtacatccgcggccactaccgcgtcgagtggcccatccgcgacgccctcctcagcgccttctcctggcacaacgagacgctcaacgtctggacgcatttgggcgggttcctgctgttcctggcgctcgccgtcgctggaggcggcccggaggccgcccacgaggtcgcgccggggatcatgaggttcgtggtgggatcagctaattcgtcgtggaagagcgatcaaacgggcctgccgagccatgacgcggcggtgacggtcctgggcgggcacggggtgccgcggtggccgcggatggtgttcctcgtgggcgccatggcgtgcctggccatcagcgcgacggcgcacctcctcgcgtgccactcgcgccgcgccaccgtcgtcttctggcagctggactacgccggcatctccatcatgatcgtcgcctccttcgtcccgcccgtgtactacgcgttcctctgccacccgcccgcgcgcgtcgcctacctctccgccatcaccgtcctcggtgcgctcgtcgtggccgtgctgctctcgccgtcgtgctcctcgccgcggtaccgccgcctccgcgccacgctgttcctcgccatggggatgtccggcgtcatcccggcggtgcacgcgctctggatcaactggggccacaccgcctgctacctggcgctcgggctggaggtggccatggggctcgcctacgccgtcggcgcctggttctatgtcagccgcgtgccggagaagtggcgccccggcgtcttcgacgtcgtcggccacagccaccagatcttccacgtcttcgtgctcgtcggtgccatcacgcactacgtcgccgtcgccgtgctgctcgactggcgggagaaggcggccgtctcgtgcggcggcacagcatcataggtggcttcttggaacttcgtaattgtaatggtcattcgagaatcatgggacgattcgaatggagtagcgagctagtactagtagcaatgtgcttaatttagtggcagcgtgtgaacttgtgatttgacatatgcaatacagttgatgagattgcgc

SEQ ID NO: 1202 - DNA, 2891 bp, Triticum aestivum
gaccgggagctctcggctgcggcggccgtgtcgcgccggagcaagagggtgggtaccgctgcgacggcgattcggcgttaccgatgcgaccccacgtaccggttcctgcacgaccgtacggccgacctgttcgccagcctcctcgtggaggacatgcgcaagctcgccaacgacgacgtccgggagctctcgctcgcggcgaagtggtgcccgtcgctaggctcgtcgtacgaccgctccactctcctctgcgaggccgtcgcgcgacgcctcttccccaggggctcgtcgccagagctcgcggatgatctccccgacgaaccttacgcttatcgtgcgcgcgagcgcctccgtaggacggcgctcgtgccgctccgccgcgcgctacagctccccgaggtcttcatgtcggcgcgggcgtgggagtccgtcgtgtacacgcgcgtggcctcggtggccatgaagaactaccaggccgtcttcctcaagcacgacgccgagcgcttcaacgcttacctcgccgatgtcaagtccagcaagaagcggatcgctgcgggcgcgctgctccctcaccagatcatcgagtccctcggcgaggacggcgacggtgccggcaccggcgtggccgacatgcagtggcggcgcatggtcgacgacatgcgcgccctcggcaagctcaccaactgcttggccgtgtgcgacgtgtccggcagcatgtccggcctgcccatggacgtctgcgtcgcgctcggcctcctcgtgtccgagctcacggacgacccgtggagcggccgcgtgatcaccttcagcgagcgcccggagatccacttgatcaccggcgacaccctctccgagaaggtgggcttcatgcgcgccatggactggggcatgaacacaaacttccaggcggtgttcgacaagatcctcgaggtggccgtgggcgccggcctgccgccggagaggatggtaaggcgggtgttcgtgttcagcgacatggagttcgaccaggcatcggctcatccgtgggagacagactacgaggcgatcgtgaggaagttctcggaagccggctacggctcggccgtgccagagatagtgttctggaacctggcgtactccaaggccgtgccggtgatgtccggccagaaaggggtggcgctggtgagcgggttctccaagaacttgctcaagctgttcctcgacggcggcggcatcgtcaccccgaggaccatcatggagaaggccatcgtcggcccggagtacgacaagctcaccgttttcgattgaagaagacagcggcaaaacaaaaacttccatatgtatgaagctgtatggactaaaaagcggcgcaatctcatcaactgtattgcatttgcatatgtgaaatcacaagttcacacgctgccactaaattaagaacattgctactactagctcactactaatacattcgaatcgtccaatgattctcgaatgacaccggtcacaatttcttgttccaagttccagcaagccgcctacgacgccgtgccgccgcacgagacggccgccttctcccgccagtcgagcagcacagcgacggcgacgtagtgcgtgatggcacccacgagcacgaagatgtggaagatctggtggctgtggccgacgacgtcgaagacgccggggcgccacttctccggcacgcggctgacgtagaaccaggcgccgaccgcgtaggcgagccccatggccacctccagcccgagcgccaggtagcaggcggcgtggccccagttgacccagagcgcgtgcaccgccgggatgacgccggacatccccatggcgaggaacagcgtggcgcggaggcggcggtaccgcggcgaggagcacgacggcgagagcagcacggccacgacgagcgcgccgaggacggtgatggcggagaggtaggcgacgcgcgcgggcgggtggcagaggaacgcgtagtacacgggcgggacgaaggaggcgacgatcatgatggagatgccggcgtagtccagctgccagaagacgacggtggcgcggcgcgagtggcacgcgaggaggtgcgcagtcgcgctgatggccaggcacgccatggcgcccacgaggaacaccatccgcggccaccgcggcaccccgtgcccgcccaggaccgccgccgccgcgtcatggctcggcaggcccgattgatcgctcttccacgacgaattagctgatcccaccacgaacctcatgatccccggcgcgacctcgtgggcggcctccgggccgccgccggcgacggcgagcgtcaggaacagcaggaacccgcccaaatgcgtccagacgttgagcgtctcgttgtgccaggagaaggcgctgaggagggcgtcgcggatgggccactccacgcggtagtggccgcggatgtactcgttgtccttgaggtactcagggagctcctcgtagcccaccagccgcggcggggccctgctgcgcctgccgcccgccatcgccgccgcggatgccgcctccacgccgcccaccgacggcgccatggctcccttctttctgctgctccgcctcgccaccgcctcccccgcggtcgccgtcgaccgcgctcccatgcgatgggcccggtgcctctctccccccggctctgtgcgcgcgcgcggctgcgtcggggttgtctgtgtctggtccgcggttcgtgcgggggagcccgggaggtggtggtgttataggcggactatgtggaggctatagggggatgggaggagacgaggccgcctggcgaatcttggcggggagcgcgcggcgcgggggtggtgtggtgcggtgatgttgctggtgggtgtaggcacgggcgagccacccacatggatttcctccgccgcacacgcttgtcc

SEQ ID NO: 1203 - DNA, 1563 bp, Triticum aestivum
gcgccgcgcgctccccgccaagattcgccaggcggcctcgtctcctcccatcccatcccatcccatccccctatagcctccctatagtcagtccgcctataacaccaccaccaccacctcccgggctcccccgcacgaaccgcggaccagacacagacaaccccgacgcagccgcgcgcgcgcacgcagccgtagagagagggagagggagaggcaccggccccatcgcatgggagcgcggtcgacggcgaccgcgggggaggcggtggcgaggcggggcggccggaagaagggagccatggcgccgtcggtgggcggcgtggaggcggcgtccgcggcggcggcgatggcgggcggccggcgcagcagggccccgccgcggctggtgggctacgaggagctccccgagtaccttaaggacaacgagtacatccgcggccactaccgcgtcgagtggcccatccgcgacgccctcctcagcgccttctcctggcacaacgagacgctcaacgtctggacgcatttgggcgggttcctgctgttcctggcgctcgccgtcgccggcggcggcccggaggccgcccacgacgccgcgccggggatcatgaggttcgtggtgggatcagctaattcgtcgtggaagagcgatcaatcggggctgccggggcatgacgcagcggcggcggtcctgggcgggcacggggtgccgcggtggccgcggatggtgttcctcgtgggcgccatggcgtgcctggccatcagcgcgacggcgcacctcctcgcgtgccactcgcgccgcgccaccgtcgtcttctggcagctggactacgccggcatctccatcatgatcgtcgcctccttcgtcccgcccgtgtactacgcgttcctctgccacccgcccgcgcgcgtcgcctacctctccgccatcaccgtcctcggcgcgctcgtcgtggccgtgctgctctcgccgtcgtgctcctcgccgcggtaccgccgcctccgcgccacgctgttcctcgccatggggatgtccggcgtcatcccggcggtgcacgcgctctgggtcaactggggccacgccgcctgctacctggcgctcgggctggaggtggccatggggctcgcctacgcggtcggcgcctggttctacgtcagccgcgtgccggagaagtggcgccccggcgtcttcgacgtcgtcggccacagccaccagatcttccacgtcttcgtgctcgtcggtgccatcacgcactacgtcgccgtcgctgtgctgctcgactggcgggagaaggcggccgtctcgtgcggcggcacggcgtcgtaggcggcttgctggaacttggaacaagaaattgtgaccggtgtcattcgagaatcattggacgattcgaatgtattagtagtgagctagtagtagcaatgtgcttaatttagtggcagcgtgtgaacttgtgatttgacatatgcaaatgcaatacagttgatgagattgcgccgctttttagtccatacagcttcatacatatggaagtttttgttttgccgctgtcttcttcagtcgaa

SEQ ID NO: 1204 - DNA, 1317 bp, Leymus cinereus x Leymus triticoides
  misc_feature (3)..(3): n is a, c, g, or t
  misc_feature (46)..(46): n is a, c, g, or t
  misc_feature (52)..(52): n is a, c, g, or t
  misc_feature (62)..(62): n is a, c, g, or t
  misc_feature (89)..(89): n is a, c, g, or t
  misc_feature (112)..(112): n is a, c, g, or t
  misc_feature (123)..(123): n is a, c, g, or t
  misc_feature (145)..(145): n is a, c, g, or t
  misc_feature (152)..(152): n is a, c, g, or t
  misc_feature (176)..(176): n is a, c, g, or t
  misc_feature (420)..(420): n is a, c, g, or t
  misc_feature (442)..(442): n is a, c, g, or t
  misc_feature (474)..(474): n is a, c, g, or t
  misc_feature (481)..(481): n is a, c, g, or t
  misc_feature (492)..(492): n is a, c, g, or t
  misc_feature (512)..(512): n is a, c, g, or t
  misc_feature (518)..(518): n is a, c, g, or t
  misc_feature (525)..(525): n is a, c, g, or t
  misc_feature (533)..(533): n is a, c, g, or t
  misc_feature (637)..(637): n is a, c, g, or t
  misc_feature (729)..(729): n is a, c, g, or t
  misc_feature (738)..(738): n is a, c, g, or t
  misc_feature (783)..(783): n is a, c, g, or t
  misc_feature (794)..(794): n is a, c, g, or t
  misc_feature (811)..(811): n is a, c, g, or t
  misc_feature (877)..(877): n is a, c, g, or t
  misc_feature (893)..(893): n is a, c, g, or t
  misc_feature (907)..(907): n is a, c, g, or t
  misc_feature (934)..(934): n is a, c, g, or t
  misc_feature (1018)..(1018): n is a, c, g, or t
  misc_feature (1060)..(1060): n is a, c, g, or t
  misc_feature (1084)..(1084): n is a, c, g, or t
  misc_feature (1091)..(1091): n is a, c, g, or t
  misc_feature (1132)..(1132): n is a, c, g, or t
  misc_feature (1144)..(1144): n is a, c, g, or t
  misc_feature (1158)..(1158): n is a, c, g, or t
  misc_feature (1171)..(1171): n is a, c, g, or t
  misc_feature (1181)..(1181): n is a, c, g, or t
  misc_feature (1206)..(1206): n is a, c, g, or t
  misc_feature (1215)..(1216): n is a, c, g, or t
  misc_feature (1218)..(1218): n is a, c, g, or t
  misc_feature (1238)..(1238): n is a, c, g, or t
  misc_feature (1250)..(1250): n is a, c, g, or t
  misc_feature (1271)..(1271): n is a, c, g, or t
  misc_feature (1290)..(1290): n is a, c, g, or t
  misc_feature (1293)..(1293): n is a, c, g, or t
gcngaccagacaaccccaacgcagccgcgcgcgcgcacagagccgnagaganaggcaccggntccatcgcatgggagcgcggtcgacgncgaccgcgggggaggcggtggcnaggcggggcancaagaagaagggagccatggcnccgtcgntgggcggcgtggaggcggcggcgncggcgggcggcaggcgcagcagggccccgccgcggctggtggggtacgaggagctccccgagtacctcaaggacaacgagtacatccgcgggcactaccgcgtggagtggcccatccgcgacgccctcctcagcgccttctcctggcacaacgagacgctcaacgtctggacgcatttgggcgggttcctgctgttcctggcgctcgccgtcgccggaggcggctcggaggccgcccacgaggncgcgccggggatcatgaggttngtggtgggatcagctaattcgtcgtggaagancgatcantcgggcctgcngagccatgacgcggcggcgncggtcntgggcgngcacggcntgccgcggtggccgcggatggtgttcctcgtgggcgccatggcgtgcctggccatcagcgcgacggcgcacctcctcgcgtgccactcgcgccgcgccaccgtngtcttctggcagctggactacgccggcatctccatcatgatcgtcgcctccttcgtcccgcccgtgtactacgcgttcctctgccacccgcncgcgcgcgncgcctacctctccgccatcaccgtcctcggcgcgctcgtcgtggncgtgctgctcncgccgtcgtgctcctcnccgcggtaccgccgcctccgcgccacgctgttcctcgccatggggatgtccggcgtcatcccggcngtgcacgcgctctggntcaactggggccangccgcgtgctacctggcgctcgggctngaggtggccatggggctcgcctacgcggtcggcgcctggttctacgtcagccgcgtgccggagaagtggcgccccggcgtcttngacgtcgtcggccacagccaccagatcttccacgtcttcgtnctcgtcggtgccatcacgcactangtcgccntcgccgtgctgctcgactggcgggagaaggcggccgtctcntgcggcggcacnacgtcgtaggcggnttgttggaacaanaagatgtgantggtttcattcgagaatcattggangattcgaanntngtagtgagctagtagtagcnatgtgcttaatntagtggcagcgtgtgaacttntgatttgacatatgcaatncanttgatgagattgcaccaaaaaaaa

SEQ ID NO: 1205 - DNA, 1564 bp, Brachypodium distachyon
ggaaatccatgtgggtggctcgccctcccctgccatcacctcagcaccacacccccgcgccgcgcgctccccgccaagattcgcctcgtctcctcccccctataacgccacctcggctcctcctctccccgcacgagccgctcgcgcagagagagatagagagagaggggcaccaccgggtggtccatcgcatcgcatgggagcgcggtcgggggcggcggcggcggcggcggcggcgaggcggagcgggaagaaggcggaggcggcatcggcgtcgtcggccatggcgccggtgggtggggtggagtcggcggcggcggcggcggggggacggagcaggaggccgccgcggctggtcgggtacgaggagctcccggagttcctcaaggacaacgagtacatccgcggccactaccgcgccgagtggcccctccgcgacgcgctcctcagcgccttcgcctggcacaacgagacgctcaacgtctggacgcatttgggagggttcctgctgttcctggcgctcgccgtcgccggaggaggcaaggaggcggcccacgaagtcgccccggggatcatgagatttgtggtgggatcagctaattcttcatggaagagcgatcactcgggcctggcggggagcgcgcacggcgaggcggcggcatcggcggagctgggcgtgccgcggtggccgcggatggtgttcctggtgggcgccatggcgtgcctggccacgagcagcgcggcgcacctgctggcctgccactcgcgccgcgccacggtcgtcttctggcagctggactacgcgggcatctccgtcatgatcgtcgcctccttcgtcccgcccgtctactacgccttcctctgccaccgcgccgcgcgcgtcgcctacctctccgccatcgccgccctgggcgcgctcgtcgtggccgtgctgctctcgccgtcctgctcctcgccgcggtaccgccggctgcgtgccgcgctgttcctcgcaatgggcttgtccggtgtcgtcccggcgttgcacgctctctggatcaactggggccacgccgcgtgctacctcgcgctcgggctcgaggtggccatggggctggcgtacgccgtcggggcctggttctatgtcagccgtgtcccggagaagtggcgtcccggcgtgttcgatgtcgtcgggcatagccaccagatcttccatgtgttcgtgctcgtcggcgccgtcacgcattatgttgccgtcgccgtgctgctcgactggcgggagaaggtcgccgtggcttgcggcggcacgacgccgtgatgagaggcgaccgaggcggcttgattgtttgttggatggagaacagaccggcttgattgtttgaggatcgtcattccaagggagtagtcagtgagtgagtgagctctagcaactagcaaatgtgcattagaaggcatagtgtggactgtggaactgtgaactttaatggtctgacatgcgatacaattgatgagattgcaccacctattggtgtacccagattccgttcgaatttggaagaagaatcaaatacactatgagttgagc

SEQ ID NO: 1206 - DNA, 1686 bp, Brachypodium distachyon
acgcccctctccataccattcgacgagcgcaaggaaaaaaaaaagatagcgacaagcgtgcgcgtcagaggaaatccatgtgggtggctcgccctcccctgccatcacctcagcaccacacccccgcgccgcgcgctccccgccaagattcgcctcgtctcctcccccctataacgccacctcggctcctcctctccccgcacgagccgctcgcgcagagagagatagagagagaggggcaccaccgggtggtccatcgcatcgcatgggagcgcggtcgggggcggcggcggcggcggcggcggcgaggcggagcgggaagaaggcggaggcggcatcggcgtcgtcggccatggcgccggtgggtggggtggagtcggcggcggcggcggcggggggacggagcaggaggccgccgcggctggtcgggtacgaggagctcccggagttcctcaaggacaacgagtacatccgcggccactaccgcgccgagtggcccctccgcgacgcgctcctcagcgccttcgcctggcacaacgagacgctcaacgtctggacgcatttgggagggttcctgctgttcctggcgctcgccgtcgccggaggaggcaaggaggcggcccacgaagtcgccccggggatcatgagatttgtggtgggatcagctaattcttcatggaagagcgatcactcgggcctggcggggagcgcgcacggcgaggcggcggcatcggcggagctgggcgtgccgcggtggccgcggatggtgttcctggtgggcgccatggcgtgcctggccacgagcagcgcggcgcacctgctggcctgccactcgcgccgcgccacggtcgtcttctggcagctggactacgcgggcatctccgtcatgatcgtcgcctccttcgtcccgcccgtctactacgccttcctctgccaccgcgccgcgcgcgtcgcctacctctccgccatcgccgccctgggcgcgctcgtcgtggccgtgctgctctcgccgtcctgctcctcgccgcggtaccgccggctgcgtgccgcgctgttcctcgcaatgggcttgtccggtgtcgtcccggcgttgcacgctctctggatcaactggggccacgccgcgtgctacctcgcgctcgggctcgaggtggccatggggctggcgtacgccgtcggggcctggttctatgtcagccgtgtcccggagaagtggcgtcccggcgtgttcgatgtcgtcgggcatagccaccagatcttccatgtgttcgtgctcgtcggcgccgtcacgcattatgttgccgtcgccgtgctgctcgactggcgggagaaggtcgccgtggcttgcggcggcacgacgccgtgatgagaggcgaccgaggcggcttgattgtttgttggatggagaacagaccggcttgattgtttgaggatcgtcattccaagggagtagtcagtgagtgagtgagctctagcaactagcaaatgtgcattagaaggcatagtgtggactgtggaactgtgaactttaatggtctgacatgcgatacaattgatgagattgcaccacctattggtgtacccagattccgttcgaatttggaagaagaatcaaatacactatgagttgagcaaatcaaggtgaaatgctgcaacattcctactgtgtgatttgcatctcatcgt

SEQ ID NO: 1207 - DNA, 1520 bp, Sorghum bicolor
ccgcgagctccggcttcctctctccccgcgcgaacgccggggcgcagcgcgcagccaggtataccccacccccccaaccgtcgcattcgcatgggagccgcgactgccccgacgaagcggagccgcggccgcagcaagaggcagcaggccatgatggcgcgcgcgggctcgggctcggagcaggcgcggcggcggccgcggctggtcgggtacgaggagctgccggagtacctcaaggacaacgagtacatccgcggccactaccgcgccgagtggcccatccgcgacgcgctcctcagcgccttcgcctggcacaacgagaccctcaacgtctggacgcatctcggtgggttcctctttttcctggcgctcgcggtcgccggaggatggacggaggccgccgacgaggccgctccggggatcatgaggttcgtggtgagatcagataatgcttcatggaacagccagcattcaggcctgccgaggcacgacgccggggcgtcgctgtccggcgtgccgcggtggccgcggatggtgttcctggtgggcgccatgtcgtgcctggccatcagcgcgacggcgcacctgctggcgtgccactcgcggcgcgccagcgtggtgttctggcagctggactacgcgggcatctccgtgatgatcgtcgcctccttcgtgccgccggtgtactacgccttcctctgccacccgccggcgcgggtggcctacctgtccgcgatcacggcgctgggcgcgctggtggtggccgcgctgctctcgccgtcgtgctcgtccccgcgctaccgccgcctccgcgcggcgctgttcctggccatgggcctgtcgggcgtcgtcccggcgctgcacgcgctgtggctcaactggggccacgccgcctgctacctggcgctggggctcgaggtcgccatggggctcgcctacgccacgggcgcctggttctacgtcagccgcgtcccggagaagtggcggcccggggtgttcgacgtcgtcgggcacagccaccagatcttccacgtcctcgtgctcgtcggcgccgtcacgcactacgtcgccgtcgccgtgctcatccactggcgggagaagatggccgtcacctgtggcgccgcgtcgtaggcgggcttgctgttctcttggcttttgcagcaagccggaggtgcttgatcggatccatagacatccatccagagcttcagtgtgccattggggtttggttgattcagcaaccattcgaatgggcgaaacgaagtagacgcagcatagatcagctctagagtttgagtgtgacattcgacgatttgtaatttaattaattgatgggatgattgagtatggtggttcattaatttatgagatttatctgtcgagtgagtgccttggatttgcaggtttaggattgcagtgtcagtgtagtctctgctcctcatcctcagtgcggcgaggtcctccaccacctccggctatcggccgctgatgcagctgtgcagattgctccaaaatgagtg

SEQ ID NO: 1208 - DNA, 1756 bp, Sorghum bicolor
tgcgacagaggaaatccatgtgccctgccgcggccacgccccacgcccgcgcactccccgccaagatttgccaccaataacccccccgcgtcctcgtcctcctcctcctccctcgccgcgagctccggcttcctctctccccgcgcgaacgccggggcgcagcgcgcagccaggtataccccacccccccaaccgtcgcattcgcatgggagccgcgactgccccgacgaagcggagccgcggccgcagcaagaggcagcaggccatgatggcgcgcgcgggctcgggctcggagcaggcgcggcggcggccgcggctggtcgggtacgaggagctgccggagtacctcaaggacaacgagtacatccgcggccactaccgcgccgagtggcccatccgcgacgcgctcctcagcgccttcgcctggcacaacgagaccctcaacgtctggacgcatctcggtgggttcctctttttcctggcgctcgcggtcgccggaggatggacggaggccgccgacgaggccgctccggggatcatgaggttcgtggtgagatcagataatgcttcatggaacagccagcattcaggcctgccgaggcacgacgccggggcgtcgctgtccggcgtgccgcggtggccgcggatggtgttcctggtgggcgccatgtcgtgcctggccatcagcgcgacggcgcacctgctggcgtgccactcgcggcgcgccagcgtggtgttctggcagctggactacgcgggcatctccgtgatgatcgtcgcctccttcgtgccgccggtgtactacgccttcctctgccacccgccggcgcgggtggcctacctgtccgcgatcacggcgctgggcgcgctggtggtggccgcgctgctctcgccgtcgtgctcgtccccgcgctaccgccgcctccgcgcggcgctgttcctggccatgggcctgtcgggcgtcgtcccggcgctgcacgcgctgtggctcaactggggccacgccgcctgctacctggcgctggggctcgaggtcgccatggggctcgcctacgccacgggcgcctggttctacgtcagccgcgtcccggagaagtggcggcccggggtgttcgacgtcgtcgggcacagccaccagatcttccacgtcctcgtgctcgtcggcgccgtcacgcactacgtcgccgtcgccgtgctcatccactggcgggagaagatggccgtcacctgtggcgccgcgtcgtaggcgggcttgctgttctcttggcttttgcagcaagccggaggtgcttgatcggatccatagacatccatccagagcttcagtgtgccattggggtttggttgattcagcaaccattcgaatgggcgaaacgaagtagacgcagcatagatcagctctagagtttgagtgtgacattcgacgatttgtaatttaattaattgatgggatgattgagtatggtggttcattaatttatgagatttatctgtcgagtgagtgccttggatttgcaggtttaggattgcagtgtcagtgtagtctctgctcctcatcctcagtgcggcgaggtcctccaccacctccggctatcggccgctgatgcagctgtgcagattgctccaaaatgagtgcttctgttctctgttcttctttttcctctcaccgtgcagtttcagctaaatacagacgcaattgggttgattaaacatagctctaggtttttgacttttggagtgttattttttgaacgga

SEQ ID NO: 1209 - DNA, 928 bp, Secale cereale
cgccgtcccctcgctttcaacccccatccgcaggaaagcaggaattcttcgcaagaatccgaccgcgggccgatttgcgtggattccgtgcggccctttctgcgccatggacttctgatccggggcccctcggatcttgggaggaaggcgggcggtgagccggccggccgcgccgggagatggccggcgggaaggagccgatcgaggtcaagttccggctcttcgacggcacggacatcggccccagcaagtacgaccccgccaccaccgtctccgcgctcaaggacttcatcctcgcccggtggccgcaagataaggaaataactccgaaaactgtgaatgacctgaagctcatcaatggtggaaagatattggagaataaccggacacttgccgagtcgcgtgttacaataggagaggtccctggaggtgtaattacaatgcatgtggtagtgcgccctccacaagttgacaaaaaccagaagcagctgggcaattcccccaagcagaacagatgcggatgcaccatactgtgatactgcgcccccgatgatgtatgatgcgcctagttgtagaatttctcctgtgcttttgttgcgtccacggcgtgcgcgtgtgtgtgttcattttgacatccagttctggagccactgagactctagaaacacatgcatgcactcccgaaagcatatgcttgggatgttgccgggagtgaagtttgtttctcctatggatgttgcaggagtccaaggactggattgggtgcttgctgttgtgtaaattgtaatgtggaaacgaccatctttttcacatttttcctttgccatgtttgacactatatcgattctttttagcgctgctgtttgccatgtaaaacagggatattgtaccattgaaatatatatatgtatatgtagcttgggaagtc

SEQ ID NO: 1210 - DNA, 949 bp, Triticum aestivum
gagtcgccgtcccctcgctttcacccccccggacgaaagcaagaattcctcgctagaatccgaccccgggccgatttgcgtggattccgtgcggccctttctgcgccatggacttctgatccggggcctctcggatcttgggaggaagaaggtgggtggtgggcggtgggcggtgagccggcccggagatggccggcgggaaggagccgatcgaggtcaagttccggctcttcgacggcacggacatcggccccagcaagtacgaccccgccaccaccgtctccgcgctcaaggacttcatcctcgcccggtggccgcaagataaggaaataactccaaaaactgtcaatgacctgaagctcatcaatggtggaaagatattggagaataaccggacacttgccgagtcgcgtgttacaataggagaggtccctggaggtgtaattacaatgcatgtggtagtgcgccctccacaagttgacaaaaaccagaagcagctgggcaattcccccaagcagaacagatgcggatgcaccatactgtgatacggcacccccctggtgatgttcgatgcgcctagttgtagaatttctcttgtgcttttgttgcgtccacggcgcggtgtgtattcattttgacatccagttcctggagccattgaaactcgatctagaaacgcatgcatgtactcctgaaagcatgtttgggaatctggtgggactggctgggagtgaaggttcctccttgggatgttgctgatgtgtgcaggagtcaaggaatggatcggatgcttgctgttgtgtaaattgtaatgtggaaacaaccatcttttcatttttcctttggctatgtttgacattatatcgattctttttagcgctgctgtttgccatgtaaaacagatatattgtaccattggaatatatatacggttttgctaaaaaaaaaa

SEQ ID NO: 1211 - DNA, 1136 bp, Triticum aestivum
ctccaccacctccacctccctcccccctcctcgccgagtcgccgtcccctcgctttcaaccccccggacgaaagcaagaattcctcgctagaatccgaccccgggccgatttgcgtggattccgtgcggccctttctgcgccatggacttctgatccggggcctctcggatcttgggaggaagaaggtgggtggtgggcggtgggcggtgagccggcccggagatggccggcgggaaggagccgatcgaggtcaagttccggctcttcgacggcacggacatcggccccagcaagtacgaccccgccaccaccgtctccgcgctcaaggacttcatcctcgcccggtggccgcaagataaggaaataactccaaaaactgtcaatgacctgaagctcatcaatggtggaaagatattggagaataaccggacacttgccgagtcgcgtgttacaataggagaggtccctggaggtgtaattacaatgcatgtggtagtgcgccctccacaagttgacaaaaaccagaagcagctgggcaattcccccaagcagaacagatgcggatgcaccatactgtgatacggcacccccctggtgatgttcgatgcgcctagttgtagaatttctcttgtgcttttgttgcgtccacggcgcggtgtgtattcattttgacatccagttcctggagccattgaaactcgatctagagacgcatgcatgtactcgaatcctgaaagcatgcttgggaatctggtgggactggctgggagtaaaggttcctccttgggatgttgctgatgtgtgcaggagtcaaggaatggattggatgcttgctgttgtgtaaattgtaatgtggaaacaaccatcttttcatttttcctttggctatgtttgacattatatcgattctttttagcgctgctgtttgccatgtaaaacagatatattgtaccattggaatatatatacggttttgctaaacatctggtacctgaaagaatcactttttctagggtagcacgaggccgaaggcggtgatagcgccggccacgtgaagcctagccgtatatgagtgtgagccagtgatgaagtagaagagggagggccgtatatgagtgtgagccagtgatgaagc

SEQ ID NO: 1212 - DNA, 862 bp, Secale cereale
cttcgcaagaatccgaccgcgggccgatttgcgtggattccgtgcggccctttctgcgccatggacttctgatccggcccccctcggatcttgggaggaaggcgggcggtgagccggccggccgcgccgggagatggccggcgggaaggagccgatcgaggtcaagttccggctcttcgacggcacggacatcggccccagcaagtacgaccccgccaccaccgtctccgcgctcaaggacttcatcctcgcccggtggccgcaagataaggaaataactccaaaaactgtcaatgacctgaagctcatcaatggtggaaagatattggagaataatcggacacttgccgagtcgcgtgttacaataggagaggtccctggaggtgtaattacaatgcatgtggtagtacgccctccgcaagttgacaaaaaccgtgagaagcagctgggcaattcccccaagcagaacagatgcggatgcaccatactgtgatacggcgccccccgatgatgtacgatgcgcctagttgtagaatttctcctgtgcttttgtcgcgtccacggcgcgtgtgtgtgtgtgtgttcattttgacatccagttctggagccactgagactctagaaacacatgcatgtactcccgtaagcatatgcttgggatgttgccgggagtgaagtttcctcctccttgggaagttgcaggagccaaggactggattgggtgcttgctgttgtgtaaattgtaatgtggaaacgaccatctttttcacatttttcctttgccatgtttgacactatatcgattctttttagcgctgctgtttgccatgtaaaacagggatattgtaccattcaaatatat

SEQ ID NO: 1213 - DNA, 908 bp, Avena sativa
ggcgggtgtctcttgtcttctccaccttcctcccctcctcgccgagtcgccgtccgctcgctttcaacccccatacggaagcaagaattcttcgtcagaatccgacgccgagccgatttctgtggattccgtgcgaacctttctgcgccatggacttctgatccgggcttccttggatcttgggaggattggaaggcggggaggtgggcgggctgaaccttcccgggagatggccggcgggaaggagccgatcgaggtaaagttccggctgttcgacggcacggacatcggcccgagcaaatacgaccccgccacaaccgtctccgcgctcaaggatttcatcctcgcccggtggccgcaagacaaggaaataactccgaaaactgtcaatgacctgaagcttatcaatggtggaaagatattggagaatagccggactcttgccgagtcacgtgttacaataggagaggtccccggaggtgtaattacaatgcatgtggtagtgcgccctccacaagctgacaaaaaccgtgagaagcagcttggcaattccccgaagcagaacagatgcggatgcaccatactgtgaatatgaaaactccctgatgatgtacaatgcatctagctctagatttttcatctggttttgtgtattcattttgacatccagttattggagccattgaaaccctagaaatatatatacccgcactcgtcaaagcatgcctgggaggtgctgagagtaaagatcccttctgtaattgagcgtgtgcaggagtaaaggattggatgtttgctgctgtataaattgtagtgtgaaaacaacaaattccttttgttttcatttcactatatttgacattttatcgatttctttttagcctgttcgtttttcatagtaaaacaag

SEQ ID NO: 1214 - DNA, 442 bp, Lolium multiflorum
ggaggattggaaggtgggggctgggcgttgaaccggccgggagatggccggcgggaaggagccgatcgaggtcaagttccggcttttcgacggcacggatatcggcccgagcaagtacgaccccgccaccaccgtctccgcgctcaaggatttcatcctcgcccggtggccgcaagataaggaaataactccgaaaacggtcaatgacctgaagctcatcaatggtggaaagatattggagaatagccggacactggccgagtcacgtgttacaataggagaggtccccggaggtgtaattaccatgcatgtcgtagtacgacctccgcaagctgacaaaaaccagaagcagctcggcaattccccgaagcagaaccgatgaggatgcaccatactctgatacgacagcttccggatgatgtacctgcccgggcggccgtcg

SEQ ID NO: 1215 - DNA, 1040 bp, Brachypodium distachyon
aaaataccgaggaagcccactagcctctgtcgtctccaccttcttcttccctacccctcctcgccgagtcgccgtcccctcgctttcagcctccacaaggaagcaagaattctccgtcagaatccggctctgagccgatttacgaggattccgtgtggccctttttttgtgcgttatggactcctgatccggggtttctcggatcttttgggaggaaggtgggtgggggcgagcggtgatctggccgggagatggccggcgggaaggagccgatcgaggtcaagttccggctgttcgacggcacggacatcggccccagcaagtacgacccctccaccaccgtctccgcgctcaaggatttcatcctcgctcggtggccgcaagataaggaaataaatcccaaaactgtcaatgacctgaagcttatcaatgctggaaggatattggagaataaccggacacttgcggagtcccgtgtcccagtaggagaggtcccgggaggtgtaattacaatgcatgtggtagtgcgccctccgcaagctgacaaaaacagtgcgaagcagcttgcgaattcccccaagcagaacagatgtggatgcaccatactgtgaacgatgccttcctgattatgtacaatgtgtctagctctaggattttgcgtctgcttttgttgcatccacaagtgcacgtgtattcattttgacatccagttcttggagccattcaaaccctagaattacacatatatacttgcctcctgtacagcgaaaatatgctttggagccgggagtagaagattctgcattcatggtgcagtgggattcttggtgctgtaaatgagtctgtgcaggagtcaaggattggatgcttgctgttgtataaattgtaatgtgaaaacaaacaaaaatatctttttggtcgttctttttgttacattgacattttatcgattctttttagcgccgttatttgtcatgtaaagcataaatattgtactcaaatatgtatattgggaaaaggagtgatatatttcttttttt

SEQ ID NO: 1216 - DNA, 1339 bp, Brachypodium distachyon
gaaattcgcacggttgcgaaaaagaatacatttttagagcttggagtgtgtacccgttagttaaaataccgaggaagcccactagcctctgtcgtctccaccttcttcttccctacccctcctcgccgagtcgccgtcccctcgctttcagcctccacaaggaagcaagaattctccgtcagaatccggctctgagccgatttacgaggattccgtgtggccctttttttgtgcgttatggactcctgatccggggtttctcggatcttttgggaggaaggtgggtgggggcgagcggtgatctggccgggagatggccggcgggaaggagccgatcgaggtcaagttccggctgttcgacggcacggacatcggccccagcaagtacgacccctccaccaccgtctccgcgctcaaggatttcatcctcgctcggtggccgcaagataaggaaataaatcccaaaactgtcaatgacctgaagcttatcaatgctggaaggatattggagaataaccggacacttgcggagtcccgtgtcccagtaggagaggtcccgggaggtgtaattacaatgcatgtggtagtgcgccctccgcaagctgacaaaaacagtgcgaagcagcttgcgaattcccccaagcagaacagatgtggatgcaccatactgtgaacgatgccttcctgattatgtacaatgtgtctagctctaggattttgcgtctgcttttgttgcatccacaagtgcacgtgtattcattttgacatccagttcttggagccattcaaaccctagaattacacatatatacttgcctcctgtacagcgaaaatatgctttggagccgggagtagaagattctgcattcatggtgcagtgggattcttggtgctgtaaatgagtctgtgcaggagtcaaggattggatgcttgctgttgtataaattgtaatgtgaaaacaaacaaaaatatctttttggtcgttctttttgttacattgacattttatcgattctttttagcgccgttatttgtcatgtaaagcataaatattgtactcaaatatgtatattgggaaaaggagtgatatatttcttttttttttctttttttgacggggaaagcaaactttattaatctgaaaagacatatgtaaaagattgacactccctccgtttgggtttataaggtccacatgaaattttatgccaaactttgaccacaaattacattggtaatatgaaattcacaaaagatatattcttggattcgtattgaaaacttttttttaatggtataccttttatatacatatactaaatataattgaataatgttt

SEQ ID NO: 1217 - DNA, 1259 bp, Oryza sativa
cgacgattgattccatcgtctcgggcatagaattccccgcctgcttctcactttcacaggtcgcaaccatggatggctccgtctccgtctccgtgctagtggaaaaaataattgaggcttctcgttgggtgtatctgttaaattaccgaggaaggaagccccagtgtgcctgtgccccctcctcgtctttcgtctcttctctccttccttcctccccttctcttcctctcctcccaccgagtcgccgccctctcgctttcaacccccacacggaagcaagaattgttcatcaaaacccgatctttggcgtggccccgtggatttcttgcgatctgtttggtgctatggatttctgatccggggtttcttggatcttggggagtaggaggtggggggcggcgatctggccgggagatggccggcgggaaggagccgatcgaggtcaagttccggctttttgatggtacggacatcggcccgagcaagtacgacccctccaccaccgtctccgcgctcaaggagttcatcctcgctcggtggccgcaagataaggaaataactccaaaaactgtcaatgacctgaagctcattaatgccggacggatattggagaataaccggacacttgctgagtcccgtgttccagtaggagaggttccaggaggtgtaattacaatgcatgtggtagtacgccctccacaacccgacaaaaacagtgagaagcagcttgcgaattcccccaagcagaacagatgtgggtgtaccatactgtgatacgccgcctgcctgatgatgatgtacaatgtctcgctctaggattttgtatctgctttcctgtgttcgcagctcttgtgaattcattttgacatccaattttagagccattcaaatcctagaaatatacatactttaacacccgtcaaatatgcttgggagctggaactgaaggtttctggaggatgcgtcatggtgatcttaatgttgtaacgagtgtgcagaagacagggattggatgctttctgttgtataaattgtaatgtgaaaacgaaaaaaattctctcctttttcttttttctcttgccacattgacattttatcgattctttttagcactggtgtttgtcatgtaaaaccagaatattgtactcatatatgtaagctgaaaaaaggggtgttttattctgttacgtggacggaaaaaggaaagaaaaaaaatagaatctgtcctatagttatcccatctggaaacacttttgggc

SEQ ID NO: 1218 - DNA, 1080 bp, Oryza sativa
gtgcctgtgccccctcctcgtctttcgtctcttctctccttccttcctccccttctcttcctctcctcccaccgagtcgccgccctctcgctttcaacccccacacggaagcaagaattgttcatcaaaacccgatctttggcgtggccccgtggatttcttgcgatctgtttggtgctatggatttctgatccggggtttcttggatcttggggagtaggaggtggggggcggcgatctggccgggagatggccggcgggaaggagccgatcgaggtcaagttccggctttttgatggtacggacatcggcccgagcaagtacgacccctccaccaccgtctccgcgctcaaggagttcatcctcgctcggtggccgcaagataaggaaataactccaaaaactgtcaatgacctgaagctcattaatgccggacggatattggagaataaccggacacttgctgagtcccgtgttccagtaggagaggttccaggaggtgtaattacaatgcatgtggtagtacgccctccacaacccgacaaaaacagtgagaagcagcttgcgaattcccccaagcagaacagatgtgggtgtaccatactgtgatacgccgcctgcctgatgatgatgtacaatgtctcgctctaggattttgtatctgctttcctgtgttcgcagctcttgtgaattcattttgacatccaattttagagccattcaaatcctagaaatatacatactttaacacccgtcaaatatgcttgggagctggaactgaaggtttctggaggatgcgtcatggtgatcttaatgttgtaacgagtgtgcagaagacagggattggatgctttctgttgtataaattgtaatgtgaaaacgaaaaaaattctctcctttttcttttttctcttgccacattgacattttatcgattctttttagcactggtgtttgtcatgtaaaaccagaatattgtactcatatatgtaagctgaaaaaaggggtgttttattctgttacgtggacggaaaaaggaaagaaaaaaaatagaatctgtcctatagttatcccatctgg

SEQ ID NO: 1219 - DNA, 520 bp, Cynodon dactylon
ggggaggagatggccggcgggaaggaaccgattgaggtcaggttccggctgtttgacggcacggacatcggccccagcaagtacgacccttcaaccaccgtctccgcgctcaaggagttcatcctcgctcggtggccgcaagataaggatatagttccaaaaactgtcaatgacttgaagcttatcaatgctggaaggatactggagaataacaggacacttgctgaatcccgtgttccggtaggagaggtcccaggaactgtaattacaatgcatgttgtagtgcgaccgccacaagttgacaaaaacaagaagcagcttgccaactcccctaagcagaacagatgtggatgcaccattctgtgacacgatgcctgcttgacgctgtacaattcgtgtagttctagggttttgtgtatgctttgtcacgttcacgcaagtgtgaattctttttgacgtccaattcttgaagccgtcgaaatcctaggaacatatatatacttaatatgtcctcgcaaaa

SEQ ID NO: 1220 - DNA, 1502 bp, Setaria italica
caaaaaaagagctcagactaaagctgcatcatatcttaattgttcattggattgtgatgtgtatttatttaactgttaatgctgaaaaatacaagctcgacctgtaccaccaatgaagaaacagtaagtgaggaaggaattattccacataaaatgccaaaaaaaccacgagtactggagcagtatagaacagggaatagaagaagacgccgacgagacccggggggccaatcatagtacccgagatagaagccatcgccgacgtcgaattccggcgattttgattcctctcctccagctgctcgggccgcgcatagaattccccgctcggcaccctcggcctcgccctcgcctctcgctttcacactcccccaccaccatcgcttgatgcaaaaaccgcaattaaaaacttcggcttgggcgtatttgtcaatacacccagaggacagaggaggaagcccactaccccgtctctctctctctggttttcgtctcgtcttcctctcttccccaccgagtcgccgtcccctcgctttcaccccacgcggaagcaagaattcatcgtcaaaatctcaccttgcgcgtgtttctgtggatttttttttgccgcttcgttgctgctatgggcctctgatccggggcttcgtggatcttgctgagaggaggtggggcggccggccggcggcgatctggcggggaggagatggccggcgggaaggagccgatcgaggtcaggttccggctcttcgacggcacggacatcgggcccaccaagtacgacccctcgaccacagtctccgcgctcaaggagttcatcctcgctcggtggccgcaagataaggatatagctccaaaaactgtcaatgacttgaagcttatcaatgctggaaggatactggagaataaccggacacttgcagagtcccgtgttccagtaggagaggtcccggggggtgtaattacgatgcatgtggtagtgcgacctccacaagctgacaaaaacagtgagaagcagcttgccaattcccccaagcagaacagatgtggatgcaccatactatgataaggcacctgcttgatgctgtacaatctgtttagtcctaggattttgtatctgctttgttgtcttcacacgagtgtgaattcattttgacatccaattcttgaagccattcaaatcccagaaacatatatactaaatatccgtcaaacatgccttggaatgaagatttctggagggcgaagtctgatcgtcgtgttgtaaccaagcgggaatggaggattggatgcttcctgttgtataaattgtaatgtcaaaacaaaaaaagcgtttcgttttcttctcttctcttcccttcctgccccgttgtctttatatcgattctttttagatctgtttctttatctcgtgtaacagaaatatttgtactcatatatatgtaacttgaaaaaggagtaatgtatgaattttcaaaagaaaaaggagtgacgtgtgctgctct

SEQ ID NO: 1221 - DNA, 1218 bp, Setaria italica
acccgagatagaagccatcgccgacgtcgaattccggcgattttgattcctctcctccagctgctcgggccgcgcatagaattccccgctcggcaccctcggcctcgccctcgcctctcgctttcacactcccccaccaccatcgcttgatgcaaaaaccgcaattaaaaacttcggcttgggcgtatttgtcaatacacccagaggacagaggaggaagcccactaccccgtctctctctctctggttttcgtctcgtcttcctctcttccccaccgagtcgccgtcccctcgctttcaccccacgcggaagcaagaattcatcgtcaaaatctcaccttgcgcgtgtttctgtggatttttttttgccgcttcgttgctgctatgggcctctgatccggggcttcgtggatcttgctgagaggaggtggggcggccggccggcggcgatctggcggggaggagatggccggcgggaaggagccgatcgaggtcaggttccggctcttcgacggcacggacatcgggcccaccaagtacgacccctcgaccacagtctccgcgctcaaggagttcatcctcgctcggtggccgcaagataaggatatagctccaaaaactgtcaatgacttgaagcttatcaatgctggaaggatactggagaataaccggacacttgcagagtcccgtgttccagtaggagaggtcccggggggtgtaattacgatgcatgtggtagtgcgacctccacaagctgacaaaaacagtgagaagcagcttgccaattcccccaagcagaacagatgtggatgcaccatactatgataaggcacctgcttgatgctgtacaatctgtttagtcctaggattttgtatctgctttgttgtcttcacacgagtgtgaattcattttgacatccaattcttgaagccattcaaatcccagaaacatatatactaaatatccgtcaaacatgccttggaatgaagatttctggagggcgaagtctgatcgtcgtgttgtaaccaagcgggaatggaggattggatgcttcctgttgtataaattgtaatgtcaaaacaaaaaaagcgtttcgttttcttctcttctcttcccttcctgccccgttgtctttatatcgattctttttagatctgtttctttatctcgtgtaacagaaatatttgtactcatatatatgtaacttgaaaaaggag

SEQ ID NO: 1222 - DNA, 790 bp, Pennisetum glaucum
cggggaggagatggccggcgggaaggagccgatcgaggtcaggttccggctcttcgacggcacggacatcgggcccaccaagtacgacccctccaccacagtctccgcgctcaaggagttcatcctcgctcggtggccgcaagataaggatatagctccaaaaactgtcaatgacttgaagcttatcaatgctggaaggatactggagaataaccggacacttgcagagtcccgtgttccagtaggagaggtcccagggggtgtaattacaatgcatgtggtagtccgacctccacaagctgacaaaaacagtgagaagcagcttgctaattcccccaagcagaacagatgtggatgcaccatactatgataaggcacctgcttgatgctgtacaatctgtgtagtcctaggattttgtatctgctttgttgtcttagacacgagtgtgaattcattttgacatccaattcttgaagccattcaaatcccccaaaaacatatatactaaatatccatcaaacatgccttggaatgaagatttctggagggcgaagtccgattgtcgtgttgtaacaaagcaggaatggaggattggatgcttcctgttgtataaattgtaatgtcaaaacgagaaaagtgtttcattttcttctcttctcttctcttctcttctcttcttgccccttttacgttatatcgattctttgtaggtctgtttctctgtctcgtgtaacagaaatatttgtactcatatatatgtaacttgaaaagggagtaatgtatgaaatt

SEQ ID NO: 1223 - DNA, 1109 bp, Panicum virgatum
gctcgatgccaaaatcgcaattaaaaacttctacttgggcgtatctgtcaatacaccgagaggaggaagcccactaccccatcgtcgtctctctggctctcgtcttcctctcctcccccaccgagtcgccgtcccctcgctttcaccccacgcggaagcaagaattcgtcgtcaaaatctcaccttcgcgtgtttctgtggatttttttttgctgcttccttgctgctatgggcctctgatccggggcttcgtggatcttgggaagaggaggtggggcggccggccggcggcgatctggcgggaaggagatggccggcgggaaggagccgatcgaggtcaggtttcggctcttcgacggcacggacatcgggcccaccaagtacgacccctccaccacagtctccgcgctcaaggagttcatcctcgctcggtggccgcaagataaggatatagctccaaaaactgtcaatgacttgaagcttatcaatgctggaaggatactggagaataaccgaacacttgcagagtcccgtgttccagtaggagaggtcccaggaggtgtaattacaatgcatgtagtagtgcgacctccacaagctgacaaaaacagtgagaagcagcttgccaattcccccaagcagaacagatgtggatgcaccatactctgataagacgcctgcttgatgctgtacaatctgtgtagtcctaggattttgcatccgctttgttgtgttcacatgagtgtgaattcattttgacatccaattcttgaagccattcaaatcccaaaagtatatactaaatatccgacaaatatgccttggaatggagatttctggagggcgaattctgatcgtcatgttgtaacaagcgggaatggaggattggatgcttcctgttgtataaattgtaatgtcacaaaacagaaaaaaacgtttcttcttcttttttctttcctactacgttgactttatatcgattctttttagctgtctctttgtctcgtgtaacagaaatattgtattcatgtatgtatgtatgtaactcgaaaaaaggagtaatgtatgctgttctgggaaaggaaaatagggggttatgattttgcact

SEQ ID NO: 1224 - DNA, 855 bp, Panicum virgatum
ctctgatccggggcttcgtggatcttgggaagaggaggtggggcggccggccggcggctatctggcgggaaggatatggccggcgggaaggagccgatcgaggtcaggtttcggctcttcgacggcacggacatcgggcccaccaagtacgacccctccaccacagtctccgcgctcaaggagttcatcctcgctcggtggccgcaagataaggatatagctccaaaaactgtgaatgacttgaagcttatcaatgctggaaggatactggagaataaccgaacacttgcagagtcccgtgttccagtaggagaggtcccaggaggtgtaattacaatgcatgtagtagtgcgacctccacaagctgacaaaaacagtgagaagcagcttgccaattcccccaagcagaacagatgtggatgcaccatactctgataagatgcctgcttgatgctgtacaatctgtgtagtcctaggattttgcatctgctttgttgtgttcacatgagagtgaattcattttgacatccaattcttgaagccattcaaatcccagaaatatatgctaaatatccgacaaatatgctttggaatggagatttctggagggcgaattctgatcgtcatgttgtaacaagcgggaatgggggattggatgcttcctgttgtataaattgtaatgtcacaaaacagaaaaaagaatttcttcttcttcttttctttccttctacgttgactttatatcgattctttttagctgtttctttgtctcgtgtaacagaaatattgtactcatatatgtatgtaactcaaaaaaaggagtaatgtatgctattttgggaaaggaaaataggg

SEQ ID NO: 1225 - DNA, 1239 bp, Zea mays
gtgaagaagacgtcgacgagaccaccgagggcagtcaaagtgcccgagatagaagccgccatcgcccgtcgccgacgtcgaaccccggtcggcatagaattccccgctccgcctcggcctcgccaatcgctttcacgctccatcaacaccatggctcgatgccaaaaccacaattaaaaatttgtgcttgggcgtatccgtcaatacacgcaccgagaggaggaagcccactaccccgtctctctctctctctcctccctggctctcgtcttcctctcctcccccaccgagttgccgccccctcgctttcaccccacgcggaagcaagaattcgtcgtcaaattcccaccttgcgcgtgtttctgtggatttccttttttttggccgcttccttgctcctatgggcctttgatccggggcttggatcttgggaaggggaggtgtggtgggcggccgccggcgatctggcggggaggatatggccggcgggaaggagccgatcgaggtcaggttccggctcttcgacggcacggacatcgggcccaccaagtacgatccctccaccacggtctcctcgctcaaggagttcatcctcgctcggtggccgcaagataaggatataactccaaaaactgttaatgacttgaagcttatcaatgctggaaggatattggagaataatcggacacttgcagagtcccgtgttccagtaggagaggtcccaggaggtgtaattacaatgcatgtggtagtgcgacctccacaagctgacaaaaacagtgagaagcagcttgccaattccgtcaagcagaacagatgcgggtgcaccattctctgataagacgcctgcttgatgttgtacaatctgtgtagtcttaggattttgtatctgctttgctgtgttcacacaagcgtgaattcattttgatatccagtccttgaagccattcgagtccagaaacatacacactaaaaatccatcgaatatgaaggtttctggatggtagatttggatcgtcttgttccagagttgaggattggatgcttcctgctgtataaatggtgttgtcgaaactagaaaaaaaaactcttttatttcttttttcttttctgccatgttgacgttatatatatatcgattctttttagatcggttgctttgtctcgtctaacagaaatattgtactcagatataagttgcaaaaggagtaatgtatggtgttatggtaaaggggaaac

SEQ ID NO: 1226 - DNA, 1364 bp, Sorghum bicolor
gaagacgactcaacgagacccagccagggcagtcaaaatgcccgagatgaagccatcgccgacgtcgaatcccggccggcgatttgtttcctccgcctcggcctcgccactcgctttcacactccatcatcaccatggctcgatgccaaaaccgcaattaaaaacttctgcttgggcgtatccgtcaatacacgcacgcaccgagaggaggaagcccactaccgcgtctctctctctctcctccggctctcgtcttcctctcctcccccaccgagtcgccgccccctcgctttcacccaacgcggaagcaagaattcgtcgtcaaattcccaccttgcgcgtgtttctgtggatttctttttttggccgcttccttgctcctatgggcctttgatccggagcttcgtggatcttgggaagaggaggtgtggtgggcagccggcggcgatctggcggggaggatatggccggcgggaaggagccgatcgaggtcaggttccggctcttcgacggcacggacatcgggcctaccaagtacgatccctccaccacagtctcctcgctcaaggagttcatcctcgctcggtggccacaagataaggatgtagctccaaaaactgttaacgacttgaagcttatcaatgctggaaggatattggagaataaccggacacttgcagagtcccgtgttccagtaggagaggtcccaggaggtgtaattacaatgcatgtggtagtgcgacctccacaagctgacaaaaatagtgagaagcagcttgccaactctcccaagcagaacagatgtggatgcaccattctctgataagacgcctgcttgatgctgtacaatctgtgtagtcataggattttgtatctgctttgctgtgttcacacaagcgtgaattcattttgatatccaattcttgaagccatttgaatcccagaaacatacatactgaaagtccatcaaatacgaagatttctggaggctgaatttggatcgccttgttctagagtggaggattggatgcttcctgctgtataaattgtgttgtcaaaactgaaaaagctcctcttttttcttttctgctttgttgactttatatcgattctttttagctcggttgctttgtctcgtgtaacagaaatattgtactcagatatatgtaacttgcaaaaggagtaatgtatggtgttatggtaaaggggaaacaaagaggtgaaaagagcatggctgtgcaatggttttacatttgattatttgttgaaccttacctgaccgttcatgcagtacctgaaggagcagtgatggccctatttttttttagtgtttgcttgccatatcttagtagtctttgcatagc

SEQ ID NO: 1227 - DNA, 1334 bp, Zea mays
ataggatgccaaaaagccatgactacggtctacggcagcagtacagaacagggaagaaggcgacgagacccagggcggtcaaaacgccagagatagaagccatcgccgacgtcgaatcccggccggcggtctgtttcctcctcctcctgctgctgctgactgcccgcctcgcgccgcgcatagaatccctcgctctgcctcgccctcggcctcggcatcgccactcgctttcacgctccatcatcaccaatggctcgatgccaaaaccgcaattaaaaatttcggcttgggcgtatccgtcaatacaccgagaggaggaagcctgcccactaccgcgtatctctctcctccctggctctcatccccccaccgagtcgtcgccccctcgctttcaccccacgcggaagcaagaattcgtcgtcaaattcccagcttgcgcgtgtttctgtggatttcttcccgcttccctgctcctgcctcctatgggcctttgatccggggcttcgtggatcttgggaagaggaggtgcggtgggcgcctcggcggcgatctggcggggaggatatggccagcgggaaggagccgatcgaggtcaggtttcgtctcttcgacggcacggatatcgggcctacgaagtacgatccctccaccacggtctcctcgctcaaggagttcatcctcgctcggtggccgcaagataaggatatagctccaaaaactgttaatgacttgaagcttatcaatggtggaaggatattggagaataaccggacacttgcagagtcccgtgttccagtaggagagatcccaggtggtgtaattacaatgcatgtggtagtgcgacctccacaagctgacaaaaacagtgagaagcagcttgccaattcccccaagcagaacagatgtggatgcaccattctctgataaggcgtctgcttggtgctgtacaatctgtgtgtacacataagattttgtatgtgctttgctgtgttcacacaagcatggattcgttttgatatccaattcttgaagccatacaaattccagaagtaagaacccacggaatacgaagatttctggatcgttttgttctagagtgtaggattggatgcttcctgctgtataaattgtgttgtcaaaactgaaaaaaaagtctctttcttttctgctatattgacttaatatcgattctttctagctcggttgcttttgattcgtgtaacagaaatattgtactcatgtatatgtaacttgcaaaaggagtaatgtatggtgttatggtaattggtaaaggggaaacaaagaggtgaaaagagcgcatggctgtccaatgg

SEQ ID NO: 1228 - DNA, 1937 bp, Hordeum vulgare
atggccggcgggaaggagccgatcgaggtcaagttccggctcttcgacggcacggacatcggccccagcaagtacgaccccgccaccaccgtctccgcgctcaaggacttcatcctcgcccggtggccgcaagataaggagataactccgaaaactgtcaatgacttgaagctcatcaatggtggaaagatattggagaataaccggacacttgccgagtcccgtgttacaataggagaggtccctggaggtgtaattacaatgcatgtggtagtgcgccctccacaagttgacaaaaaccgtggtattgccgacaattttacgccttctctttcacattgtgttcctggttctgaggtgttcgcggactcgtcgacgagctgcactcatcattgtatgatccagatactttcgaggatagcaacaagaagccctcgccgagccatctctgcatccaatccgtgtagctcgaaacttcatcgggcagaattctcttgttgggatccagcttacctaggtaatagtactgttagccccagctgtaccatgaggtcgggtgatggaaattcagatggccaggacacgccactcgccgaggggaaggaccacggctgctccccaggtgtccagtccacaccggacatcgagaagaagtacgtgcaccgtgtctacgatgccatagcccctcacttcagctcgacacggttcgccaagtggcccaaggttgcggggttcctcaacgcgctgaggccagggtccgtcgtgctggatgccggctgcggcaacggcaagtatttgggcttcaatcctgagtgcttctacataggctgcgatataagcccgccgcttatagagatatgcgctgggagggggcacgaggtgttggtcgccgatgccgtcaatctcccgtacagggaaaacgttgctgacgccgcaatttcaattgcggtgttgcatcatctgagtaccgaggacaggcggaggaaagccatacaagagttgatccgtgttgtcaagagaggtggtcttgtgctgatcactgtttgggctgtggagcaggaagacaggtcgcttcttaacaagtggactcccttgtgcgacaagtataatgaagagtgggttgatccaagcagtccgatggtgcgtaacaaatctgctactatgctagatagcattgaagagaccgatgaagacacgggcgccgtcaagcaaatggatgatcggctgaaaaatagttttgatggtttggaggataagaccttaattatggatgagcatgacaaaacccagcaggagtactttgttccttggcatctaccatttcaccgagcagaaattggcggtgcatctgctgctgctctacagaatggattggcaaagaaagatgataagaagggtactgtggtctacaaccgttattatcacatttttgtcgaaggagaacttcaaaggctagttgctggcatgaaaaatgcagccattgccgaccaattctacgacaaatccaactggtgcatagttctggagaagctttgagccgcaggcaaaacgatgccggagaatgtatcctcgtgtcttgtaggaccgtcagctgctagtacaactccgcgagggcacgattttgagtccggatgtcggacacatgcaacaatcttgtcgattcgacggatgtccttggcaatgccgctcatctcccttgtcttgtttgtggccgctgaacataagttttttttttgtggccgtctagatgtttcagggggcatctggcctgactttgcacaagtcatgtgctgccttgcaaactatggaagctcgtgaatcggcatgggttgcttgtgtgctatttttggtgtactgcataatggaactttaaaaaaaaagtcggtgaacactgtcactagcattcagtcattttcttgtgtgatccttgatgctgc

SEQ ID NO: 1229 - DNA, 1118 bp, Brachypodium distachyon
tcccctcgagacgcccgtctcgtcgctttgctcccctcgaaagaattctaaattcttgcttaacaaaaggagaagccggatccttcgcgggatccgcatcggttcttgcccttccttcctgcgcggattttcggcagcctttctggtttttttttcgcctcccctgaattcctccgccgtggtcgacgactgagctggtcgtcgcgcgcggctgcggctgttgggatcttgggtgaggggaggaggggcgccgccgcgatccggccagggagagatggccggcgggaaggagccgatcgaggtcaagttccggctttttgacggcacggacatcgggcccagcaagtacgacccctccacctccgtcacctcgctcaaggagttcatcctcgctcggtggccgcaggataaagaagttgttccaaaaactgtcaatgatgtgaaactcattaatgctggaagaatactggagaacaacaaaactcttgccgagtctcgagtcccagtaggagaagttcctggaggtgttataacgatgcatgttgtcgtgcgccctccccaaagcgacaaaagtgagaagcagctttcaaattctcccaagcagaacagatgtggatgcacgatattgtgacaccgattcggctgcattgtgtattctgtatattggtgccatgctcacatcgattgcaagttcaccctaacattgattcttgcaagctattcttgaaagcctagagacggtaattaacaccatacgtaaatcatcatccctgctcgacagtaaagtttttctccggagttcatagtggagggcgccatccatatttatgtaagctgtaacgagtgcgaaggagtgcaggggtcaagtgctggatgctcgctgttgctttaagatgtagaacctgtgtatttgaggtcgagaacgagctgccacttttctttcttttgctactacatatatacagtcatatagttcttgccgagatctttttcccgctgcatatgtgttatgtgaaaataggaatgtgtttgccagtagtttctgtccagaagtgtaaaaagggaatgtgacatgggactcaaccgatgggcagtgaagtttgtatttgccttttttt

SEQ ID NO: 1230 - DNA, 1311 bp, Brachypodium distachyon
taatttctaaagcaaacctcctgcggcccaaccgtgtcgcaggcagtcaacctcgcctgtcgacaggctcggaccggcttgccaagttgcaagccgctttcccagtaaaattccatcatatacaagtttcctggggacgtatctgcgaaaacgccgaggaatcccactctctcttcccctcgagacgcccgtctcgtcgctttgctcccctcgaaagaattctaaattcttgcttaacaaaaggagaagccggatccttcgcgggatccgcatcggttcttgcccttccttcctgcgcggattttcggcagcctttctggtttttttttcgcctcccctgaattcctccgccgtggtcgacgactgagctggtcgtcgcgcgcggctgcggctgttgggatcttgggtgaggggaggaggggcgccgccgcgatccggccagggagagatggccggcgggaaggagccgatcgaggtcaagttccggctttttgacggcacggacatcgggcccagcaagtacgacccctccacctccgtcacctcgctcaaggagttcatcctcgctcggtggccgcaggataaagaagttgttccaaaaactgtcaatgatgtgaaactcattaatgctggaagaatactggagaacaacaaaactcttgccgagtctcgagtcccagtaggagaagttcctggaggtgttataacgatgcatgttgtcgtgcgccctccccaaagcgacaaaagtgagaagcagctttcaaattctcccaagcagaacagatgtggatgcacgatattgtgacaccgattcggctgcattgtgtattctgtatattggtgccatgctcacatcgattgcaagttcaccctaacattgattcttgcaagctattcttgaaagcctagagacggtaattaacaccatacgtaaatcatcatccctgctcgacagtaaagtttttctccggagttcatagtggagggcgccatccatatttatgtaagctgtaacgagtgcgaaggagtgcaggggtcaagtgctggatgctcgctgttgctttaagatgtagaacctgtgtatttgaggtcgagaacgagctgccacttttctttcttttgctactacatatatacagtcatatagttcttgccgagatctttttcccgctgcatatgtgttatgtgaaaataggaatgtgtttgccagtagtttctgtccagaagtgtaaaaagggaatgtgacatgggactcaaccgatgggcagtgaagtttgtatttgccttttttttatcacgtcacgccaacaa

SEQ ID NO: 1231 - DNA, 1288 bp, Secale cereale
acaagacagctatttccctactacaactcgagagtaaatatagttttccgcgggggcgtatctgcgaaaacaccgacggaatcccactcccccttctctctctccctctcttcctccctaccctcgagacgcccgtctcgtcgctttgctccccacgaaagaattctaaattcttgcttaacaaaacgagaaagtggatcctatccttcgtgggatccgcatcggttcttgccctcgccgcgtcgggttcgccggcttttctttcctcccctgaatccctccgcccggccggccgccgtcgactgagccggcggttgttgggatcttgcgtcggggggcgatccggccggggggagatggccggcgggaaggagccgatcgaggtgaagttccgcctgttcgacggcacggacatcgggcccaacaagtacgaccccgccaccaccgtcaccgcgctcaaggagttcgtcctcgctcggtggccgcaggacaaagacattattccaaaaactctcaatgacgtgaagctcatcaatgctggaaggatacttgagaataacaaaactcttgctgagtcccgagtcccagtaggagaagttccaggaggtgtgatcacgatgcatgttgttgtacgccctccccaaagtgacaaaagtgataagcacctctccaattctcccaagcagaacagatgtgggtgcacgatattgtgacgcttttgattgagcccgcgttgtgtatttctgtatattggtgccatccatgctcacaacgattgcaagttcaccctaacacttgattcttgcaagccattcttgaatgaaatgcctagagacggtaacttaacacccatatatatttcatctctgctcgacagtaaagtttggttacagcgggggcccttccatacatccatgtaagctgtaacgggtatgcaggaagtcaagagctgggatgcttgctgttgttttaagatgtagacattgtgtagtgacgtcggaaatgaggttccacttcttattttttgcttctacatatatatactcgtcgtatagtatttgtcgagattttttcccccaagttgccactacatattatattgatatatgtaatagggaagtgatttctgtccagaagtgtaaagggaatatgttggactgacggaagggagtttgtatgtgtgttttggttcttctgtctcgtagtctttagaaaaacaaaaaaaaaaaaaaaagaaaaaaaaaaaactaaaagaagaagacgaccaagacgacgacaggagaggggg

SEQ ID NO: 1232 - DNA, 1518 bp, Hordeum vulgare
ccgaaaacgccgaggaatcccactcccccctcctctccctctcttcctcccctcgaggcgcccgtctcgtcgctttgctccccacgaaagaattctaaattcttgcttaacaaaacgagaaagcggatcctgtccttcgtgggatccgcatcggttcttgccctcgccgcgtcgaatccggcagctcttctttgctcccctgaatccctccgccgccgtccactgagccggcggtcgttgggatcttgcgtcggggggcgatccggccgggggcagagatggccggcgggaaggagccgatcgaggtgaagttccgcctgttcgacggcacggacatcgggcccaacaagtacgaccccgccaccaccgtcaccgcgctcaaggagttcgtcctcgctcggtggccgcaggataaagacattgttccaaaaactctcaatgacgtgaagctcatcaatgctggaaggatacttgagaataacaaaactcttgctgagtctcgagtcccagtaggagaagttccaggaggtgtgatcacgatgcatgttgttgtacgccctccccaaagtgacaaaagtgataagcacctctcgaattctcccaagcagaacagatgtgggtgcacgatattgtgacgcttcggttcagcccgcgttgtgtatttctgtatattggtgccatccatccatgctcacaacgattgcaagttttcaccctaacaattgattcttgcaagccaattcttgaaaagcctagaggcggtaacttaacacccacatatatttcatctctgctcgacggtaaggtttggttacggcaggggcccttccacatatccatgtaagctgtaacgagtatgcaggaaagtcaagagctggggtactcgctgttgtttttaagatgtagacattgtgtagtgacgtcgtaaaatgaggttccacttcttcttttttgcttctacatatatactcgtatagtatttgttgagatttttcccactgagttgctgatactacatatatatatatccgttattataatgtaatagggaagtgatttctgtccaaaagtgtaaaggggatatgttggactgacggaaagcagtttgtatgtgtgttttggttcctctgtctgtagctacgccgccggctgtggagcagttgcggtgtcagaatgtgctggaccatgccagcggcaaccgctggtcgggctgtcgaccatggtgtcggttcggctgtaacgtcgaccagctaccatctgattgagcaaagaattgtgacaggctggctgacgatgacgggatgataacatggccagttttcttgtttcttcggctatccatttttaatggccatgaattaggaaaaggttgaaagttggtagtgccttttttagtcttcaaccactgcgcaacactagaggccccatctggatcgaaggaatttcctaacccatttggttaagacaatgcaacctccaaagaattataaacaaggaactggaactgacaccttgttg

SEQ ID NO: 1233 - DNA, 1641 bp, Hordeum vulgare
aaaaatcctgtcgacagacgcaatagtcgccactaagcagctgcaggtaggcgcaagacagctattttccgactacaactcgaggataaatacagttttccgcgggggacgtatctgcgaaaacgccgaggaatcccactcccccctcctctccctctcttcctcccctcgaggcgcccgtctcgtcgctttgctccccacgaaagaattctaaattcttgcttaacaaaacgagaaagcggatcctgtccttcgtgggatccgcatcggttcttgccctcgccgcgtcgaatccggcagctcttctttgctcccctgaatccctccgccgccgtccactgagccggcggtcgttgggatcttgcgtcggggggcgatccagccgggggcggagatggccggcgggaaggagccgatcgaggtgaagttccgcctgttcgacggcacggacatcgggcccaacaagtacgaccccgccaccaccgtcaccgcgctcaaggagttcgtcctcgctcggtggccgcaggataaagacattgttccaaaaactctcaatgacgtgaagctcatcaatgctggaaggatacttgagaataacaaaactcttgctgagtctcgagtcccagtaggagaagttccaggaggtgtgatcacgatgcatgttgttgtacgccctccccaaagtgacaaaagtgataagcacctctcgaattctcccaagcagaacagatgtgggtgcacgatattgtgacgcttcggttcagcccgcgttgtgtatttctgtatattggtgccatccatccatgctcacaacgattgcaagttttcaccctaacaattgattcttgcaagccaattcttgaaaagcctagaggcggtaacttaacacccacatatatttcatctctgctcgacggtaaggtttggttacggcaggggcccttccacatatccatgtaagctgtaacgagtatgcaggaaagtcaagagctggggtactcgctgttgtttttaagatgtagacattgtgtagtgacgtcgtaaaatgaggttccacttcttcttttttgcttctacatatatactcgtatagtatttgttgagatttttcccactgagttgctgatactacatatatatatatccgttattataatgtaatagggaagtgatttctgtccaaaagtgtaaaggggatatgttggactgacggaaagcagtttgtatgtgtgttttggttcctctgtctgtagctacgccgccggctgtggagcagttgcggtgtcagaatgtgctggaccatgccagcggcaaccgctggtcgggctgtcgaccatggtgtcggttcggctgtaacgtcgaccagctaccatctgattgagcaaagaattgtgacaggctggctgacgatgacgggatgataacatggccagttttcttgtttcttcggctatccatttttaatggccatgaattaggaaaaggttgaaagttggtagtgccttttttagtcttcaaccactgcgcaacactagaggccccatctggatcgaaggaatttcctaacccatttggttaagacaatgcaacctccaaagaattataaacaaggaactggaactgacaccttgttgcttttcc

SEQ ID NO: 1234 - DNA, 447 bp, Secale cereale
ttcccgggtcgactgagccggcggttgttgggatcttgcgtcggggggcgatccggccggggggagatggccggcgggaaggagccgatcgaggtgaagttccgcctgttcgacggcacggacatcgggcccaacaagtacgaccccgccaccaccgtcaccgcgctcaaggagttcgtcctcgctcggtggccgcaggacaaagacattattccaaaaactctcaatgacgtgaagctcatcaatgctggaaggatacttgagaataacaaaactcttgctgagtcccgagtcccggtaggagaagttccaggaggtgtgatcacgatgcatgttgttgtacgccctccccaaagtgacaaaagtgataagcacctctccaattctcccaagcagaacagatgtgggtgcacgatattgtgacgctttcgattcagcccgcgttgt

SEQ ID NO: 1235 - DNA, 999 bp, Triticum aestivum
gctccccacgaaagaattctaaattcttgcttaacaaaacgagaaagcggatcctatccttcgtgggatccgcatcggttcttgccctcgccgcgccgaatccggcagcttttctttcctcccctgaatccctccgcccggccagccgccgtcgactgagccggcggttgttgggatcttgcgtcggggggcgatccggcccggggggagatggccggcgggaaggagccgatcgaggtgaagttccgcctgttcgacggcacggacatcgggcccaacaagtacgaccccgccaccaccgtcaccgcgctcaaggagttcgtcctcgctcggtggccgcaggacaaagacattattccaaaaactctcaatgacgtgaagctcatcaatgctggaaggatacttgagaataacaaaactcttgctgagtctcgagtcccagtaggggaagttccaggaggtgtgatcacgatgcatgttgttgtacgccctccccaaagtgacaaaagtgataagcacctctcgaattctcccaagcagaacagatgtgggtgcacgatattgtgacgctttcgattcagcccgcgttgtgtatttctgtatattggtgccatccatgctcacaacgattgcaagttcaccctaacacttgattcttgcaagccattcttgaatgaaatgcctagagacggtaacttaacacccatatatatttcatctctgctcgacagtacgtttggttacagcggggggcccttccatacatccatgtaagctgtaacgggtatgcaggaagtcaagagctgggatgcttgctgttgttttaagatgtagacattgtgtagtgacgtcggaaatgaggttccacttcttattttttgcttctacatatatactcgtcgtatagtatttgtcgagattttttcccccaagttgccactgcatattatatataaatatgtaatagggaagtgatttctgtccagaagtgtaaaggga

SEQ ID NO: 1236 - DNA, 1455 bp, Triticum aestivum
gctccccacgaaagaattctaaattcttgcttaacaaaacgagaaagcggatcctatccttcgtgggatccgcatcggttcttgccctcgccgcgccgaatccggcagcttttctttcctcccctgaatccctccgcccggccagccgccgtcgactgagccggcggttgttgggatcttgcgtcggggggcgatccggcccggggggagatggccggcgggaaggagccgatcgaggtgaagttccgcctgttcgacggcacggacatcgggcccaacaagtacgaccccgccaccaccgtcaccgcgctcaaggagttcgtcctcgctcggtggccgcaggacaaagacattattccaaaaactctcaatgacgtgaagctcatcaatgctggaaggatacttgagaataacaaaactcttgctgagtctcgagtcccagtaggggaagttccaggaggtgtgatcacgatgcatgttgttgtacgccctccccaaagtgacaaaagtgataagcacctctcgaattctcccaagcagaacagatgtgggtgcacgatattgtgacgctttcgattcagcccgcgttgtgtatttctgtatattggtgccatccatgctcacaacgattgcaagttcaccctaacacttgattcttgcaagccattcttgaatgaaatgcctagagacggtaacttaacacccatatatatttcatctctgctcgacagtaacgtttggttacagcggggggcccttccatacatccatgtaagctgtaacgggtatgcaggaagtcaagagctgggatgcttgctgttgttttaagatgtagacattgtgtagtgacgtcggaaatgaggttccacttcttattttttgcttctacatatatactcgtatagtatttgtcgagattttttcccccaagttgccactgcatattatatataaatatgtaacagggaagtgatttctgtccagaagtgtaaagggagtatgttggactgacggaaggcagtttgtatgtgtgttttggttcttctgctcgtagctttgctttgcagttgcagctgtgggtgcagttgccttgtcagtatgtgctggaccgcgccggcggcagccgctggtcgggctgtcgaccatggcgtcggtttggctgtcacgtcggccagctaccatctgactgagcaaagattgtgacgagggtggctgacgacgccgagggatgataacgcggcctagtttccttgttactttgcctctcctatttttaactggtcatgaactaggtaaatgtagtaaggtgggtagggtgtcctttttagtcttctattcttacaacctctccgctaatactagacgtccgtctggatcgtaaggtaacttcctaacgtcgctacaatacttcacgtaccagtacggtaagttcggtggtactctacaaacgtaaac

SEQ ID NO: 1237 - DNA, 463 bp, Secale cereale
tttcaacccccatccgcaggaaagcaggaattcttcgcaagaatccgaccgcgggccgatttgcgtggattccgtgcggccctttctgcgccatggacttctgatccgggccccctcggatcttgggaggaaggcgggcggtgagccggccggccgcgccgggagatggccggcgggaaggagccgatcgaggtcaagttccggctcttcgacggcacggacatcggccccagcaagtacgaccccgccaccaccgtctccgcgctcaaggacttcatcctcgcccggtggccgcaagataaggaaataactccgaaaactgtgaatgacctgaagctcatcaatggtggaaagatattggagaataaccggacacttgccgagtcgcgtgttacaataggagaggtccctggaggtgtaattacaatgcatgtggtagtgcgccctccacaagttgacaaaa

SEQ ID NO: 1238 - DNA, 921 bp, Pseudoroegneria spicata
gtctcgtcgctttgctccccacgaaagaattctaaattcttgcttaacaaaacgagaaagcggatcctatccttcgtgggatccgcatcggttcttgccctcgctgcgccggattcgccagcttttctttcctcctctgaatccctccgcccggccgccgccgtcgactgagccggcggttgttgggatcttgcgtcgcggggcgatccggccgtggggagatggccggcgggaaggagccgatcgaggtgaagttccgcctcttcgacggcacggacatcgggcccaacaagtacgaccccgccaccaccgtcaccgcgctcaaggagttcgtcctcgctcggtggccgcaggataaagacattgttccaaaaactctcaatgacgtgaagctcatcaatgctggaaggatacttgagaataacaaaactcttgctgagtctcgagttccagtaggagatgttccaggaggtgtgatcacgatgcatgttgttgtacgccctccccaaagtgacaaaagtgataagcacctctcgaattctcccaagcagaacagatgtgggtgcacgatattgtgacgctttccattcagcccgcgttgtgtatttctgtatattggtgccatccatgctcacaacgattgcaagttcaccctaacaattgattcttgcaagccaattcttgaaaagcctagagacggtaactttaacaccatatatatttcatctctgctcgacagtaatgtttggttacagcgggggcccttccacatatccatgtaagctgtaatgagtatgcaggaagccaagagctgagatgctcgctgttgttttaagatgtagacattgtgtagtgacgtcgaaaatgaggttccacttcttttttgcttctatatatatactcgtatagtatttgtcgaga

SEQ ID NO: 1239 - DNA, 985 bp, Avena sativa
cccactccttccttctctctccccttgagacgcccgtctcgtcgctttgctccccacgaaagaattctaaattcttgcttaactaaaggagaaagcggatccttcgtgggatccgccgcatcggtttcttgccctggttgcgccgaatttggcagctttcctccccgaattcctctgccggcccgtggtcgactgagccggccagcgcagcggttgttgggatcttgcgtaggaggtgcgccgtgatccggccgggaagatggccggcgggaaagagccgatcgaggtgaagtttcggctgttcgacggcacggacatcgggcccaacaagtacgacccctccaccaccgtcaccgcgctcaaggagttcgtcctcgctcggtggccgcaggataaagatgttattccaaaaactcttaatgacgtgaagctcatcaatgctggaaggatactggagaacaacaaaactcttgctgagtctcgagtcccagtaggagaagttccaggaggtgtgatcacaatgcatgttgtcgtacgccctccccagagtgacaaaagtgagaagcacctgtcgaattctcccaagcagaacagatgtggatgcacgatattgtgacgccgattcatcccccattgtgtattctgtatattggtgccatgctcagaaagattgcgagtcggccctaacgattggttcttgaaagcctaagagacggtaattaacaccacatgttatatcatctttgctcgacggtgaagttttctctggagttgacagcggggtcttctgtacccatgttcaggagtcgagacctggatgtttgctgttgttttaagttgtagaacatgtgcggtgatgtcaaaaaacgaagtgccacttttttctgatactacatatatatagccgtatagcatttctcgagattttttacgccagttgctactatacatatatatattttattctgttatttgtaatagggaa

SEQ ID NO: 1240 - DNA, 1113 bp, Pennisetum glaucum
gatcccccgcgggatccgcatcggtgtttgcccttcctccggcctcgagacgcccgtctcctcctcgctttgccccccacgaagcaattctaaatcctcgcggcagaagatcggatcccccgcgggatccgcatcggtgtttgcccttcctgcgcggatttccggcagcctttttcctcttcccctggtttcttccctctgccgattccctgctcctgccgcggtggttgttcctgtagcctgttgggggatcttagcagcagcaggaggaggaggggttggttaggcggtacccgcgatccggcgccgggggagatggccggcgggaaggagccgatcgaggtgaagttccggctcttcgacggcaccgacatcgggcccagcaagtacgaccccaacaccaccgtcgccgcgctcaaggagttcgtcctctcccggtggccgcaggataaagaaatagttcctaaaactgtcaatgatgtgaagctcatcaatgctggaaggatactggagaacagcaaaactcttgccgagtcacgagtcccagttggagaagttcctggaagtgtgattacgatgcatgttgttgtgcggcctccccaatcaaataaaagtgagaagcaacagtcaaactctccgaagcagaacagatgtggatgtaccatattgtgacgtctgtgcaataccaatgtgtatattggtgccgtgtccacaggcatcacaagttcattttgacaattgattcgtgcatctattcttcacagcctaagcctagagatgtcattaccactggccacatctgcttgagaatttgatgctttctatcgtgtaaaaggagtgtggagggaggacatttcacgaagagccctgacaaaaattctaaaacgagtgtgcaggagtctagaaaattggatgtttgcttttgtgtattgtgtagacgtagggataccaaaagtgagtggctgcatagtacctgtcaagagactcaagacgttccttttcatttgcatcaagctcggtcacgtatgtgttttgtaatgaaaaaagtgactggtaattcttgtcgagtaagtggagaggaatgttgggtttggcatgggatcaaaaaaaaaa

SEQ ID NO: 1241 - DNA, 959 bp, Avena sativa
cccactccttccttctctctccccttgagacgcccgtctcgtcgctttgctccccacgaaagaattctaaattcttgcttaactaaaggagaaagcggatccttcgtgggatccgccgcatcggtttcttgccctggttgcgccgaatttggcagctttcctccccgaattcctctgccggcccgtggtcgactgagccggccagcgcagcggttgttgggatcttgcgtaggaggtgcgccgtgatccggccgggaagatggccggcgggaaagagccgatcgaggtgaagtttcggctgttcgacggcacggacatcgggcccaacaagtacgacccctccaccaccgtcaccgcgctcaaggagttcgtcctcgctcggtggccgcaggataaagatgttattccaaaaactcttaatgacgtgaagctcatcaatgctggaaggatactggagaacaacaaaactcttgctgagtctcgagtcccagtaggagaagttccaggaggtgtgatcacaatgcatgttgtcgtacgccctccccagagtgacaaaagtgagaagcacctgtcgaattctcccaagcagaacagatgtggatgcacgatattgtgacgccgattcatcccccattgtgtattctgtatattggtgccatgctcagaaagattgcgagtcggccctaacgattggttcttgaaagcctaagagacggtaattaacaccacatgttatatcatctttgctcgacggtgaagttttctctggagttgacagcggggtcttctgtacccatgttcaggagtcgagacctggatgtttgctgttgttttaagttgtagaacatgtgcggtgatgtcaaaaaacgaagtgccacttttttctgatactacatatatatagccgtatagcatttctcgagattttttacgccagttgctactatacatatatatat

SEQ ID NO: 1242 - DNA, 1152 bp, Sorghum bicolor
gtatctgttaaaacgctcacaaatcccattcctcctgtctcctcccgtcctccgcctcgagacgcccgtctcctcatcgctttgccccccacgaagcaattctaaatcctcgcgcagaagatcggatcctctcgtgggatccgcatcggtgcttgccctccctgctcggatttctggcagccctttccttcccccctgaattcctgtgcggtttccctcccctgccccggcggtttctcctgttgcctgttgggatcttgggaggaggaggaaggggttggtgggggtgtggaaggcgcccgcgatccggcccgtggagatggccggcgggaaggagccgatcgaggtgaagttccggctgttcgacggcaccgacatcgggcccagcaagtacgaccccaacaccaccgtcaccgcgctcaaggagttcgtcctcgcccggtggccgcaggataaagaaatagttccaaaaactgtcaatgatgtgaagctcatcaatgctggaaggatactggagaatagcaaaactcttgctgaatctcgagtcccagttggagaagttcctggaagtgtgattacgatgcatgttgttgtgcggcctccccaatctaacaaaagtgagaagcaacagtcaaactccccgaagccgaacagatgtggatgcacgatattgtgacgttgatgcaagtagcaatgtgtatatcggtgtccacagggatcacaagttcatttaacaattgattcttgcatctattcttcacagcctaagtgtagagatggtgttacggcgaatcacatctgtttgagaatttgatgcttgcgatcgtatgtttgagtgtgcaggaaggatagttcacggggtcctggtaaaacccttaaaaacggtgtggaggagtcaaggaattggatgtttgctattgtgtaatgtgtagagatagtgataccagaagtgagttgctgcatagtacatcggagacaattctttttcgtagctcgattgcgtatatcggtatatgtcttttgtaatagaaaaaagatgactggctgttcttgttataaagtggtacggaatactgctggaagtttggcatgggacgatgaaagtgaatattgaccagtaatataatgcactaatattctctctgttttaaa

SEQ ID NO: 1243 - DNA, 1142 bp, Setaria italica
tcgcggcagaagatcggatcctccgcgggatccgcatcggtgcttgcccttcctgcgcggatttccggcagcctttttcttttcccctggtttcctctgccgattccctgctcctgccgcggcggttgttcctgtagcctgttgggggatcttagcagcagcagcaggaggggttggtgggggttggccgcgatccggtccggggagatggccggcgggaaggagccgatcgaggtgaagttccggctcttcgacggcaccgacatcggacccagcaagtacgaccccaacaccaccgtcgccgcgctcaaggagttcgtcctcgcccggtggccgcaggataaagtagttccgaaaactgtcaatgatgtgaagctcatcaatgctggaaggatactggagaatagcaaaactcttgctgagtcacgagtcccagttggagaagttcctggaagtgtgattacaatgcatgttgttgtgcggcctccccaatcaaacaaaagtgagaagcaacagtcaaactctccgaagcagaatagatgtggatgtacaatattgtgacgctggtgcagtacccatgtgtatatcggtgtcgtgtccacaggggtcacatgttcattttgacaactgattcttgcatctattcttcacagcctaagcctagagatgtcattaccactggccacatctgcttgagaatttgatgtttgctatcgtgtaaaaggagtgtgcagggaggagatttcacgggtggccctggtaaaaaccctaaaacgagtgtgcaggagtcaagaaaattggatgtttgcttttgtgtaatgtgtagacgtagtgataccaaaagtgagttgctgcatagtacctgtcaagacgttctttttcatttgcatcaagctcggtcacgtatatgtgttttgtaatagaaaaaagtgactggtaattcttgtcgagaagtggaaaagaatgttggggtttggcatggaacctatgaaagtgaaaaaaatgactagtaatatttgtgaagtggaaaggaaggcattgattttgaatctttctccgacctagactgaaccctcatcttgttaggccatgtaatttttcctggtcatgtaattttgagttgttagtctgttatgtttaag

SEQ ID NO: 1244 - DNA, 1152 bp, Sorghum bicolor
tgtatctgttaaaacgctcacaaatcccattcctcctgtctcctcccgtcctccgcctcgagacgcccgtctcctcatcgctttgccccccacgaagcaattctaaatcctcgcgcagaagatcggatcctctcgtgggatccgcatcggtgcttgccctccctgctcggatttctggcagccctttccttcccccctgaattcctgtgcggtttccctcccctgccccggcggtttctcctgttgcctgttgggatcttgggaggaggaggaaggggttggtgggggtgtggaaggcgcccgcgatccggcccgtggagatggccgacgggaaggagccgatcgaggtgaagttccggctgttcgacggcaccgacatcgggcccagcaagtacgaccccaacaccaccgtcaccgcgctcaaggagttcgtcctcgcccggtggccgcaggataaagaaatagttccaaaaactgtcaatgatgtgaagctcatcaatgctggaaggatactggagaatagcaaaactcttgctgaatctcgagtcccagttggagaagttcctggaagtgtgattacgatgcatgttgttgtgcggcctccccaatctaacaaaagtgagaagcaacagtcaaactccccgaagccgaacagatgtggatgcacgatattgtgacgttgatgcaagtagcaatgtgtatatcggtgtccacagggatcacaagttcatttaacaattgattcttgcatctattcttcacagcctaagtgtagagatggtgttacggcgaatcacatctgtttgagaatttgatgcttgcgatcgtatgtttgagtgtgcaggaaggatagttcacggggtcctggtaaaacccttaaaaacggtgtggaggagtcaaggaattggatgtttgctattgtgtaatgtgtagagatagtgataccagaagtgagttgctgcatagtacatcggagacaattctttttcgtagctcgattgcgtatatcggtatatgtcttttgtaatagaaaaaagatgactggctgttcttgttataaagtggtacggaatactgctggaagtttggcatgggacgatgaaagtgaatattgaccagtaatataatgcactaatattctctctgttttaa

SEQ ID NO: 1245 - DNA, 1027 bp, Panicum virgatum
  misc_feature (48)..(48): n is a, c, g, or t
  misc_feature (66)..(66): n is a, c, g, or t
  misc_feature (100)..(100): n is a, c, g, or t
  misc_feature (104)..(104): n is a, c, g, or t
  misc_feature (134)..(134): n is a, c, g, or t
  misc_feature (160)..(160): n is a, c, g, or t
  misc_feature (164)..(164): n is a, c, g, or t
  misc_feature (208)..(208): n is a, c, g, or t
  misc_feature (215)..(215): n is a, c, g, or t
  misc_feature (322)..(322): n is a, c, g, or t
  misc_feature (355)..(355): n is a, c, g, or t
  misc_feature (449)..(449): n is a, c, g, or t
  misc_feature (485)..(485): n is a, c, g, or t
  misc_feature (784)..(784): n is a, c, g, or t
ccacgaagcaattctaaatcctcgcgcggaagatcggatcctccgcgngatccgcatcggtgcttncccttcctgcgcggatttccggcagccttttccncccnaaccctgatttcccctgccgattccctgcncctgccgcggcggttgttcctgcagnctgntggggggatctttggtggaggagggagttggtgggggttggttnggcggcncccgcgatccggcccggggagatggccggcgggaaggagccgatcgaggtgaagttccggctcttcgacggcaccgacatcgggcctagcaagtacgaccccagcancaccgtcgccgcgctcaaggagttcgtcctcgnccggtggccgcaggataaagaaatagttccaaaaactgtcaatgatgtgaagctcatcaatgctggaaggatactggagaatagcaaaactctngccgagtcacgagtcccagttggagaagttcctggnagtgtgattacaatgcatgttgttgtgcggcctccccaatcaaacaaaagtgagaagcaacagtcaaactctccgaagcagaacagatgcggatgtacgatattgtgatgttgatgcagtagaaatgtgtatatcggtgttgtgtccacagggatcacaagttcattttgacaattgattcttgcgtctattcatcacagcccaagcctagatatgtcattaccactagccacatctgcttgagaatttgatgcttgctatcgtgtaaaaggagtgtggtggaaggagatttctcaggnggtcctggtaaaaaccctaaaaggagtgtgcaggagtcaaggaaattggatgtttgcttttatgggatgtgtagacgtagtgataccaaaagtgagttgctgcatagtacctgtcaagtctttctttttcgtttgcgtcaagctcggtcacgtatgtgttttgtaatagaaaaagtgactggtaattcttgtcgagaagtggaaaggaatgttgggttttgccggtttggcatgggactgacg

SEQ ID NO: 1246 - DNA, 1127 bp, Setaria italica
gtatctgtcaaaacgccgacgaatcccactcgccctttctctcctccgcctcgagacgcccgtctcctcctcgctttgccccccacgaagcaattctcgcggcagaagatcggatcctccgcgggatccgcatcggtgcttgcccttcctgcgcggatttccggcagcctttttcttttcccctggtttcctctgccgattccctgctcctgccgcggcggttgttcctgtagcctgttgggggatcttagcagcagcagcaggaggggttggtgggggttggccgcgatccggtccggggagatggccggcgggaaggagccgatcgaggtgaagttccggctctttgacggcaccgacatcggacccagcaagtacgaccccaacaccaccgtcgccgcgctcaaggagttcgtcctcgcccggtggccgcatgataaagtagttccgaaaactgtcaatgatgtgaagctcatcaatgctggaaggatactggagaatagcaaaactcttgctgagtcacgagtcccagttggagaagttcctggaagtgtgattacaatgcatgttgttgtgcggcctccccaatcaaacaaaagtgagaagcaacagtcaaactctccgaagcagaatagatgtggatgtacaatattgtgacgctggtgcagtaccaatgtgtatatcggtgtcgtgtccacaggggtcacatgttcattttgacaattgattcttgcatctattcttcacagcctaagcctagagatgtcattaccactggccacatctgcttgagaatttgatgtttgctatcgtgtaaaaggagtgtgcagggaggagatttcacgggtggccctggtaaaaaccctaaaacgagtgtgcaggagtcaagaaaattcgatgtttgcttttgtgtaatgtgtagacgtagtgataccaaaagtgagttgctgcatagtacctgtcaagacgttctttttcatttgcatcaagctcggtcacgtatatgtgttttgtaatagaaaaaagtgactggtaattcttgtcgagaagtggaaaagaatgttggggtttggcatggaacctatgaaagtgaaaaaaatgactagtaatatttgtgaagtggaaag

SEQ ID NO: 1247 - DNA, 1120 bp, Zea mays
attaaatcgcccacaattccctgtcctccgcggctccgcctcgatacggccgtctcctccccgctttgctccccacgaagcaattctaaatcctcgcgcagaagatcggatcctccgtcagatccggatcggtgcttgccctccctgctcggatttctggcagccctttcctaccccctgaattcctgtgcggattccctcccctgccctggcggttgctcctgttgcctggtgggaacttgagagtagaggaggggttggtggggtggaaggcgctcgtgacccggcccgtggagatggctggcgtgaaggagccgatcgaggtgaagttccggctgtccgacggcaccgacatcgggcccagcaagtacgatcccaacaccaccgtcgccgcgctcaaggagttcgtcctcgcccggtggccgcaggataaagaaatagctccaaaaactgtcaatgatgtgaagctcatcaatgttggaaggatactggagaatagcagaactcttgctgaatctcgtgtcccagttggagaagttcctggaagtgtgattacaatgcatgttgttgtgcggcctccccaatctaaaaacagtgagaagcaacagtcaaactctccgaagccaaacagatgtggatgcacgatattgtgacgttgatgcaagtagcaatgtgtatatcggtgtccacagagatcaatcacaagttcatttagcaattgattcaatctattcttcacaacctaagcctagagttggtgttacggccagtcacatctggcttgagaaattgatgcttgcggtcgtgttcgagtgtgcaaggagttcacagggtcctggtaaaaccctgaaatcggtgtggactcaaggaattggatgtttgctattctgtaatgtgtggagacagtgataccagaagtgagttgctgcatagttacatcggagacaattcttttttcgtaactcggttgcgtgtatcagtatttctgttttgtaatagaaaaaggttgaccggctattgttggcataaagtggtaaggaatgggggtcccctaaggaatgctgtggtttgacatgggaagatgaaagtgaataatgagtaccattctggttcacctttt

SEQ ID NO: 1248 - DNA, 902 bp, Saccharum officinarum
atccgcatcggtgcttgccctccctgctcggatttctggcagccctttcctccaccccctgaattcctgtgcggattccctcccctgccccggcggcgctctgttgcctgttgggatcttggaggaggaggggttggttgggggtggaaggcgcccgcgatccggccgtggagatggccggcgggaaggagccgatcgaggtgaagttccggctgttcgacggcaccgacatcgggcccagcaagtacgaccccaacaccaccgtcgccgcgctcaaggattcgtcctcgcccggtggccgcaggataaaaaaatagttccgaaaactgcaatgatgtgaagctcatcaatgctggaaggatactggagaatagcaaaactcttgctgaatctcgagtcccagttggagaagttcctggaagtgtgattacaatgcatgttgttgtgcggcctcctcaatctaacaaaagtgacaagcaacagtcaaactccccgaagccgaacagatgcggatgcacgatattgtgacgttgatgcaagtagcaatgtgtatatcggtgaccacagggatcacaagttcatttaacaattgattcttgcatctattcttcacagcctaagcttagagatggtgttacggccagtcacatctgcttgagaatttgatgcttgcgatcgtgtgttcgagtgtgcaggaaggatagtccacggggtcctggtaaaacccttaaaacggtgtggagtcaaggaattggatgtttgctattgtgtaatgtgtagagatagtgataccagaagtgagttgctgcatagtacatcggagctttttcgtagctcggttgcgtatatcggtatatgtgttttgtaaaaaaaaaaaaggtgactggctattcttggcatat

SEQ ID NO: 1249 - DNA, 1338 bp, Elaeis guineensis
aaaattgcatgttcggctttagtttccttccccactggttacaaaaacagagtgcggaggaggggggagttttgggagagaagcgagctcttcttcgggtctttcctctcacccatttcgacgacgtctgcagcgaattcccaattgggattcctatttggcctgttggaatccctcaaatccaatttttatgtcaaaaatgacgtggtaggaggggtttgggtttgatttgtcattctgggatccggaaattcgatcgcggttgtcgtcgaaatcgaacaaaatttggttttcgaggtgaggaagccatttctcgtccgagatttcgaagagctgggttgctggttgagagggaacctggtaatttgacatggatcttgctgattgctgttttctttgaagatccatcacgaatcgttgaatttgatccgaattgttagggatttgcctttgtggacaccagaagttgtcggaatttatgattttgggtgggattgattggaattgtaggcaggagatcatggagaattgagtggagggttctctttcttcatctaaagtggttttcgaatggctggagatgatttgattgagctcaaatttaggctttttgatggcacggacattgggccaagcaagtatgatccttcgaccaccgttgcatctctcaaagaaaccatcctgtctcgatggccgcaagacaaagaaattgctccaaaaacaataaatgatttgaagctcatcaatggtgggaaaatattggagaacaacaggactcttgctgagtccggggtaccggttggagagcttccaggtggtgtaataaccatgcacgttgttgtgcggcctccccaacttgacaaaaacaacgagaaacaactcgcaaatgccccaaagcagaacagatgtgcgtgcacaatcctgtgataccagattgtaattccttagatcatctccggtcggctctttggtgtcaatattttcactgttagttgattggcgggctgcaaaaaatcagtcaaatggcattgctgttgcatgatgatttggacgtagctcctatacatgataacgatagtcatcttttttatgactagagttttgctacggtcctggggtttagcccatctgattgcgcaggaggaattggaaacatgttgtggttgtataactgggggttttgagacaagaactacttgtttgctactttgctatgatctttgtattatcgaatgattctttttaaaagattgattctatttctgagaatcccttgttttgtttcaggcttgccctggaaaacaaaggaaaaaaaaaaactaaacgtaggacgtacgt

SEQ ID NO: 1250 - DNA, 955 bp, Triticum aestivum
gcacgctgcagtttcggccacgggaaaacgtttggatggaggcgctgggcctcctgggccgcgcgtgccgcctcggccacttccgccgccgcagcacggccactcctccccctccccctcctcgcagcaacagcaagcgctgcagagccgtgcgcgccggagccagagccgcctcgtcgtcggcgccgcgggcgatggaagccaagcgggaggagccgagggtggtgacgctgcggccggtggaggccacgccggagtccttcgcgcccttcgggcaggtcatcgccgcctcccccgacggcgaccagttcggcccccacgacgcccagctcgacctcagccgcggcatccccaggttctacatcatgagattggagagcaggccgctcaagttctcgtccatcacccaccacgccagcgtcacgcagtgcctgggctccatcggcggccaggactggtacctcggcgtggccaagccttccatcgttgacggggcgacggagcagagtggtggcgggagtgccgtgcagtcgcgcgctgggcatttctatctgcccccggacccgtccgaggtctgcgtcttccgtgtctccggtccgaaatttctcaagctgcacgccgggacctggcacgccgggccgctgttcaaggcagacgccgtggatttctataatctggagctgagcaacaccaatatcgtggatcacaccacgcactacttcaagaagcaggacggcgtaacctttgtgatcgaggactgagacgctgcgtcctaggcacaaaagctcggcgcagcgtgtgcctcgcggacgctgttcgtgccatgtctgtctctccgtgtgattgaacatccagtatgtatgtgtatgcaataatgtactatgcgtactgcatgtcatttgtacgtgcctacgtacgcatcggccgcctccctgggcgtttatttgtgtcgttg

SEQ ID NO: 1251 - DNA, 986 bp, Avena sativa
cacgcgaaaaaaactcctcgagacggacccgaggtgaccgaagccgggtcgacgcgagcgggatgcagcaggcgctgggcctgggccacgcgtgcagcctcggccgttactgccgccgcagcacggctaccactcctcccccttcccctccacctcatcgcaccaacagcaagagcggcagagccgtgcgcgccgaagctgcctcgtcagcgccgcagacgatggaagccaagctggaggagccaagggtggtgaagctgcgggccgtggaggccacgccggagtccttcgcgccgttcgggcaggtcatcgccgcctcccccgacggcgaccagttcgggccccacgacgcccagctcgacctcagccgcggcatccctaggttctacatcatgagattggagagcaaaccgctcaagttctcgtcaatcacccaccacgccagcgtgacgcagtgcctgggatccatcggcggccaggattggtacctcggcgtcgccaaatcttccatcgtggacggggcgccgccggaacagagtggcggcaggagtcccgtgcagtcgcgcgctgggcatttctacctgcctcccgatccggccgaggtctgcgtcttcagggtctccggtccgaaatttctcaagctgcacgcggggacctggcacgccgggccgctgttcaaggcagacgccgtggatttctataacctggagctcagcaacaccaatgttgtcgatcacaccacgcactacttcaagaaacaagacggcgtaacctttgtgatcgaggattgaaatgccacacgcgtcgcggcctaggcacgaagctggagcgcaccggcgcgccctcaggtcgtgttcgtgtcttcctggcttttgtaacgagaacaacctgtgtgtaaatgtaataatgtgattacagctttacaagtcaggcatgatgtactatgtctgagcttcttcttcagagtcgttgctgctggtagtcgc

SEQ ID NO: 1252 - DNA, 918 bp, Triticum aestivum
cctctccatcctcctcctcgcaggaacagcaagcgcggcagagccgtgcgcgccggagccagagccgcctcgtcgtcggcgccgcaggcgatggaagccaaacgggaggaggagccgagggtgatgacgctccggccggtggaggccacgcaggagtccttcgcgcccttcgggcaggtcatcgccgcctcccccgacggcgaccagttcggcccccacgacgcccagctcgacctcagccgcggcatccctaggttctacatcatgagattggagagcaggccgctcaagttctcttccatcacccaccacgccagcgtcacgcagtgcctgggctccatcggcggccaggattggtacctcggcgtggccaagccctccatcgtggacgggcagagtggccaggaccgtggcaggagtctcgtgcagtcgcgcgctgggcatttctatctgcctcccgatccgtccgaggtctgcgtcttccgggtctctggtcccaagtttctcaagctgcacgcagggacctggcacgccgggccgctgttcaaggcagacgccgtggatttctataacctggagctcagcaacaccaatatcgtggatcacaccacgcactacttcaagaagcacgacggtgtaacctttgtgatcgatgactgagacgctgcgtcccaggcacaaaagctcagcgcagcgtgtgcctcgcggacgctgttcgtgccctgtctctcggtgtgattgaacatccagtatgtatgtgtatgcaataatgcacctactgcaagtcatttgtacgtacttacgtacgcatcggccgctccctgggcgtttgtttgtgtcgttgtttctgctgacacccggcgttggagatgcccctgacactgacataatgaaaaaggcaacggcttaacggatttt

SEQ ID NO: 1253 - DNA, 1310 bp, Pseudoroegneria spicata
  misc_feature (192)..(192): n is a, c, g, or t
  misc_feature (1129)..(1129): n is a, c, g, or t
tgaaaagcagcaccgagaagggaacggcttggactggaagcgacccgcgtccaccaccgccgctttccccgtctcctccccctcctcctcaccgcgcggcgacgccgagcgacccagcggcgagcccggcatgcatcacgaccccaaccccttcgacgagggcaccgccggcgacgaaaaccccttctccantggaggaggccgaggcgggaagcagcagtacggcttccggccgaccgagcccgtcggcttcggcggcggcggcagcaggggcgacgccaccgtcgacgtgcccctcgacaacatgggcgactcgaatggcaaggcgagggagctctcgtcgtgggaatcagatctgaggcggcgtgaggcggacatcaaaaggagggaggaatcgctgaagaatgctggagtgcccatggaggagaagaattggccgccttttttcccgattatccaccatgacatcgccaatgagatacctgcgaacgtgcagaagttacagtatctggcgtttgcaagctggcttggaattgtgctctgcctctcctggaactttattgctgtcatagtctgctggatcaaggagggagattcaaagctgttcttccttgctacaatctatgctttgcttggaattcccctttcttacttgatgtggtatcgacccctctatcgtgcaatgaggactaacagtgcattcagttttggatggtttttcctgtgttatctgatccacattggtttttgcataattgctgccattgctccgccaattgtattccaagggaaatcattaacgggcatattggccgcgatcgacactttctctgagcatttgataattgggatcttttacttcgtggggtttgcactattttgcttggagacactgttgagcatcggggttcttcagaaagtatacatgtacttccgagggcataagtgaagcagacatggatggaaaaatttcggaagtctacaagcagcagtgattctgtccatatgtgtcagtacaccttgagtctatgttctgttctgcctaaggttatcgaggaatgcttctgagcctgaatggagtatggaaggtagccctgctactataggatgttctctaagatggggtgtngagattctttatatactgtgcttcgtgtgttatctggtagttcgtttgggagtttggcatgtcgatgaacattacagtagtcagtattgtattattaaacgaagatgagcaactgggcaggaatcatatttgttcatccaagcatcctccggcttgaattgtccaggaggtatagcaatta

SEQ ID NO: 1254 - DNA, 1596 bp, Triticum aestivum
ggcttggactggaagcgacccgcgtccaccaccgccgctttccccgtctccccctcaccgcgcggcgacgccgagcgacccagcggcgagcccggcatgcatcacgaccccaaccccttcgacgagggcaccgccggcgacgagaaccccttctccaatggaggaggccgcggcgggaagcagcagcacggcttccggccgaccgagcccgtcggcttcggcggcggcggcagcaggggcgacgccaccgtcgacgtgcccctcggcaacatgggcgactcgaatggcaaggcgagggagctctcgtcgtgggaatcagatctgaggcggcgtgaggcggatatcaaaaggagggaggagtcgctgaagaatgctggagtgcccatggaggagaagaattggccaccttttttcccgattatccaccatgacatcgccaatgagatacctgccaacgtgcagaagttacagtatctggcgtttgcaagctggcttggaattgtgctctgcctgtcctggaactttattgctgtcatagtctgctggatcaaggagggagattcaaagctgttcttccttgctacaatctatgctttgcttggaattcccctttcttacttgatgtggtatcgacccctctatcgtgcaatgaggactaacagtgcattcagttttggatggtttttcctgtgttatctgatccacattggtttttgcataattgctgccattgctccgccaattgtattccaagggaaatcattaacgggcatattggccgcgatcgacactttctctgagcatttgataattgggatcttctacttcgtggggtttgcactattttgcttggagacactgctgagcatcggggttcttcagaaagtatacatgtacttccgagggcataagtgaagcggtctgggatggaaagttttccgaagtctataagcagcagtgattgtgtccatatgtgtcagtacaccttgagtctgttctgttctgccaaaggttgtcgaaaaatgcttctgagcctgaatggagtatggaaggtagccctgctactataggatgttctctatggggtgttgagattctttatatgctgtacttcgtgtgttatctggtagatctcctgcaagtttggcatgtcggtgaacattacaagtagtcagtagttaaacgaagaatatgaacaactaggcaggaatcatgttctttcgagaattagtggcgatgctctgctatgtgctttggatgactagatgtttgttaaattgcccagttatagcaaattcgtccggtgtcacttgatgtgatgctattattgagctgctgcttcgttgaccccaaatatatcctgttaacagccgttctttaataacttaggattttttcctcgcctaggcatagctttggtctttgatgactttgctcattgccggtgtgttttatttgtgtgtgcgttggtgtggctctgtgcatcttagttgtgtacaggccggatgtgtgctatcgtgtctgtatccacttggtgcgtcattttgagtcaataaatcgatcctttaccgacaaaaaagaaaagtaccgactgcg

SEQ ID NO: 1255 - DNA, 1352 bp, Triticum aestivum
ccacgcgtccgtgaaaagcagcaccaagaagggaacggactgcttggactggaagcgacccgcgtccaccaccgccgctttccccctcgccccctcaccgcgcggcgacgccgagcgacccagcggcgagcccggcatgcatcacgaccccaaccccttcgacgagggcaccgccggcgacgaaaaccccttctccaatggaggaggccgcggcgggaagcagcagcacggcttccggcccaccgagcccgtcggcttcggcggcggcggcagcaggggcgacgccaccgtcgacgtgcccctcggcaacatgggcgactcgaatggcaaggcgagggagctctcgtcgtgggaatcagatctgaggcgtcgtgaggcggatatcaaaaggagggaggaatcgctgaagaatgctggagtgcccatggaggagaagaattggccgccttttttcccgattatccaccatgacatcgccaatgagatacctgcaaacgtgcagaagttacagtatctggcgtttgcaagctggcttggaattgtgctctgcctctcctggaactttattgctgtcatagtctgctggatcaaggagggagattcaaagctgttcttccttgctacaatctatgctttgcttggaattcccctttcttacttgatgtggtatcgacccctctatcgtgcaatgaggactaacagtgcattcagttttggatggtttttcctgtgttatctgatccacattggtttttgcataattgctgccattgctccgccaattgtattccaagggaaatcattaacgggcatattggccgcgatcgacactttctctgagcatttgataattgggatcttctacttcgtggggtttgcactattttgcttggagacactgctgagcatcggggttcttcagaaagtatacatgtacttccgagggcataagtgaagcggtcttggatggaaaaatttcggaagtctacaagcagcagtgattctgttcatatgtgtcagtacaccttgagtctattctgttctgccaaaggttagcaaagaatacttctgagcctgaatggagtatggaaggtagccctgctactataggatgttctctaagatggggtgttgagattctttatatgctgtacttcgtgtgttatctggtagatctcctgcaagtttggcatgtcggtgaacattacaagtagtcagtagttaaacgaagaatatgaacaactaggcaggaatcatgttctttcgagaattagtggcgatgctctgctatgtgctttggatgactagatgtttgttaaattgcccagttatagcaaattcgtccggtgtca

SEQ ID NO: 1256 - DNA, 1618 bp, Triticum aestivum
tgaaaagcagcaccaagaagggaacggactgcttggactggaagcgacccgcgtccaccaccgccgctttccccctcgccccctcaccgcgcggcgacgccgagcgacccagcggcgagcccggcatgcatcacgaccccaaccccttcgacgagggcaccgccggcgacgaaaaccccttctccaatggaggaggccgcggcgggaagcagcagcacggcttccggcccaccgagcccgtcggcttcggcggcggcggcagcaggggcgacgccaccgtcgacgtgcccctcggcaacatgggcgactcgaatggcaaggcgagggagctctcgtcgtgggaatcagatctgaggcgtcgtgaggcggatatcaaaaggagggaggaatcgctgaagaatgctggagtgcccatggaggagaagaattggccgccttttttcccgattatccaccatgacatcgccaatgagatacctgcaaacgtgcagaagttacagtatctggcgtttgcaagctggcttggaattgtgctctgcctctcctggaactttattgctgtcatagtctgctggatcaaggagggagattcaaagctgttcttccttgctacaatctatgctttgcttggaattcccctttcttacttgatgtggtatcgacccctctatcgtgcaatgaggactaacagtgcattcagttttggatggtttttcctgtgttacctgatccacattggtttttgcataattgctgccattgctccaccaattgtattccaagggaaatcattaacgggcatattggccgcgatcgacactttctctgagcatttgataattgggatcttttacttcgtggggtttgcactattttgcttggagacactgctgagcatcggggttcttcagaaagtatacatgtacttccgagggcataagtgaagcggtcatggatggaaaaatttcggaagtctacaagcagcagtgattctgttcatatgtgtcagtacaccttgagtctatgttctgttctgccaaaggttagcaaagaatacttctgagcctgaatggagtatgtaagggtagccctgctactatatgatgttctctaagatggggtgttgagattctttatatgctgtgcttcgtgtgttatctggtagttcgtttgggagtttggcatgtcggtgaacattacaagtaatcagtatttaaacgaagatgaacaactaggcaggaatcatgttctttcgagaattagtggcgatgctctgctattgtgctttggaggactagatgtacgctcaattgtccagttatagcaaattcgtccggtgtcacttgatgtgatgctattattgagctgctgcttcgttgaccccaaatatatcctgttaacagccgttctttaataacttaggatttttttcctcgcctaggcatagctttggtctttgatgactttgctcattgccggtgtgttttatttgtgtgtgcgttggtgtggctctgtgcatcttagttgtgtacaggccggatgtgtgctatcgtgtctgtatccacttggtgcgtcattttgagtcaataaaatcgatcctttatcgcaaaaaaaaaaa

SEQ ID NO: 1257 - DNA, 1453 bp, Triticum aestivum
cttggactggaagcgacccgccgtccaccaccgccgctttccccgtctccccctcaccgcgcggcgacgccgagcgacccagcggcgagcccggcatgcatcacgaccccaaccccttcgacgagggcaccgccggcgacgagaaccccttctcgaatggaggaggccgtggcgggaagcagcagcacggcttccggcccaccgagcccgtcggcttcggcggcggcggcagcaggggcgacgccaccgtcgacgtgccgctcggcaacatgggcgactcgaatggcaaggcgagggagctctcgtcgtgggaatcagatctgaggcgccgtgaggcggatatcagaaggagggaggaatcactgaagaatgctggagtgcccatggaggagaagaattggccgccttttttcccgattatccaccatgacatcgccaatgagatacctgccaacgtgcagaagctacagtatctggcgttcgcaagctggcttggaattgtgctctgcctctcctggaactttattgctgtcatagtctgctggatcaaggagggagattcaaagctgttcttccttgctacaatctatgctttgcttggagttcccctttcttacttgatgtggtatagacccctctatcgtgcaatgagaactaacagtgcattcagttttggatggtttttcctgtgttacctgatccacattggtttttgcataattgctgccattgctccgccgatcgtattccaagggaaatcattaacgggcatattggctgcgatcgacactttctctgagcatgtgataattgggatcttttacttcgtggggtttgcactattttgcttggagacactgctgagcatcggggttcttcagaaagtatacatgtacttccgagggcataagtgaagctagtcgtgatggaaatttttcagaagcctacaagcagtagtgattctgtccatatgtgttagtacaccttgagtctatgtttgttgagcgaagggttatcgaagaatgcttctgagactgagtggagtatggcatgtagcgctgctactataggatcttctctaagatgggggtgctgaggttctttatatgctgtgcttcgtgtgtcatctggtagttcgtttgggagtctggcatgtcggcgaacattacagtagtcagtatttattattaaacgaagaagagcaactaggcaggaatactatgtgccagtcttggcttatgtctgctaggctgctagttgatgtgattgctattcccgagctgctgcttcgttggcccgaacagttgttgctttaggtgcgttggtcttactgggagacgcttgctttgactccctccatctgggtttactagacccctttcatatttagggtcaaattaaataaagtaataaatgttataatgtacagtatatgtcaaaaaatttagaccct

SEQ ID NO: 1258 - DNA, 1307 bp, Brachypodium distachyon
gggaagcgactcgcgtccaagccaagcctagccaccgccgctttccccgtctccgctctccccaccaccgcgcggcgaggccgaggaagcgagcggcgaggagcctgcccggcatgcatcacgaccccaaccccttcgacgagggcggcgccgaggacaaccccttctccaatggaggaggccgaggcgggaggcagcagtacgggttccggccgagtgagcccgtggggttcgggggcggcaggggcgacgctaccgtcgacgtgcccctcgacaacatgggcgctcgaatggcaaggcgagggagctctcgtcgtgggaatcagatctgaagaggcgtgaggcggacatcaaaaggagggaggaatcactgaagaatgctggagtgccaatggaggacaagaactggccgccattcttcccgatcatccaccatgacatcgctaatgagataccggccaatgtgcagaagttgcaatatctggcattcgcaagctggcttggaattgtgctttgcctctcgtggaactttattgctgtcatagtttgctggatcaaggagggagattcaaagctatttttccttgcaacaatctatgctttgcttggaattcccctttcctacttgatgtggtatagacccctctatcgtgcaatgaggactaacagtgcattcagttttggatggtttttcctgtgttacctgatccacattggtttttgcataattgctgccattgctccaccaattgtatttcaaggaaaatcattaacgggtatattggctgcaatcgacactttctctgagcatgtcataattgggatcttttactttgtggggtttgcactattttgcttggagacactgctgagcattggggttcttcagaaagtatacatgtacttccgagggcacaagtgaagctggtcatgatggaaatttccagaagtcaaccggcagcgtctgcagcgatcctgtgcatacatatcagtacaccttgagtctgtcttttgttctggcaagtattataaaaagttgcttctgagcaattattgagtatggaagacagcaccgctactatagggtggtttctgagatggtggtttgattctttatagctgtgcttcatgtgttatcgggtagtttagttgcaagtttggcatgtccgtgaacattacagtagtcagaactagtcttaaaactaaagatgagccactggcaaggaatcatatttgtgcttttgacaattagcttgtggtgaactatatatatccttgtgctatcgtgcttaaattttgttgaactc

SEQ ID NO: 1259 - DNA, 1257 bp, Secale cereale
accgccggcgacgagaaccccttctccaatggcggaggccgcggcgggaagaagcagtacggcttccggcccaccgagcccgtcggcttcggcggcggcggcggcagcaggggcgacgccaccgtcgacgtgcccctcggcaacatgggcgactcgaatggcaaggcgagggagctctcgtcgtgggaatcagatctgaggcggcgtgaggcggatatcaaaaggagggaggaatcactgaagaatgctggagtgcccatggaggacaagaattggccgccatttttccccattatccaccatgacatcgccaatgagataccggccaacgtgcagaagctacagtatctggcattcgcaagctggcttggaattgtgctctgtctctcctggaactttattgctgtcatagtctgctggatcaaggagggagattcaaagctgttcttccttgctacaatctatgctttgcttggaattcccctttcttacttgatgtggtatcgacccctctatcgtgcaatgaggactaatagtgcattcagttttggatggtttttcctgtgttatctgatccacattggtttttgcataattgctgccattgctccgccaattgtattccaagggaaatcattaacgggcatattggccgcgatcgacactttctctgagcatttgataattgggatcttttacttcgtggggtttgcactattttgcttggagacactgctgagcatcggggttcttcagaaagtatacatgtacttccgagggcataagtgaagcggtctgggatggaaaaatttcggaagtctataagcagcagtgattgtgtccatatgtgtcagtacacctttagtctatgttctcttctgccaaaggttgtcgaaaaatgcttctgagcctgaatggagtatggaaggtagccctgctactataggatgttctctaagatggggtgttgagattctttatatgctgtgcttcgtgtgttatctggtagatctcttgcaagtttggcatgtcggtgaacattacaagtagtcagtatttgaacgaagatgagcaactaggcaggaatcatgttctttcgagaattagtggtggtgctctgctattgtgctttggatgactagatgtatgttgagttgcccagttaaaataaaaaaaaaaaaaacaaaaaaaaaaacaaaaaaaaactaaagaagaatacgacgaacgacaacacgaaggaagagaccacccaccccc

SEQ ID NO: 1260 - DNA, 1398 bp, Brachypodium distachyon
gggtcacgtgaaaagcagcggcgagcgaaccggccaccgcccaaagggaactgcttggactgggaagcgactcgcgtccaagccaagcctagccaccgccgctttccccgtctccgctctccccaccaccgcgcggcgaggccgaggaagcgagcggcgaggagcctgcccggcatgcatcacgaccccaaccccttcgacgagggcggcgccgaggacaaccccttctccaatggaggaggccgaggcgggaggcagcagtacgggttccggccgagtgagcccgtggggttcgggggcggcaggggcgacgctaccgtcgacgtgcccctcgacaacatgggcacacaaggctcgaatggcaaggcgagggagctctcgtcgtgggaatcagatctgaagaggcgtgaggcggacatcaaaaggagggaggaatcactgaagaatgctggagtgccaatggaggacaagaactggccgccattcttcccgatcatccaccatgacatcgctaatgagataccggccaatgtgcagaagttgcaatatctggcattcgcaagctggcttggaattgtgctttgcctctcgtggaactttattgctgtcatagtttgctggatcaaggagggagattcaaagctatttttccttgcaacaatctatgctttgcttggaattcccctttcctacttgatgtggtatagacccctctatcgtgcaatgaggactaacagtgcattcagttttggatggtttttcctgtgttacctgatccacattggtttttgcataattgctgccattgctccaccaattgtatttcaaggaaaatcattaacgggtatattggctgcaatcgacactttctctgagcatgtcataattgggatcttttactttgtggggtttgcactattttgcttggagacactgctgagcattggggttcttcagaaagtatacatgtacttccgagggcacaagtgaagctggtcatgatggaaatttccagaagtcaaccggcagcgtctgcagcgatcctgtgcatacatatcagtacaccttgagtctgtcttttgttctggcaagtattataaaaagttgcttctgagcaattattgagtatggaagacagcaccgctactatagggtggtttctgagatggtggtttgattctttatagctgtgcttcatgtgttatcgggtagtttagttgcaagtttggcatgtccgtgaacattacagtagtcagaactagtcttaaaactaaagatgagccactggcaaggaatcatatttgtgcttttgacaattagcttgtggtgaactatatatatccttgtgctatcgtgcttaaattttgttgaactcaccagtcttgcaaatttctctgg

SEQ ID NO: 1261 - DNA, 1426 bp, Sorghum bicolor
tccgcaggtcacgtgaaaagcagcggaggcgcaagcgcaacgcgaggcaggaaaactcaaaaagggcggagaaactgcttgaactggaagcgaccctagtccaaaaccaccgcaccgagcccccgccgcgccgcgccacctccgctcctctcgtctcccccggccggcgtcgaggccgaagcgaaggcgagcatgcatcacgaccccaaccccttcgacgagggcggcgccgaggacaaccccttctccaatggaggaggtggaggcggcaagcagcagtacgggttccggccgactgagcccgtcgggttcggcggcgccggcagggggggcgacgccgtcgtcgacgtcccgctcgagaccatgggggactctaagagcaagtcgagggagctctcgtcgtgggaatcagatctgaagcggcgagaggcggatatcaagaggagggaggaggcgctgaagaatgctggtgtgccgatggaggagaagaactggccaccattcttccccatcatccaccatgacattgccaatgagataccagccaatgtgcagaagttacagtatcttgcattcgcaagctggcttggaattgtgctttgcctgtcctggaacttcattgctgtcatagtctgctggatcaaggagggagattcaaagttgtttttccttgcaacaatctatgctttgcttggaattcctctgtcatatctgatatggtataggccactctaccgtgcaatgaggactaacagtgctttcagttttggatggtttttcctgtgttacctgatccacattggtttttgcataattgctgccattgctccaccaattgtatttcatgggaaatcattaactggtattctggctgcgattgacaccttctctgagcatgtgataattgggatcttttactttgttgggtttgcactgttttgtctggagacattgctgagcattggggtccttcagaaagtgtacatgtacttcagagggaacaagtgaagccagtcatgatggagaattacatttcttgacaaaatggggagtactttagcacatgttcactcgatggttttgtgcatatctgtcagtacaccttgagtctgtcttttcttatgtcagtggcactgagaattgctttttaagatggtatggaagtaggatagcacagagaaccgccttgcactcgcggcgctctatgtgttcaaacagactatgggggtgattatgctgccggtacaagaagtataaatttctagtccatttgaaccagctatagttgaagcttgaaagacaaatttgtcgacctgattattcatctagcagtctttgactacagttatatgcatacccattaaggcagcgacatttttgtcgtatgtgacgggggagtaactaagcacttttctttatatatata

SEQ ID NO: 1262 - DNA, 1481 bp, Sorghum bicolor
gcacccgcagaccccgctcccagccgtgtcgccatccgcaggtcacgtgaaaagcagcggaggcgcaagcgcaacgcgaggcaggaaaactcaaaaagggcggagaaactgcttgaactggaagcgaccctagtccaaaaccaccgcaccgagcccccgccgcgccgcgccacctccgctcctctcgtctcccccggccggcgtcgaggccgaagcgaaggcgagcatgcatcacgaccccaaccccttcgacgagggcggcgccgaggacaaccccttctccaatggaggaggtggaggcggcaagcagcagtacgggttccggccgactgagcccgtcgggttcggcggcgccggcagggggggcgacgccgtcgtcgacgtcccgctcgagaccatgggggactctaagagcaagtcgagggagctctcgtcgtgggaatcagatctgaagcggcgagaggcggatatcaagaggagggaggaggcgctgaagaatgctggtgtgccgatggaggagaagaactggccaccattcttccccatcatccaccatgacattgccaatgagataccagccaatgtgcagaagttacagtatcttgcattcgcaagctggcttggaattgtgctttgcctgtcctggaacttcattgctgtcatagtctgctggatcaaggagggagattcaaagttgtttttccttgcaacaatctatgctttgcttggaattcctctgtcatatctgatatggtataggccactctaccgtgcaatgaggactaacagtgctttcagttttggatggtttttcctgtgttacctgatccacattggtttttgcataattgctgccattgctccaccaattgtatttcatgggaaatcattaactggtattctggctgcgattgacaccttctctgagcatgtgataattgggatcttttactttgttgggtttgcactgttttgtctggagacattgctgagcattggggtccttcagaaagtgtacatgtacttcagagggaacaagtgaagccagtcatgatggagaattacatttcttgacaaaatggggagtactttagcacatgttcactcgatggttttgtgcatatctgtcagtacaccttgagtctgtcttttcttatgtcagtggcactgagaattgctttttaagatggtatggaagtaggatagcacagagaaccgccttgcactcgcggcgctctatgtgttcaaacagactatgggggtgattatgctgccggtacaagaagtataaatttctagtccatttgaaccagctatagttgaagcttgaaagacaaatttgtcgacctgattattcatctagcagtctttgactacagttatatgcatacccattaaggcagcgacatttttgtcgtatgtgacgggggagtaactaagcacttttctttatatatatagtactcctttcatcccaaaat

SEQ ID NO: 1263 - DNA, 1288 bp, Panicum virgatum
cgagtccaaaccaccgcacccaaccccaccgccgccgcctcactcgcttccttcgtctccgccactcccgcccgcacgccggcgcccgaccgcgcggaggcgagcatgcatcacgaccccaaccccttcgacgagggcagcgccgacgacaaccccttctccaatggaggaggcggaggcggaggcggcaagcagcagtatgggttccggccgaccgagcccgtcggcttcgggagcgccggcaggggcgacgccgtcgtcgacgtccctctagataacatgggggactccaagggcaaggcgagggagctctcgtcgtgggaatcagatctgaagcggcgagaggcggatatcaagagaagggaggaggcgctgaagaatgctggagtgccgatggaggagaagaactggcctccattcttcccgatcatccaccatgatattgccaatgagataccagccaatgtgcagaggctgcagtatcttgcatttgcaagctggcttggaattgtgctttgcctgtcgtggaatttcattgctgttatagtctgctggatcaaggagggagattcaaaattgtttttccttgcgactatctatgctttgcttggaattcctctgtcatatttgatatggtacaggcccctctatcgtgcaatgaggacaaacagtgctttcagttttggatggtttttcctctgttacctgatacacattggtttttgcataattgctgccattgctccacccattgtatttcatgggaaatcattaaccggtatactggctgcgatcgacaccttctctgagcatatcataattgggatcttctactttgtggggtttgggctgttctgtttggagacgctgctgagcattgcagttcttcagagagtgtacatgtacttcagagggaacaagtgatgccagccatgattgaaaactacatttgtccaaaaaaaatgtggtggagaattgcttatgcatgctagtagcacctgttcgtgtgacggttttgtgcatacctgtcaagtacaccttgagtctatcgttttgtatgtcagtggtggtgcttttttaagctggtatggagtaggatggtagccctgtcattataggttggcttgcggaacggggggtgttttatttcttcattagctatgcccatatttcaacttgttagtgtagtatttgccatgttggcgaccgttatgggcttatggcacgcagtactatattattcttgaaatgcagaagaggaactgccctatgggctgatttcttacat

SEQ ID NO: 1264 - DNA, 1461 bp, Setaria italica
ggagaaactgcttgaattggaagcgacccgagtccaaaccaccgcaccgagagccccccgccgcgccgcttcccccctccgctcacctctcgcccgcaagccgagcgcggaggcgacagcgagcatgcatcacgaccccaaccccttcgacgagggcgccgccgacgacaacccctactcgaatggaggaggcggaggcggcaagcagcagtacgggttccggccgaccgagcccatcggcttcgggggggccggcaggggcgacgccgtcgtcgacgtcccgctcgacaccatgggggactccaagggcaaggcgagggagctctcgtcgtgggaatcagatctgaagcggcgtgaggcggatatcaagaggagggaggagtcgctgaagaatgccggagtgcccatggaggagaagaactggccgccattcttcccgctcatccaccatgacattgccaatgagataccggccaatgtgcagaggttgcagtatcttgcattcgcaagctggcttggaattgtgctttgcctctcttggaatttcattgctgtcatagtctgctggatcaaggagggagattcaaagctgtttttccttgcaactatctatgctttgcttggaattcccctgtcatatttgatatggtataggcccctctatcgtgcaatgaggactaacagtgctttcagtttcggatggtttttcctctgttatctgatacacattggtttctgcataattgctgccattgctccacccattgtattccatgggaaatcattaactggtatactggctgcgatcgacaccttctctgagcatatcgtaattgggatcttctactttgtggggtttgggctgttctgtttggagacactgctgagcattgcagttcttcagagagtgtacatgtacttcagagggaacaagtgaggccagccatagtggaaaactacatttgtcggaaaatgtgatggagaattacttatgaatgctagtagcaccttttcgtgtggttttgtgcatacctgtcagcacaccttgagtctatcgtttcatatgtcagtggtggtgcttttttaagctggtatggtttaggatggtagcactgtcattataggtttgcttgcggaacggggtgttttatttcttcattagctatgcccatgttttatcaggttagtttagtcttaagtttggcatgtcggcgaccgttatggcacgcagtattatattattcttgaaatgcagaagagcaaccgccatatggtgtctgaactgaattcttatatgctactgtgcttgccgctttatattgattttttcctagtcggagcaaatttctcttgtatgtacggtatagcaaagttttctgcctgaacagcaacagttttcccttgttgaatgttgttaccatggtttgttgaatgtgttaacatggtttgttgaatgttgtt

SEQ ID NO: 1265 - DNA, 1429 bp, Setaria italica
cgacccgagtccaaaccaccgcaccgagagccccccgccgcgccgcttcccccctccgctcacctctcgcccgcaagccgagcgcggaggcgacagcgagcatgcatcacgaccccaaccccttcgacgagggcgccgccgacgacaacccctactcgaatggaggaggcggaggcggcaagcagcagtacgggttccggccgaccgagcccatcggcttcgggggggccggcaggggcgacgccgtcgtcgacgtcccgctcgacaccatgggggactccaagggcaaggcgagggagctctcgtcgtgggaatcagatctgaagcggcgtgaggcggatatcaagaggagggaggagtcgctgaagaatgccggagtgcccatggaggagaagaactggccgccattcttcccgctcatccaccatgacattgccaatgagataccggccaatgtgcagaggttgcagtatcttgcattcgcaagctggcttggaattgtgctttgcctctcttggaatttcattgctgtcatagtctgctggatcaaggagggagattcaaagctgtttttccttgcaactatctatgctttgcttggaattcccctgtcatatttgatatggtataggcccctctatcgtgcaatgaggactaacagtgctttcagtttcggatggtttttcctctgttatctgatacacattggtttctgcataattgctgccattgctccacccattgtattccatgggaaatcattaactggtatactggctgcgatcgacaccttctctgagcatatcgtaattgggatcttctactttgtggggtttgggctgttctgtttggagacactgctgagcattgcagttcttcagagagtgtacatgtacttcagagggaacaagtgaggccagccatagtggaaaactacatttgtcggaaaatgtgatggagaattacttatgaatgctagtagcaccttttcgtgtggttttgtgcatacctgtcagcacaccttgagtctatcgtttcatatgtcagtggtggtgcttttttaagctggtatggtttaggatggtagcactgtcattataggtttgcttgcggaacggggtgttttatttcttcattagctatgcccatgttttatcaggttagtttagtcttaagtttggcatgtcggcgaccgttatggcacgcagtattatattattcttgaaatgcagaagagcaaccgccatatggtgtctgaactgaattcttatatgctactgtgcttgccgctttatattgattttttcctagtcggagcaaatttctcttgtatgtacggtatagcaaagttttctgcctgaacagcaacagttttcccttgttgaatgttgttaccatggtttgttgaatgtgttaacatggtttgttg

SEQ ID NO: 1266 - DNA, 1445 bp, Oryza sativa
cgtcacgtgagaaaaagcggcgcaaaagcgagtgaaccgcttgaaccggaagcgactcgagtccaagccaagccacgcgctgcaccactcgccgctttacccgccgttctcctcctcctcctcctccacgcgcggcggcgaggcggagccaagccctaggaaggagcggcgcgtcaccggcggcggcggcggcatgcatcacgaccccaacccgttcgacgagggcaacgccgacgacaaccccttctccaatgggggaggtggtggtggcggcggcggcagcaggcagcagtacgggttccgccccacggagcccgccggcttcggcgccggcaggggggacgccaccgtcgatgtcccgctcgacaccatgggcgactccaagagcaaggcaagggagctctcatcgtgggaaacagatctgaagcggcgggaggcggatatcaaaaggagggaggaagcgctgaggaatgctggagtgccaatggaggataagaactggccaccattcttcccgatcattcaccatgacattgccaatgagataccggctaatttgcagaaattgcagtatctcgcgttcgcaagctggcttggtatcgtgctttgcctctcatggaacttcatcgctgtcatagtctgttggatcaaggagggagattcgaagctgtttttccttgccactatctatgccttgcttggaattcccctctcgtacttgatatggtataggcctctctaccgtgctatgaggactaacagtgcgttcagttttggatggttctttctctgttacttgatccacattggcttttgcattattgctgccattgccccgccaattgtgtttcatggaaaatcattaacgggcatactggctgccatagacaccttttctgagcatgtgataattgggatcttttactttgtggggttcgcgctgttttgcttggagacactgctgagcattggagttcttcagagagtgtacatgtacttcagagggaacaagtgaagctattcatcatgatggaaagtttccggtgatcaccagtagcacacctcttcatgcatcgcttctgtgcatacaaatcagtacaccctgagaatgtctcttcatgtcagtttattgtgaaaccttttcaagcttgttatggggtaggttgttagcatcgttatcatagctttgtgtctggaacgaggtgttttgattcttggcaaactgtagtccgtatgtgattgggtagatcgccggtttgcctgttggttaccgttaaatgagctaaggctattctcgctcgggaaaatagacacaaaattgcattcagacctggatcatatatatgcacccttgcggattgttggcttgatgctgtgcttcccgatttttactatccatctaactcaaagcagattcatctggcacaattcgttgcaagtttcca

SEQ ID NO: 1267 - DNA, 1437 bp, Oryza sativa
gagaaaaagcggcgcaaaagcgagtgaaccgcttgaaccggaagcgactcgagtccaagccaagccacgcgctgcaccactcgccgctttacccgccgttctcctcctcctcctcctccacgcgcggcggcgaggcggagccaagccctaggaaggagcggcgcgtcaccggcggcggcggcggcatgcatcacgaccccaacccgttcgacgagggcaacgccgacgacaaccccttctccaatgggggaggtggtggtggcggcggcggcagcaggcagcagtacgggttccgccccacggagcccgccggcttcggcgccggcaggggggacgccaccgtcgatgtcccgctcgacaccatgggcgactccaagagcaaggcaagggagctctcatcgtgggaaacagatctgaagcggcgggaggcggatatcaaaaggagggaggaagcgctgaggaatgctggagtgccaatggaggataagaactggccaccattcttcccgatcattcaccatgacattgccaatgagataccggctaatttgcagaaattgcagtatctcgcgttcgcaagctggcttggtatcgtgctttgcctctcatggaacttcatcgctgtcatagtctgttggatcaaggagggagattcgaagctgtttttccttgccactatctatgccttgcttggaattcccctctcgtacttgatatggtataggcctctctaccgtgctatgaggactaacagtgcgttcagttttggatggttctttctctgttacttgatccacattggcttttgcattattgctgccattgccccgccaattgtgtttcatggaaaatcattaacgggcatactggctgccatagacaccttttctgagcatgtgataattgggatcttttactttgtggggttcgcgctgttttgcttggagacactgctgagcattggagttcttcagagagtgtacatgtacttcagagggaacaagtgaagctattcatcatgatggaaagtttccggtgatcaccagtagcacacctcttcatgcatcgcttctgtgcatacaaatcagtacaccctgagaatgtctcttcatgtcagtttattgtgaaaccttttcaagcttgttatggggtaggttgttagcatcgttatcatagctttgtgtctggaacgaggtgttttgattcttggcaaactgtagtccgtatgtgattgggtagatcgccggtttgcctgttggttaccgttaaatgagctaaggctattctcgctcgggaaaatagacacaaaattgcattcagacctggatcatatatatgcacccttgcggattgttggcttgatgctgtgcttcccgatttttactatccatctaactcaaagcagattcatctggcacaattcgttgcaagtttcca

SEQ ID NO: 1268 - DNA, 985 bp, Saccharum officinarum
ggagaaactgcttgaactggaagcgaccctagtccaaaaccaccgcaccgacccccgccgcgccacctccgcgcctcgcgctcctctcgtctccccccgccggcgtctagcccgaagcgaaggcgagcatgcatcacgaccccaaccccttcgacgagggcagcgccgacgacaaccccttctccaatggaggaggtggaggcggcaagcagcagtacgggttccggccgactgagcccgtcgggttcggcggcgccggcaggggcgacgccgtcgtcgacgtcccgctcgagaccatgggggactctaagagcaaggcgagggagctctcgtcgtgggaatcagatctgaagcggcgagaggcggatatcaagaggagggaggaggcgctgaagaatgctggcgtgccgatggaggagaagaactggccgccattcttccccatcatccaccatgacattgccaatgagataccagccaatgtgcagaagttgcagtatcttgcattcgcaagctggcttggaattgtgctttgcctgtcctggaacttcattgctgtcatagtctgctggatcaaggagggagattcaaagttgtttttccttgcaacaatctatgctctgcttggaattcctctgtcatatttgatgtggtataggccactctaccgtgcaatgaggactaacagtgctttcagttttggatggtttttcctgtgttacctgatccacattggtttttgcataattgctggcattgctccaccaattgtatttcatgggaaatcattaactggtattctggctgcgattgacaccttctctgaacatgtgataattggggatctttacttggtgggggtttgcactgttttgtcttggaaacctggtgaacatggggggtcttcaaaaagtgtacatgttcttcagaggggaacaattgaacccggtctgattgagaatttacatttcttgagaaaatgggg

SEQ ID NO: 1269 - DNA, 1255 bp, Pennisetum glaucum
gacagcgacagcgagcatgcatcacgaccccaaccccttcggcccgcacgccgagcgcggaggcgacagcgacagcgacagcgacagcgagcatgcatcacgaccccaaccccttcgtcggcgggggcgccaagcagcagtacgggttccggccgaccgagcccgtcggcttcgggggcgccggtaggggcgacgccgtcgtcgacgtcccgctcgacaccatgggggactccaagggcaaggcgagggagctctcgtcgtgggaatcagatctgaagcggcgtgaggcggatatcaagaggagggaggaggcgctgaagaatgctggagtgccgatggaggagaagaactggccgccattcttcccactcatccaccacgacattgctaatgagataccagccaatgtgcagaagttgcagtatcttgcattcgcgagctggcttggaattgtgctttgcctctcttggaatttcattgctgtcatagtttgctggatcaaagagggagattcaaagctgtttttccttgcaactatctatgctttgcttggaattcccctgtcatatttgatatggtataggcccctctatcgtgcaatgaggactaacagtgctttcagttttggatggtttttcctctgttacctgatacatgttggtttctgcataattgctgccattgccccacccattgcattccatggaaaatcattaaccggtatactggctgcaattgacaccttctctgaacatatcataattgggatcttctactttgtggggtttggcctgttctgtttggagacactgttgagcattgcggttcttcagagagtgtacatgtacttcagagggaacaagtgaggccagccatggtggaaaactacatttgttggaaaatgtgatggggaattactttatgaatgctagtagcaccttttcgtgtgatggttttgtgaatacctgtcaggacaccttcagtttatcgattcgtatgtcagtggtggtggttttttaagctggtatggagtaggatggtagcactgtcattataggtttgcttgcggaacggggtgttttatttcttcattagctatgcccatgttttatctggttagtttagtctctagtttggcatgtgggcgaccgttaatggcacacagtattatattattcttgaaatgcagaaggcaactgtcatatgcggtttgtttgtctggattatcagctaccaaccagtgctacttttaaat

SEQ ID NO: 1270 - DNA, 1302 bp, Sorghum bicolor
agtgaaaagagatgagagcaacttgaaccggaagcgacttgggtagtcggtcagtccactgcaccaccacgcccgacacgcccacccctcccaccgcttccctctccaggtctcccccgcggcaacgaccacagcccaccgagcaccgatcaattcgctgctccgccagaagcagaagccgaggccgacctgtccacggcagcgagcatgcaccacgatcccaaccccttcgacgatggcgccgacgagaaccccttctcgaatggaggcggaggagcgcgtggcggaggcgtcaagtcgcagtacgggttccggccggcggagcccgcggggttcggcggcggcggcggcaggggcgatgcgaccgtcgacatccccctcgacaccatgaacgattcgaagggcaaggcgaaggagctgtctcagtgggagtcagatctcaggaggcgagagtcggatatcaggagaagggaggaagctctcaagagcgctggggtgcccatggaggacaagaactggccgcctttcttcccaatcatccaccatgatattgccaatgagataccagcgaacgcccagaagttgcagtatcttgcgttcgcgagctggcttggtattgtgctttgtctcttttggaattttattgctgtcatagtctgttggatcagagggggagattccaagctatttttcctggctaccatctatggtatgcttggcatccctttgtcctatttgatgtggtatagacctctgtaccgagcaatgagaactgacagtgctttcagctttggatggtttttcctttgttacctgctccacattggcttttgcatatttgctgccattgctcctccaattatattccgcggaaaatcgttaacgggtatactggctgcaattgacaccttttctgatcatgcaatagttgggatcttttactttgttggatttgccttgttttgcttggagacacttgtgagcatatgggttcttcagaaagtatacatgtacttcagagggcacaagtaggctatggaagcacttgcaatagtcaaccgagtaccatctggttgctctgtggttttgtgcatacacataagtaagtacatgtcagtcgttgtatgttaccgacaatgtatatttttccctttaaagtttgtatggtgaagggtatatacgattatattgtagtgtctttctggactgatctgttttaaaccccaattctttgcccatatatacaaattgcactttgtgtggacttgtttgctaccaaggcttcgaagattgattggtctg

SEQ ID NO: 1271 - DNA, 1921 bp, Sorghum bicolor
ccgggggcctcctcccgtcccgcactcccgcctgccctgccagcgcgaagtctttgaactgcgaccaaaccgaagaaaaaaaaaacagtgaaaagagatgagagcaacttgaaccggaagcgacttgggtagtcggtcagtccactgcaccaccacgcccgacacgcccacccctcccaccgcttccctctccaggtctcccccgcggcaacgaccacagcccaccgagcaccgatcaattcgctgctccgccagaagcagaagccgaggccgacctgtccacggcagcgagcatgcaccacgatcccaaccccttcgacgatggcgccgacgagaaccccttctcgaatggaggcggaggagcgcgtggcggaggcgtcaagtcgcagtacgggttccggccggcggagcccgcggggttcggcggcggcggcggcaggggcgatgcgaccgtcgacatccccctcgacaccatgaacgattcgaagggcaaggcgaaggagctgtctcagtgggagtcagatctcaggaggcgagagtcggatatcaggagaagggaggaagctctcaagagcgctggggtgcccatggaggacaagaactggccgcctttcttcccaatcatccaccatgatattgccaatgagataccagcgaacgcccagaagttgcagtatcttgcgttcgcgagctggcttggtattgtgctttgtctcttttggaattttattgctgtcatagtctgttggatcagagggggagattccaagctatttttcctggctaccatctatggtatgcttggcatccctttgtcctatttgatgtggtatagacctctgtaccgagcaatgagaactgacagtgctttcagctttggatggtttttcctttgttacctgctccacattggcttttgcatatttgctgccattgctcctccaattatattccgcggaaaatcgttaacgggtatactggctgcaattgacaccttttctgatcatgcaatagttgggatcttttactttgttggatttgccttgttttgcttggagacacttgtgagcatatgggttcttcagaaagtatacatgtacttcagagggcacaagtaggctatggaagcacttgcaatagtcaaccgagtaccatctggttgctctgtggttttgtgcatacacataagtaagtacatgtcagtcgttgtatgttaccgacaatgtatatttttccctttaaagtttgtatggtgaagggtatatacgattatattgtagtgtctttctggactgatctgttttaaaccccaattctttgcccatatatacaaattgcactttgtgtggacttgtttgctaccaaggcttcgaagattgattggtctgttgatgcgacggttgttggaacccaagacagccagtcagccaggcctcctgggatctcatttatgtgttctgtgacgttgaacgaatctcccggtctttcttggagattcagcttgtactgaactgcatggatgaaactgttgcctcctgctggtttatttgttatcgtcagcaaggagtatagtgtgtctcccctggtaatattctggcttcacagtttgtgccactcagcatggatgaaactgttgcaacacaatcagcatccctgtccacagtggagacacgatcatgttacttcttttatgtatgcagggtgttgcgtgacgaactgacaatgtagcgaatattgtttcggctcatgaatccaaacgaatgtcatttacaggagcctgaaatacatgcacatgaatcgatttaatgcaattacctcgatgccttggggtggcatattcgaaaagaagaaaaaggaaaaaaaagaaaaagagaaattctctcacaggtctgggacatcaggtgatgtggacgctgccaaa

SEQ ID NO: 1272 - DNA, 1233 bp, Saccharum officinarum
cacgcccgacacgcccactcctcccaccgcttccctctccaggtctccccgcgccaacgaccacaccccaccgagcaccgatcaaggtagacctgttcgctgctccgccagaagccgaggccgagctgtccacggcagcgagcatgcaccacgatcccaaccccttcgacgagggcgccgacgagaaccccttctcgaatggaggcggaggagcgcgtggcggaggcgtcaagtcgcagtacgggttccggccggcggagcccgcggggttcggcggcggcggcaggggcgatgcgaccgtcgacatccccctcgacaccatgaacgattcgaagggcaaggcgaaggagctgtctcagtgggagtcagatctcaggaggcgagagtcggatatcaggagaagggaggaagctctcaagagcgctggggtgcccatggaggacaagaactggccgcctttcttcccaatcatccaccatgatattgccaatgagataccagcaaacgctcagaagttgcagtatcttgcgttcgcaagctggcttggtattgtgctttgtctcttttggaattttattgctgtcatagtctgttggatcagagggggagattccaaactatttttcctggctaccatctatggtatgcttggcatccctttgtcctacttgatgtggtatagacctctataccgagcaatgagaactgacagtgctttcagctttggatggtttttcctttgttacctgctccacattgctttttgcatatttgccgccattgctcctccagttgtattccgcggaaaatcattaacgggtatactggctgcaattgacaccttttctgatcatgcaatagttgggatcttttactttgtcggatttgccttgttttgcttggagacacttgtgagcatatgggttctccagaaagtatacatgtacttcagagggcacaagtaggctatggaagcacttgcaatagtcaaccatccggttgctctgtggttttgtgcatacacataagtacatgtcagtcattgtatgttacgacaatgtatatttttccgtttaaagtttgtatggtggagggtatatacgattatattgtagcgtctttctggactgatctgttttaaaccccaattctttgcccatatacaaatggcgctttgtgtgcacttctgtttgctaccaaggctgcgcagattgattggtctgctggtacctc

SEQ ID NO: 1273 - DNA, 1368 bp, Zea mays
ttttttcagaggagagtgtagagtactcaaaaccggaagcgactccggtagtcggtctcggtcagtccactccactccactccactccaccacgcctgacccgcccactctaccttcttccctcttcagtctcctcgcgccaacgaccacatcccaccgaacaccgatcaaggtaaacctgttcgctgctccgccagaagccgaggtcgagctgttcacggcagcgagcatgcaccacgatcccaaccccttcgacgagggcgccgacgagaaccccttctcgaatggaggcggaggagcgcgtggcggaggcgtcaagccgcagtacgggttccggccgacggagcccgcggggttcggcggcggcaggggcgatgcgaccaccgacatccctctggacaccatgaacgattcgaagggcaaggcgaaggagctgtctcagtgggagtcagatctcaggaggagggagtcggatatcaggaggagggaggaagctctcaagagcgctggggtgcccatggaggacaagaactggccgcctttcttcccaatcatccaccatgatattgccaatgagataccagcaaacgctcagaagttgcagtatcttgcgtttgcgagctggcttggtattgtgctttgcctcttttggaattttattgctgtcatagtctgttggatcagagggggagattctaaactatttttcctggctaccatctatggtatgcttggcatccctttgtcctacttgatgtggtatagacctctgtaccgagcaatgagaactgacagtgctttcagctttggatggtttttcctttgttacctgctccatattggtttttgcatatttgctgccattgctcctgcagttgtattccgtggaaaatcattaacgggtatactggcagcgatcgacaccttttctgatcatgcaatagttgggatcttttactttgtcggatttgccttgttttgcttggagacacttgtgagcatatgggttcttcagaaagtatacatgtacttcagagggcacaagtaggctatggaagcacttgcaatagtcaaccaactaccatctcatctgattgccatgtggttttgtatgttaggacaacgtatatttttccgtttgcattgtggagggtaagtacgactatatgtataattttcggtttgcatggtggagggtaaatacgactatattgtagcgtctctctcgactgatctgtttttaaccccaattctttgctcatatacaaattgtgctttgtatgcacttttgtttgctaccaaggctgcacattgtatgcacttctgttggtgccttaaacaaggagacaaatattttatttgacacta

SEQ ID NO: 1274 - DNA, 1252 bp, Panicum virgatum
gtccactcccaccacgcccgacacgcccacccctcccaccgcttccctcccccctaggccctagtccagtttccacgcaacaacgacgatcaaggcagcccgttcgccgctccgcccgccagccgccgtcaccggcagcgagcatgcaccacgatcccaaccccttcgatgagggcgccgacgacaaccccttctcgaatggaggaggaggaggtgcaggagcgcgtggtggaggcggcaagtcgcagttcgggttccggccggcggagcccgtcgggttcggcggcggcaggggcgacgcgaccgtcgacatccccctcgacaccatgaacgattcgaagggcaaagcgaaggagctgtcgcagtgggaatcagatctcaggaggcgagaggcggatatcaggaggagggaggaagctctcaagagtgctggggtgcccatggaggacaagaactggccgccattcttcccaatcatccaccacgacattgccaatgagataccagcaaacgctcagaagttgcagtatcttgcgttcgcgagctggcttggcatagtgctttgtctcttctggaattttattgctgtcattgtctgttggatcagagggggagattccaagctatttttcctggctacaatctatggtatgcttggcatccctttgtcctacttgatgtggtataggcctctctaccgagcaatgagaactgacagtgctttcagctttggatggtttttcctatgttacctgctccacattggcttttgcatatttgctgccattgctcctccaattatattccgtggaaagtcattaacgggtatactggctgcaattgacaccttctctgatcatgcgatagttgggatcttttactttgtcggatttgccttgttttgcttggagacacttgtgagcatatgggttcttcagaaagtatacatgtacttcagagggcacaagtaggccatggaaggatttactaccaataccatctgattgtgctgcggttctgtgcatacacataagtacatgtccattgttgtatgttatgacaatgtatatttttttgactttgaagttgaggggtataccattatatagtagtgtcgtttctgactgatttatttttttacccatatacaaattgcactttgtgtccacttatgtttgctaatgtggctgagcagtttgattggtctgttggtaccttataacaagagccatggttgttggaatccaagact

SEQ ID NO: 1275 - DNA, 1101 bp, Zea mays
ccaaccgtcactgttgcgtcgcagaatggaggagccggaggcggcaagcagcagtacggcttccggccgactgagcccgtcgggttcggcggcgctagcaggggcgacgccgtcgttgacgtcccgctcgagaccatgggggactctcggagcaaggtgaaggagctctcgtcgtgggaatcagatctgaagcggcgagaggcggatatcaagaggagggaagaggcgctgaagaatgctggcgtgccaatggaggagaagaactggccaccattcttccccatcatccaccatgatattgccaatgagataccagcaaatgtgcagaagttgcagtatcttgcatttgcaagctggcttggaattgtgctttgtttgtcctggaacttcgttgctgtcatagtctgctggatcaaggagggagattcaaagttgtttttccttgcaacaatctatgctttgcttggaattcctctgtcatatttgatatggtacaggccactctaccgtgcaatgaggactaacagtgctttcagttttggatggtttttcctgtgttacctgatccacattggtttttgcataattgctgccattgctccaccaattgtatttcatgggaaatcattaactggtattctggctgcgattgacactttctctgaacatgtgataattgggatcttttactttgtggggtttgcactgttttgtctggagacactgctgagcattggggttcttcagaaagtgtacatgtacttcagagggaacaagtgaagccagtcatgatggagagttacgtttgttgagaaaatttggagttacttgtggctacttgtagcacatgttcattcgatggttttgtgcatacctgtcagtacaccttgaatctataatttcttatgtcagttattggtgccgagaattgtttttttaaggtggtatgggagtataggtttgcttacggatgggtgctgtggttcttcactagctattcttgaaacgcagaagatcatgcgcccaagtcatgtttcagaattaatttactgtactcatacatgctatcgttcccctttggtgcggcgccgtagctgccga

SEQ ID NO: 1276 - DNA, 1363 bp, Pennisetum glaucum
ccacgcccgacacgcccacggcccacccctcccaccgcttccgtctcctccagtagtccagtctccatctccacgcaccaacgaccccacagaccaccgcgatcaaggcaacctgttcgccgctccgcccgccacccgtcgtcgccggcagcgatcatgcaccacgatcccaaccccttcgacgagggcgccgacgacaaccccttctcgaatggaggaggaggcggtggcggaggagcgcgcggcggaggcggcaagtcgcagtttgggttgcggccggcggagcccgtcgggtttggcggcggcaggggcgacgcgaccgtcgacatccccctcgacaacatgaacgattcgaagggcaaggcgaaggagctgtcgcagtgggaatcagatcttaggaggcgggatgcggatatcaggaggagggaggaagccctcaggagcgctggggtgcccatggaggacaagaactggccaccattcttcccaatcatccaccacgacatcgccaatgaaataccagcaaacgctcagaagttgcagtatcttgcgttcgcgagctggcttggaattgtgctttgtctcttctggaattttattgctgtcatagtctgttggatcagagggggagattccaaactatttttcctggctaccatctatggtatgcttggcattcctttgtcttacttgatgtggtataggccgctataccgagcaatgagaactgacagtgctttcagctttggatggtttttcctttgttacctgctccacattggcttttgcgtacttgccgccattgctcctccaattgtattccgtggaaaatcactaacgggtatattggctgcaattgacactttctcagatcatgcaatagttgggatcttttactttgttggatttgccttgttttgcttggagacacttgtgagcatatgggttcttcagaaagtatacatgtacttcagagggcacaagtaggccatggaaggatttccaatacatatgcttgtgccgcggttctgtgcatacacataagtatacgtcagtcgttgtgtgttatgacaatgtaattttcagcatttaaagtttgcattttggaggggtatgccattatattctagtgtcgtttctggaccgatctgttctttactcgtatacaaattacacgtcgtgctcatttctgtttgctagtgtggctggaccgtttaattggtctgtttgcttcacaacaagagccctggttgtcggaacccagatagcaactaacctggctcttgcggtctcatctgcacgatctggaccttgtgagaacctggtcacggggcgtcacagcccttgcgtggtcttttgaatg

SEQ ID NO: 1277 - DNA, 1491 bp, Setaria italica
aagaagatgagagcaacttgaaccggaagcgactcgagtaggcggtcagtccactcccaccacgcccgacacgcccacccctcccaccgcttccctctctactccagtagtccagtctccacgcacaccaacgacccaagccaccgcgatcaaagcagcccgttcgccgctccgcccgccacccgtcgtcgccggcagcgagcatgaaccacgatcccaaccccttcgacgagggcgccgacgacaaccccttctcgaatggaggaggaggaggtgggggagcgcgcggcggaggcggcaagtcgcagttcgggttccggccggcggagcccgtcgggttcggtggtggcaggggcgacgcgaccgtcgacatccccctcgacaccatgaacgattcgaagggcaaggcgaaggagctgtcgcagtgggaatcagatctcaggaggcgagatgcggatatcaggaggagggaggaagccctcaggagcgctggggtgcccatggaggacaagaactggccaccattcttcccaatcatccaccacgacattgccaatgagataccagcaaacgctcagaagttgcagtatcttgcgttcgcgagctggcttggcattgtgctttgtctcttctggaattttattgctgtcatagtctgttggatcagagggggagattccaaactatttttcctggctactatctatggtatgcttggcatccctttgtcttacttgatgtggtataggcctctgtaccgagcaatgagaactgacagtgctttcagctttggatggtttttcctctgctacctgctccacattggcttttgcgtatttgccgccattgctcctccaattatattccgtggaaaatcattaacgggtatattggctgcaattgacactttctcagatcatgcgatagttgggatcttctactttgtcggatttgccttgttttgcttggagacacttgtgagcatatgggttcttcagaaagtatacatgtacttcagagggcacaagtaggccatggaaggatttccaatacatatgcttgcgctgcggttctgtgcatacacataagtacatgtcagtcgttgtatgttatgacaatgacaatgtaatttttaacatttaaagtttgtattttggaggggtatgccattatattgtagtgtcgtttctggaccgatctattatttactagtatacaaagtacacgtcgtgctcacttctgtttgctagtgtgactgagccgtttaagtgtctgttggtgcctcacaacaagagccctggttgttggaacccaagatagcaaccatcctggcctcctgggatctcatttgtatgttctgtgacgttgaattaatctccctgtcttggagattcagcttctgccggttcgtgccctcaatgtttccgtgtcaacatcaaggagtagatgagactctctttggtaatattctggttctcacattttctgcca

SEQ ID NO: 1278 - DNA, 1365 bp, Setaria italica
gtccactcccaccacgcccgacacgcccacccctcccaccgcttccctctctactccagtagtccagtctccacgcacaccaacgacccaagccaccgcgatcaaagcagcccgttcgccgctccgcccgccacccgtcgtcgccggcagcgagcatgaaccacgatcccaaccccttcgacgagggcgccgacgacaaccccttctcgaatggaggaggaggaggtgggggagcgcgcggcggaggcggcaagtcgcagttcgggttccggccggcggagcccgtcgggttcggtggtggcaggggcgacgcgaccgtcgacatccccctcgacaccatgaacgattcgaagggcaaggcgaaggagctgtcgcagtgggaatcagatctcaggaggcgagatgcggatatcaggaggagggaggaagccctcaggagcgctggggtgcccatggaggacaagaactggccaccattcttcccaatcatccaccacgacattgccaatgagataccagcaaacgctcagaagttgcagtatcttgcgttcgcgagctggcttggcattgtgctttgtctcttctggaattttattgctgtcatagtctgttggatcagagggggagattccaaactatttttcctggctactatctatggtatgcttggcatccctttgtcttacttgatgtggtataggcctctgtaccgagcaatgagaactgacagtgctttcagctttggatggtttttcctctgctacctgctccacattggcttttgcgtatttgccgccattgctcctccaattatattccgtggaaaatcattaacgggtatattggctgcaattgacactttctcagatcatgcgatagttgggatcttctactttgtcggatttgccttgttttgcttggagacacttgtgagcatatgggttcttcagaaagtatacatgtacttcagagggcacaagtaggccatggaaggatttccaatacatatgcttgcgctgcggttctgtgcatacacataagtacatgtcagtcgttgtatgttatgacaatgacaatgtaatttttaacatttaaagtttgtattttggaggggtatgccattatattgtagtgtcgtttctggaccgatctattatttactagtatacaaagtacacgtcgtgctcacttctgtttgctagtgtgactgagccgtttaagtgtctgttggtgcctcacaacaagagccctggttgttggaacccaagatagcaaccatcctggcctcctgggatctcatttgtatgttctgtgacgttgaattaatctccctgtcttggagattcagcttctgccggttcgtgc

SEQ ID NO: 1279 - DNA, 1194 bp, Brachypodium distachyon
agtcagtccaccacttcttgacgcgcccgctccaccccactgcttccttccctccccacccacaacaccaaatccaaccgacgatcgtttcttccacctcccgtagttaggccggcggagcagcgagcatgcaccgcgatccaaaccccttcgacgagggcgccgacgagaaccccttctccaatggaggaggacgtggtgctgctgctgctggtggcaagtccaagttccagttccgcccggcagagcccgccggattcggcggcggcggtaacagcgacgccgctgtcgacattcccctcgacaacatgaatgattcgaatggcaaggctggggagctctcgcaatggcaggcagatctcaagaggcgagaggcggacatcaagaggagggaggaagctctcaagagtgccggggtgcccatggaggacaagaactggccgccgttctttccaatcatccaccatgacattgcaaatgagataccagccaacgcgcagaggttgcagtatcttgcgtttgcgagctggcttggcattgtgctttgtctcttctggaatttcattgctgtcaccgtctgttggatcagagggggagactcaaaactttttttcctggctactatatatggcatgcttggaattcctttatcgtacttgatgtggtataggcctctctaccgtgcgatgagaactgacagcgcattcagctttgggtggtttttcctctgttacatgctccacattggcttttgcataattgctgccattgctccaccaatcgtatttcgtggaaagtcgttaacgggtatactggctgcaatcgatacattctctgatcatgcattagttgggatattttactttgtcggatttgccttgttttccttggagacagttgtgagcatttgggttcttcagagagtatacatgtatttcagagggcacaagtagaagtgggcaacggaggaaaaataccaaattatgtctgcggttctgtgcatacatacaagtacatgtcattctttgtatggtattgactgtgacggacataattaccttccaagtttgtttggtggagagggtagcagtgtggcaccattatatagtgttttttctggaacgatctgttatttgaagcttggattatttacctatacaaattacaattcattcatatttttgggtgcttgtt

SEQ ID NO: 1280 - DNA, 1914 bp, Brachypodium distachyon
agcgagccgaggtaagtcaccggtcagtactcaatagtcagtccaccacttcttgacgcgcccgctccaccccactgcttccttccctccccacccacaacaccaaatccaaccgacgatcgtttcttccacctcccgtagttaggccggcggagcagcgagcatgcaccgcgatccaaaccccttcgacgagggcgccgacgagaaccccttctccaatggaggaggacgtggtgctgctgctgctggtggcaagtccaagttccagttccgcccggcagagcccgccggattcggcggcggcggtaacagcgacgccgctgtcgacattcccctcgacaacatgaatgattcgaatggcaaggctggggagctctcgcaatggcaggcagatctcaagaggcgagaggcggacatcaagaggagggaggaagctctcaagagtgccggggtgcccatggaggacaagaactggccgccgttctttccaatcatccaccatgacattgcaaatgagataccagccaacgcgcagaggttgcagtatcttgcgtttgcgagctggcttggcattgtgctttgtctcttctggaatttcattgctgtcaccgtctgttggatcagagggggagactcaaaactttttttcctggctactatatatggcatgcttggaattcctttatcgtacttgatgtggtataggcctctctaccgtgcgatgagaactgacagcgcattcagctttgggtggtttttcctctgttacatgctccacattggcttttgcataattgctgccattgctccaccaatcgtatttcgtggaaagtcgttaacgggtatactggctgcaatcgatacattctctgatcatgcattagttgggatattttactttgtcggatttgccttgttttccttggagacagttgtgagcatttgggttcttcagagagtatacatgtatttcagagggcacaagtagaagtgggcaacggaggaaaaataccaaattatgtctgcggttctgtgcatacatacaagtacatgtcattctttgtatggtattgactgtgacggacataattaccttccaagtttgtttggtggagagggtagcagtgtggcaccattatatagtgttttttctggaacgatctgttatttgaagcttggattatttacctatacaaattacaattcattcatatttttgggtgcttgtttggtttgcttgtgtgctctacaagaccatggttgttggaacctaaagacagcaaaccatatggggacctcatttgtgccctgtgatatagaagcaatcttaccgtcgttggagattcagcttctgcttgttttcatcttcaaagctcaatgtatttgttaacggcaacaaggagtcaaatgagattcccgtaatcatattctagattacactgaatcatgctagtcagattgctgtgtctcaattctctgatcagtgatgagtcatggttctgtaacttcctactccccgagacgtataatgcacaaaattcacaaacgtggtttctgccgagatgttacagcagcattgagtcaaacgaattctactggaagtctagaagaaggcattcagtttcttcgtatatgctatggaatgtctcgcatgtattgaccatatatgcacaggggtcacaggggttggcgatgagtgacttggggatgctgacatggcacatacctgcaaccacatgttgacacatgggactgccttctaagaaaaacacacacatggtgaagtaagcatcagccatatcctctcctagtctgggcgatcaatttccagcctccattcctcatccgcttccagccatccttgcactgccacgtggtggaaccatatctagatccctggaaccaccaccaagc

SEQ ID NO: 1281 - DNA, 560 bp, Secale cereale
agttcttccacagccccatccgccgccgcgtcacaacaggccccgcctcaggcaagcaatggaccgcgtcggcagcggcgagaagcacctcgaggactgcaccgtcgccaatgccctcggaacttgggtcttctctgttgctggtgctctccttgccattcctgtgggcataaagaggaagtccttcgccccgctggtgttctttggcactactggaacgatgcttgacatcataatgggcattagccagtgcgagagggagcatgctgagcggcagatgaagcttttagaagcgcaaaaccttgcgacgaatgcttcagtagagggtgaaagcttgactgattcatttgccaatgtggataagtgaattgtggcctggtgtgggttttctttcatgaactcctgagtttcattgtcatgatcctttggaaacattgctgttcttcctatttccaaataatgtgtattgaagcaatgatcactgtgagtcagtgttagtcaagatgacaattgaaaggccatctaagtccctaatgcgttcttggggtcgatgacatgtg

SEQ ID NO: 1282 - DNA, 664 bp, Secale cereale
agttcttccacagccccatccgccgccgcgtcacaacaggccccgcctcaggcaagcaatggaccgcgtcggcagcggcgagaagcacctcgaggactgcaccgtcgccaatgccctcggaacttgggtcttctctgttgctggtgctctccttgccattcctgtcggcataaagaggaagtccttcgccccgctggtgttctttggcactactggaacgatgcttgacatcatcatgggcattagccagtgcgagagggagcatgctgagcggcagatgaagcttttagaagcgcaaaaccttgcgacgaatgcttcagtagagggtgaaagcttgactgattcatttgccaatgtggataagtgaaatgtggcctggtgcaggttttctgtcatgagctcctaagtttcattgtcatgatcctttggaaacattgttgttcttcctatttccaaataatgtgtattgaagcaatgatcactgtgagtcagtgttagtcaagatgacaactgaaaggccatctaagtccataatgtgttcttggggtcgatgacacatgattatgttggactaatgatttaattgagaatattacgcagatgtttagtccattgggtcagggcccattaccgctcgttaatctgatttcctttacttttttag

SEQ ID NO: 1283 - DNA, 673 bp, Triticum aestivum
cccgcctccgagatccggcctccccccatcctcgcgacgcccagctcgctacctccatccaccgcccgttcgtacgcaggttgatccgccgccgcgtcacggcaacgggccccgccgcaagcgagcaatggaccgagtcggcagcggcgagaagcacctcgaggactgcaccgtcgccaatgccctcggaacttgggtcttctctgttgctggtgccctccttgccattcctgtgggcataaagaggaagtccttcgctccgctggtgttctttggcacaactggaactatgctcgacatcatcatgggcattagccagtgtgagagggagcatgctgagcggcagatgaagcttctagaagcgcaaaaccttgcagccaatgcttcaatagagggtgaaagcttgactgattcctttgccaatgtggacaagtgaaatctggcctggtgtgggttttctttcatgaactcctgagtttaattgtcgatggtcctttggaaacattgttgttcttcctatttccaaataatgtgtatcgaagcaatgatcagtgtgagtcagtgttagtcaagatgacaatggaaaggccatctaagtccctaatgtgttcttggggtcgatgacacatgattctgttggactaacgatttaattgagaatattacacagata

SEQ ID NO: 1284 - DNA, 692 bp, Avena sativa
cccggggggaggcatttccttccttcctaatcgctagaatgcaagatacacaagcccactaaaattgcgccggtcgcctctatgcttgagccaacctgcgacggccgtcctccactccggtgaacccttcgggcggcgcgactcgtggtagaagccggtgccggcgctctcccctccagatccggttgatccaatccgtcgctcttttggttgcctccacttttaagagccgcgccacagctgccccgtctaaaacaagcaatggagcgaatcggcagcggcgagaagcacctcgaggactgcaccgtatccaatgccctcggaacttgggtcttctctgttgctggcgctctccttgctattcctgtgggcataaagaagaaatcctttgctccgctggtgttctttggcactactggaactatgcttgacatcatcatgggcattagccaatgtgagagggagcatgcggagcgacagatgaagcttttggaagcgcaaaaccttttggcgaatgcttcagtagagggtgaaagcttgaccgagtccttggccaacgtggacaagtgaaaggcgtcttgatgttttccttttctgaattctgggttaaatgtcatgactcctgctcatgtgtgaaacagatgatctctgaacttttggaaccttgccgttcttcctgtttcctaataata

SEQ ID NO: 1285 - DNA, 814 bp, Avena sativa
ggagccaacctgcgacggccgtccctccactccggtgaacccttcgggcggcgcgactcgtggtagaagccggtgccggcgctctccttctccagatccggttgatccaatccgtcgctcttttggttgcctccacttttaagagccgcgccacagctgccccgtctaaaacaagcaatggagcgaatcggcagcggcgagaagcacctcgaggactgcaccgtatccaatgccctcggaacttgggtcttctctgttgctggcgctctccttgctattcctgtgggcataaagaagaaatcctttgctccgctggtgttctttggcactacaggaactatgcttgacatcatcatgggcattagccaatgtgagagggagcatgcggagcgacagatgaagcttttggaagcgcaaaaccttttggcgaatgcttcagtagagggtgaaagcttgaccgagtccttggccaacgtggacaagtgaaaggcgtcttgatgttttccttttctgaattctgggttaaatgtcatgactcctgctcatgtgtgaaacagatgatctctgaacttttggaaccttgccgttcttcctgtttcctaataatacatgtattgagcgatgatcagtggagccagtgttaccccagaatattatgtcttataaccttttgtttgatacccttaagttgatgatcttcgtttgtatgtgggcagctgttggatatgtcatggtcatgtttgtgacactgatggcatgaaacattatattcctaggtattcacgatgcagctgtgtgatgcatagtttatttg

SEQ ID NO: 1286 - DNA, 652 bp, Triticum aestivum
ccgccgcggccgcccccggtccccgcccgcctccgagatccggcctcctccgtcctcggtgacatccagctctgcccgagatccgacgccagttcgtccacaggctgatccaccgccgcgtcacgacaacgggccccgcggcaaacgagcaatggaccgagtcggcagcggcgagaagcacctcgaggactgcaccgtcgccaatgccctcggaacttgggtcttctctgttgctggtgctctccttgccattcctgtgggcataaagaggaagtccttcgctccgctggtgttcttcggcactactggaactatgcttgacatcatcatgggcattagccagtgtgagagggagcatgctgagcggcagatgaagcttttagaagcgcaaaaccttgcaatgaatgcttcagtagatggtgaaagcttgactgataagtgaaatgtgtcctggtgtgagttttttttgttcacaactcctgagtttaaatgtcatgatcctttggaaacattgttgttcttcctatttccaaataatgtgtactgaagcaatgatcagtgtgagtcagtgttagtcaagatgacaatggccatgtgagtccctaatgtgttcttggggtcgatggcatgtgattatgttggactaacgatt

SEQ ID NO: 1287 - DNA, 732 bp, Triticum aestivum
ccgccgcggccgcccccggtccccgcccgcctccgagatccggcctcctccgtcctcggtgacatccagctctgcccgagatccgacgccagttcgtccacaggctgatccaccgccgcgtcacgacaacgggccccgcggcaaacgagcaatggaccgagtcggcagcggcgagaagcacctcgaggactgcaccgtcgccaatgccctcggaacttgggtcttctctgttgctggtgctctccttgccattcctgtgggcataaagaggaagtccttcgctccgctggtgttcttcggcactactggaactatgcttgacatcatcatgggcattagccagtgtgagagggagcatgctgagcggcagatgaagcttttagaagcgcaaaaccttgcaatgaatgcttcagtagatggtgaaagcttgactgataagtgaaatgtgtcctggtgtgagttttttttgttcacaactcctgagtttaaatgtcatgatcctttggaaacattgttgttcttcctatttccaaataatgtgtactgaagcaatgatcagtgtgagtcagtgttagtcaagatgacaatggccatgtgagtccctaatgtgttcttggggtcgatggcatgtgattatgttggactaacgatttaattgagaatattacacagatatttagtccattgggtcagggcccattaccactcattaatctgatttcgttttctttt

SEQ ID NO: 1288 - DNA, 927 bp, Brachypodium distachyon
atggccctttttgtttggtcattcggcccctccagctctagggcgtttttctcgtgcaggcacggccgctccccctccctcgtctcctccgcttcaggcccagtccacgagacgccttcgccgcccgtctgcgacccgccgccgtcccacctggccatcggcgagccgtccgtggccgccccctaccggttcatcccgaccgatccccctcctctcagttcgtccaaaaccgccccccacaccccccgcgcaaacaagcaatggagcgagtaggcagcggcgagaagcagctcgaggactgctccgtctccaatgccctggggacttggtttttctctgttgccggtgctctccttgctattcctgtgggaataaagaagaaatccttggctccactggtattctttggcactactggaactatgcttgacatcatcatgggcattagccagtgtgagcgggaacatgctgagcgacagatgaagcttttggaagcacaaaaccttttggcaaatgcttcagtagatggggaaagctcgactgagtcctttaccaatgttgacaagtgaaatgcattcttttctttttctcaggtgtcgtgatcctctgcccatttgggaaatcgataatgtctgaactttgggaatcttgatgttcttcctatttccaaataatgtgtattgagtgatgatcaaatgttagtaaccttttgttggttattctgcaaacggctgatcttcatttgcactgggaggctgtagattgagacattattgacactggtggcatgacagctgtgaagtagccatgattagtttcttcgggtatgtagaatctgggcttaccttttcttgactttttcattgtaatttgaacgaactattcccattgatctgaatgtcttctaaagaacacattttatgtgtc

SEQ ID NO: 1289 - DNA, 1263 bp, Sorghum bicolor
tattgttgcctggcccatacggtttaccttcgttcttgtgtcttcttcctcgactcgaaaacacacaggcactccgaacagtacgcaggcagagacaggcggcggcggaggcaggatcaggttcctcgcggccggcgttaagtagggcggccgccttacctcgtactactggtaggtcctccacggagccgctggaaggaggctttgcggcgatggaccgggtcggcggcggcgagaagcagctggaggattgcacagtggccaatgctctaggaacttggttcttctcagttgcgggtgctcttgttgctattcctgtgggcataaagaggaaatccttagctccactggtcttctttggaaccacaggaaccatgctggacattatcacgggcattagccagtgtgagcgagagcatgctgagcggcaaatgaagcttttggaagcccagaaactttcgaccgatgcttcagctgggggtgaaagctctgattcctttggcagtgctgataagtgaaatacttctcttgcatttcctattgattagggttcttgctcagatgcaaattttacaccttttaatttctgaatataccattcctactccccttataacgtgtaattgtgtatttgagcaacgatcagttgttttcgcctcatcagtacgtgtcaactgctagtagcctagtagggattaggcaacgatgggtgcgctactttgtgtttgtgttcaatgctgagattaaacacagatactggaggtgtcacggccccaaggtataagagatgctgagactgcatgacttattgacttggtgtaatctgtaagctctatgtgatgaagcacagatgttgagtttcatcccatactcccatccctcggatacacgaggttgtatccactgtttttttaataatgtcaattgatgaaaatatagcagggttcaatcttggtcttcaagcaaagcttaccacctggagaaaaatagcccaatccattgtacggctaggtcttaaacttttcaaataaattatatatatatatatatatatatatatttaaaaaaaccttgtggatgaatttcttcttattctttaccaagtcgtttcctttatttgcttgctcaatcgccttggttgcatgcttcatctgtgatttctgtggctgcttgatgcgtgcacggtgcacactaacacttccttattctcacgactcacatgccacgttctcatcattatcgtctgctcgagttgcagtgcat

SEQ ID NO: 1290 - DNA, 758 bp, Saccharum officinarum
ccacggcgccgctggaaggaggctttgtggcgatggacagggttggcggcggcgagaagcagctggaggattgcacagtggccaatgctctaggaacctggttcttctcagttgcgggtgctcttgttgctattcctgtgggcataaagaggaaatccttagctccactggtcttcttcggcaccacaggaaccatgctggacattatcacgggcattagccagtgtgagcgagagcatgctgagcggcaaatgaagcttttggaagccgagaaactctcggccaatgcttcagctgagagtgaaagctctgattcctttggcagtgctgacaagtgaaatacttctcttgtttttcctcacttgagttgttgctcagatgccaatttgacaccttttattttctgaatataccattcctactcccccaataacgtgtaattgtgtatttgagcaacgatcagttgttttcgcctcatcagtacatgtcaactgctagtagcctagtagggattaggcaaacgatgggtgcgctactttgtgttcgatgctgagattaaactttcacagatactggagatgtcacggccccaaggcataagctatgctgagactgtatgacttattgatttgtaatctgtaagctcttacgtgttccttgttcgcttggctgaaaagtcatggccgaaagtactgttcgctgatttgttgtgagagaaaaacaatgttcgttggctaaaaaagtacggcttataagac

SEQ ID NO: 1291 - DNA, 657 bp, Setaria italica
agcacgtgcttctcagtgtctcccatctccaggcagctccccgccgccggcagccgcacgacgcgcgccgctgtttgcaactagccgtcttcgctgtcactcacgcgtcgttcggggaggccacctcacgccggcggaaggaggcgttgcggcgatggaccgggtcggcagcggcgagaagcagctggaggactgcaccgtggccaatgctctgggaacttggttcttctcagttgctggtgcccttgttgctattcctgtgggcataaagaagaaatcatttgctcccttagtctttttcggcacgacaggaaccatgcttgacatcatcatgggcattagccagtgtgagagggagcatgccgagcggcagatgaagcttttggaagcccagaaacttccggctgatgcttcagatgggattgaaagcgcagaatcatctggcaatgcagacaagtgaaacgccttttatgttttgctgacttctgtcatcacttgtcatgattggaaatcttgctcatataacaatttgatacctctgaacttctgaattatggatatctttattattcacaaataatgtgtaattgtgtattgagcaatgatcagtaaacagtgcactccaaactgttagtcaagacaacagctgtgtaactc

SEQ ID NO: 1292 - DNA, 803 bp, Pennisetum glaucum
gctgagcgagcacgtgcctcccgacttccccatctccagcttgctgccgccggcagccgcagcgacgcgcgccgctgtgtgcaagtacccgtcttcgctgccgctcgcgtgccggaaggaggcgctgcggcgatggaccgggtcggcagcggcgagaagcagctggaagactgcaccgtggccaatgctctgggaacttggttcttctcagtcgctggtgcccttgttgctattcctgtgggcataaagaagaaatcactagctcccttagtctttttcggtacaacaggaaccatgcttgacatcatcatgggcattagccagtgtgagagggagcatgccgagcggcagatgaagcttttggaagcccagaaactttcggctgacgcttcagctgcttcagctgggattgaaagcacagaatcttttggcaatgcagacaagtgaaatgacttttatgttttgctgacttccgtcgtctcttgtcatgactggaaattccgcttgcttacagaacagtgacacctctgaagttctgaaatatgcttatctttgttgttcgcaaataatgtgtagttttgtatcaagcaatgatcagtcaacacaagggtgtataatagtgcattcagtcaagacaagggtgtgtaactttgttttcagtgctacgaagtcttccatcatcttttttttaagattaagtcttccatcatctggacatatcatggtcactgtaattagatacttcctccgtcttaatatatgttctcaaatatatgatgtttagttataagcaatttaagttc

SEQ ID NO: 1293 - DNA, 1399 bp, Oryza sativa
tcacctcttctgcagcttcctcatctccttcctctttctcctcctcttccccatcttgcccttcctcgccctcttccacttcgtcactcttctcctcccctttgccctcctccaactcctccacctcctcatcgctcacctctaccccctcgtcatcatcctcgctctcctcaacctcgtcctcctcgtcgtcgatctccccttccaccacctccttgtcgtcctcctcactatcatcctccacctccgaatcatcctcgtcgccctcggagtcaccgtcggggatagaaggcttcccgccgcggcggctaccgctcagggcctgggagatcttctcgtcgatggaggtggtgcggcggcgcgcgtgctccgccgccacggactccgcgtaggacgagaactcccacggcgactgcgccggcttcctccgccccgcggccgccgaggccgccgccccgtcgtcgtcggagccgtccgggtcgaaccggaagtcggcgtccatgccgcgggagaggaggaggcggcgagcggcgggggttggtggtggtggtggtcgcctccggcgtgcggcggcgggaggcgagggtttaatcgagggtttcgtgtagggggagagggagaggcggaaggaggcgacttgatgggctttcgtgggccgtctcatgcgagaagggcagaagcggtatttcctctagttgggccggcgttaatgggccgggatccatttttctcatctaagtctcctccacgccgccgccctcctcttgcgccgccgccgccgccaccgccgccgcactctgcaaccgcgccgcgtggagggagggaaggacgaaggaggaaggagatggagcgggtcggcggcggggagaagcagctggaggactgcaccgtgtccaatgctctcggcacctggttcttctcagttgctggtgctcttgttgctattcctgtggggataaagaagaaatccttggcaccactggttttctttggcactactggaactatgcttgatatcatcatgggcattagccaatgcgagcgggagcatgctgagcggcagatgaagcttttagaagctcaaaacctttctgccaatgcttcagcagatggtgaaaactgatcaagttctttgattattaggacaagcaaaatgcagctgttgtttttcgtaacttactagttgatctgtaattggcatgatcttctgctcttgtacaaatttgtccatccaaaatacggaaatcttgatattttaaatattctccaataagtatattgagcagtggttaatccttgattttttttgtgatttgattaagttgcccccaagtcctagaaataaatcacaaaacctggcattttgcgttaccggggttccaaaactccaaccaggggt

SEQ ID NO: 1294 - DNA, 455 bp, Pennisetum glaucum
tcggcagcggcgagaagcagctggaagactgcaccgtggccaatgctctgggaacttggttcttctcagttgctggtgcccttgttgctattcctgtaggcataaagaagaaatcgctagcgcccttagtctttttcggcacgacaggaaccatgcttgacatcatcatggggattagccagtgtgaaagggagcatgccgagcggcagatgaagcttttggaagcccagaaactttcgactgacgcttcagctgggattgaaagcgctgaatcttttggcaatgcagacaagtgaaaacgactttttatgttttgctgacttccatcgtcacttgtcatgactggaaatttcgcttgcttacagaacaatgacacctctgaacttctgaaatatgcgtatctttgttgttcgcaaataatgtgtagttttgtatcaagcaatgatcagtcaaca

SEQ ID NO: 1295 - DNA, 749 bp, Panicum virgatum
ggccgcagcgagacgccggtagtgtcttccctttccgcgagtgcacccgtccttgctgcccccagccgtatcgacgccgcagcagcagcgatggagcgagtcggcggcggcgagaagcagctggaggactgcaccgtgtccaatgctctaggaacttggttcttttcggttgctggtgctcttgttgctattcctgtcggcataaagaagaaatccttggctcctctggtcttctttggcaccactggaaccatgctggacatcatcatgggcattagccaatgtgagagggagcatgctgagcggcagatgaagcttttggaagctcagaaactttcagccgatgtttcagctgagagtggaagctctgattcttttggcagtgttgacaagtaaagtacttctcttattttccctaacgtatggcctcacctcttctgattggaattcttgctcagataccaatttcgtgcctttgaacttccaaaatatatcattcctatttcccaataatgtgtaattgtgcattgagaaatgatctgtcaatcaatagtgcgccccagttgccagtgaaacaatggtacaatactttttgatcggtgctctaaaggatttaaatcttcatcgacactggacctcacggggctcacaactgcaagacataagcgatgctgtgtctgacataagttgtaaacttgtttgcagtcacatgaagtacggatggtgaatttcattccatccctcagatg

SEQ ID NO: 1296 - DNA, 1561 bp, Triticum aestivum
gagcgcagccgcaccggccggccatgaagcgcttcttccagcccgtactcaaggacggatcccccgccaagaagaggcccgccggagctgcgacctctgactgcgttgatggccccgcccccaccgcggccgacgccggcggggacggccctcccggcgaggagccacgcaggttcgttacctggaacgccaacagccttctgctccggatgaagagcgactggcccgcgttctgtcagttcgtcgcccgcgtcgaccccgacgtcatctgcgtccaggaagtgcggatgccagcagctggttccaaaggggcacctaaaaatcctagtgagctaaaagacgacacaacctcatcacgcgaagaaaaacagacagtgctgcgtgctttgtcgagttcacctttcaaagactaccgtgtctggtggtccctttcagattccaaatacgcaggcacagctgtgtttatgaagaagaagtttgaaccaaagaaagtgtcattcaacttggatagaacatcttctaagcatgatgcagacggccgtgtcatcattgtggaatttgaatcattcttgttactaaacacatatgctccaaacaacgggtggaaagaggaggaaaattcatttcaaagaagaagaaagtgggataaaagaatgttggagtttgttcaacaagtagacaagcccttaatctggtgcggagatctgaacgttagtcatgacgaaatcgatgtcagccatcctgatttttttagcgatgctaagctcaatggatatatccctccaaataaagaggactgtggacagccaggattcacccttgcagagagacagcgttttggcaatatattgtcgcagggaaagctggtagatgcttacagatacctgcacaaagaaaaagacatggagtgtggcttctcttggtctgggaatccagttgggaagtaccgaggaaagagaatgcggattgactattttgttgtttcagaagggttgaaggacagaattgtttcatgtgaaatgcatggtcatggaattgaactggaaggattttatggaagtgatcactgtcctgtttcacttgagctctccaaagaagcagcggaagcaccagaatcgaagagctccggctaacttctatgtttttctctgaaccggacatcgtggattattagattaggtcaggtgaagcgcttggcctatcatgagctatttaaacattttctatgacctgtaggccaatactgcggtgcaccctctagtccggatctggattggaattagagttcaacgcttactgtgatcagctattggtatccaagttcagatttctaagagttgttccatttatgactggcttttacaatttcggaagaaaccagatgcgagctctagggcaacattatgctccctctatttcttaacagtatatagatcatgttttgcaatgcaggcagccaattttcttaagcaagatctacatccgttgcatgaaaataacatggggattatgacccaaatacaatagggcagagattgcccaaggaaatagtgttgacggt

SEQ ID NO: 1297 - DNA, 1375 bp, Secale cereale
ccctcccctgctggcgcctgccgaggagcgccgccgcaccagccggccatgaagcgcttcttccagcccgtactcaaggacggctcccccgccaagaagaggcccgccggagccgcgacctctgactgcgctgatggccccgcccccaccgcggccgacgccggcggggagggccctcccggcgaggagccacgcaggttcgtcacgtggaacgccaacagccttctgctccggatgaagagcgactggtccgcgttctgccagttcgtcgcccgcgtcgaccccgacgtcatctgcgtccaggaagtgcggatgccagcagctggttccaaaggggcacctaaaaatcctagtgagctaaaagacgacacaacctcgtcacgcgaagaaaaacagacagtgctgcgtgctttgtcgagttcacctttcaaagactaccgtgtctggtggtccctttcagattccaaatacgcaggcacagctgtgcttatgaagaagaagtttgaaccaaagaaagtgtcattcaacttggatagaacatcttctaagcatgatgcagacggccgtgtcatcattctggaatttgaatcattcttgttactaaacacatatgctccaaacaacgggtggaaagaggaggaaaattcatttcaaagaagaagaaagtgggataaaagaatgttggagtttgttcaacaagtagacaagcccttaatctggtgcggagatctgaacgttagtcatgacgaaatcgatgtcagccatcctgatttttttagcgatgctaagctcaatggatatatccctccaaacaaagaggattgtggacagccaggattcacccttgcagagagacagcgttttggcaatatattgtcgcagggaaagctggtagatgcttacagatacctgcacaaagaaaaagacatggagtgtggcttctcttggtctgggaatccaattggaaagtaccgagggaagagaatgcggattgattattttgttgtttcagaagggttgaaggacagaattgtttcatgtgaaatgcatggtcatggaattgaactggaagggttttatggaagtgatcactgtcctgtttcactggagctctccaaagaagtagcggaagcaccagaatcgaagagctccggttaacttctactccaaacaaggcatcgtggattattagattaggagtactatgtttttctctgaaccggacatcgtggattattagattaggtcgggtgaagcgcttggcctatcatgagctatttaaacattttctatgacctgtaggccaatactgcggtgcaccctctagtccggatctggattggaattagagttcagcgcttactgtgatcagcta

SEQ ID NO: 1298 - DNA, 1516 bp, Triticum aestivum
tatcggcaaaaaataaaaaacaattgccccgtcgttgcttcactttccggtgttccctcctctgctggcggctgccgagagcgcagccgcaccggccggccatgaagcgcttcttccagcccgtactcaaggacggctcccccgccaagaagaggcccgccggagttgcgacctctgactgcgctgatggccccgcccccaccgcggccgacgccggcggggatggccctcccggcgaggagccacgcaggttcgttacctggaacgccaacagccttctgctccggatgaagagcgactggtccgcgttctgtcagttcgtcgcccgcgtcgaccccgacgtcatctgcgtccaggaagtgcggatgccagcagctggttccaaaggggcacctaaaaatcctagtgagctaaaagacgacacaacctcatcacgcgaagaaaaacagacagtgctgcgtgctttgtcgagttcacctttcaaagactaccgtgtctggtggtccctttcagattccaaatacgcaggcacagctgtgtttatgaagaagtttgaaccaaagaaagtgtcattcaacttggatagaacatcttctaagcatgatgcagatggccgtgtcatcattgtggaatttgaatcattcttgttactaaacacatatgctccaaacaacgggtggaaggaggaggaaaattcatttcaaagaagaagaaagtgggataaaagaatgttggagtttgttcaacaagtagacaagcccttaatctggtgcggagatctgaacgttagtcatgacgaaatcgatgtcagccatcctaatttttttagcgatgctaagctcaatggatatatccctccaaataaagaggactctggacagccaggattcacccttgcagagagacagcgttttggcaatatattgtcgcagggaaagctggtagatgcttacagatacctgcacaaagaaaaagacatggagtgtggcttctcttggtccgggaatccaattgggaagtaccgagggaagagaatgcggattgattattttgttgtttcagaagggttgaaggacagaattgtttcatgtgaaatgcatggtcatggaattgaactggaaggattttatggaagtgatcattgtcctgtttcacttgagctctccaaagaagcagcggaagcaccagaatcgaagagctccggctaactactatgtttttgtctgaaccggacatcgtggattattagattaggtcaggcgcttggcctatcatgagctatttaaacattttctatgacctgtaggccaatactgcgttgcaccctctagtctggatctggattggaattagagttcaacacttactgtgatcagctattggtgtccaagttcagatttctaagagttgttccatttatgactggcttttacaatttcggaagaaaccagatgcgagctctagggcaacattatggtccctctatttattaacagtagtatagatcatgttttgc

SEQ ID NO: 1299 - DNA, 1450 bp, Triticum aestivum
gagcgcagccgcaccagccagccatgaagcgcttcttccagcccgtactcaaggacggatcccccgccaagaagaggcccgccggagccgcgatctctgactgcgttgatggccgcgcccccaccgcggccgacgccggcggggacggccctcccggcgaggagccacgcaggttcatcacgtggaacgccaacagccttctgctccggatgaagagcgactggcccgcgttctgtcagttcgtcgcccgcgtcgaccccgacgtcatctgcgtccaggaagtgcggatgccagcagctggttccaaaggggcacctaaaaatcctagtgagctaaaagacgacacaacctcatcacgtgaagaaaaacagacagtgttgcgtgctttgtcgagttcacctttcaaagactaccgtgtctggtggtccctttcagattccaagtacgcaggcacagctgtgtttatgaagaagaagtttgaaccaaagaaagtgtcattcaacttggatagaacatcttctaagcatgatgcagacggccgtgtcatcattgtggaatttgaatcattcttgttactaaacacatatgctccaaacaacgggtggaaagaggaggaaaattcatttcaaagaagaagaaagtgggataaaagaatgtcggagtttgttcaacaagtagacaagcccttaatctggtgcggagacctgaacgttagtcatgacgaaatcgatgtcagccatcctgatttttttagcgatgctaagctcaatggatatatccctccaaataaagaggactgtggacagccaggattcacccttgcagagagacagcgctttggcaatatattgtcccagggaaagctggtagatgcttacagatacctgcacaaagaaaaagacatggagtgtggcttctcttggtctgggaatccagttgggaagtaccgaggaaagagaatgcggattgactattttgttatttcagaagggttgaaagacagaattgtttcatgtgaaatgcatggtcatggaattgaactggaaggattttatggaagtgatcactgtcctgtttcacttgtgctctccaaagaagcagcggaagcaccagaatcgaagagctccagctaacttctgtgtttttctcgaaccggacaccatggattattagattattattaggtcagttgaagcgcttggcctatcatgagctatttaaacattttttatgacctgtaggccactactgcggcgcaccctctagtccggatctggattggaattagagttcaactcttactgtgatcagctattggtatctaagttcagatttctaagagttgttccacttatgactggcttttacaatttcggaagagaccagatgcgagctctagggcaacattatgctccctctatttcttaacagtatatagatcatgttttgc

SEQ ID NO: 1300 - DNA, 1193 bp, Brachypodium distachyon
gcagcagtaccagcggcggcgatgaagcgcttcttccaacccgtgcctaaggaaggctcccccgccaagaggaggccctcagaggtcgtcgcctccgactgcgtcgatggccccgccgccaccgcggccggcgccggtggggagggggctcccggccaggagccgcgcaggttcatgacgtggaacgccaacagccttctcctccggatgaagagcgactggcctgcgttctgccagttcgtctcccgcctcgaccccgacgtcatctgcgtccaggaagtgcggatgccggcagccggttccaaaggggcaccaaaaaatcctagtgagctaaaagatgacacaagctcgtcacgcgaagagaaacagatagtgctgcgtgctttgtcgagttcacctttcaaagactaccgtgtctggtggtctctttcagattccaaatatgcaggcacagctgtgtttgtaaagaagatgtttgagccaaagaaagtgtcattcaacttggatagaacatcttccaagcatgaatcggacggtcgtgtcatcattgtagaatttgaatcattgctgttactaaacacatatgctccaaataatgggtggaaagaggaggaaaattcatttcaaagaagaagaaagtgggataagagaatgttcgagtttgttcaacaagtagacaagcccttcatctggtgtggagacttgaatgtcagccatgaagaaatcgacgtcagccatcctgacttttttagcagtgctaagctcaatggatatattcctccaaataaagaggactgtgggcagccaggattcactcttgcagaaagacagcggtttggcaatatattgtcccagggaaagctagtagatgcttacagacacctgcacaaagaaaaagacatggaatgtggtttctcttggtctgggaatcctattggcaagtaccggggaaagagaatgcggattgattatttcatcgtttcagaacggttgaaggacagattagtttcatgtgaaatccatggtcatggaattgaactcgaaggattttatggaagtgatcactgtcctgtttcacttgagctctccaaagacgcagcggaagcaccaggatcccaaaactccagctaacttctatgtttctatcttaacatatcatcatggattattattaggttaggtcaggttaagcg

SEQ ID NO: 1301 - DNA, 1410 bp, Brachypodium distachyon
gacgggcgaggaaaggagggcagccgcagtctgcactctgcagcagtaccagcggcggcgatgaagcgcttcttccaacccgtgcctaaggaaggctcccccgccaagaggaggccctcagaggtcgtcgcctccgactgcgtcgatggccccgccgccaccgcggccggcgccggtggggagggggctcccggccaggagccgcgcaggttcatgacgtggaacgccaacagccttctcctccggatgaagagcgactggcctgcgttctgccagttcgtctcccgcctcgaccccgacgtcatctgcgtccaggaagtgcggatgccggcagccggttccaaaggggcaccaaaaaatcctagtgagctaaaagatgacacaagctcgtcacgcgaagagaaacagatagtgctgcgtgctttgtcgagttcacctttcaaagactaccgtgtctggtggtctctttcagattccaaatatgcaggcacagctgtgtttgtaaagaagatgtttgagccaaagaaagtgtcattcaacttggatagaacatcttccaagcatgaatcggacggtcgtgtcatcattgtagaatttgaatcattgctgttactaaacacatatgctccaaataatgggtggaaagaggaggaaaattcatttcaaagaagaagaaagtgggataagagaatgttcgagtttgttcaacaagtagacaagcccttcatctggtgtggagacttgaatgtcagccatgaagaaatcgacgtcagccatcctgacttttttagcagtgctaagctcaatggatatattcctccaaataaagaggactgtgggcagccaggattcactcttgcagaaagacagcggtttggcaatatattgtcccagggaaagctagtagatgcttacagacacctgcacaaagaaaaagacatggaatgtggtttctcttggtctgggaatcctattggcaagtaccggggaaagagaatgcggattgattatttcatcgtttcagaacggttgaaggacagattagtttcatgtgaaatccatggtcatggaattgaactcgaaggattttatggaagtgatcactgtcctgtttcacttgagctctccaaagacgcagcggaagcaccaggatcccaaaactccagctaacttctatgtttctatcttaacatatcatcatggattattattaggttaggtcaggttaagcggactctcacaacaatgctattctatcagtttctaagacctgcagtaattatgtatatcccattattgctgggcattctctagctcggatcctggttgtaacttgtaggttactgtgatcagctattgctatgtcagacgttcaaacttccatgggttgttcctcttccggctccaaaa

SEQ ID NO: 1302 - DNA, 1639 bp, Panicum virgatum
gtaacgttgacagcggaggattcagtccagttgcggacttgcgggtagaggagccgccagccccgccgccgcccgctggcgatgaagcgcttcttccagcccgtgcctaaggacggctccccggctaagaagaggcccacagccactaccgactcgggcgatgcccccgccgcggccggcgccggcggggaggaggggagccccggcgaggagccgcacaagttcgtgacgtggaacgccaacagcctgctccttcggatgaagagcgactggcccgctttctctcagttcgtcgctcgcctcgatcccgacgtcatctgcatccaggaggtgcggatgcctgcggctggttcaaaaggggcacctaaaaatcctagggaactaaaagatgacacaagctcatcacgggacgaaaagcagatagttttgcgtgctttgtcgagttcacctttcaaagactactgtgtctggtggtctctttcagattcaaaatatgcaggaacagctgtgtttatcaagaaaaagtttgaacctaagaaggtgtcttttaacctggatagaacgtcttccaagcatgaaacggatgggcgtgttataattgtggaatttgaatcatttctcttactaaacacttatgctccaaacaatggatggaaggaggaagaaaattcatttcaaaggagacgtaagtgggacaagagaatgctagaatttgttcaacgtgtagacaaacccttaatctggtgtggcgacttgaacgtcagccatgaagaaatcgatgtcagccatcctgattttttatcagtgctaagctgaatggatataccccgccaaataaagaggactgtggacagccaggattcaccctagcagagaggcatcgatttggcaacatattgtcccatggaaagctggtagatgcttatagacacctgcataaagaaaaagatatggacagtggcttctcctggtccggtcatccaattggcaagtaccgaggaaagagaatgaggattgattatttcattgtttcggaacaattgaaggacagaataatttcatgtgaaatgcatggccgtggaattgaattagaaggattttatggaagtgaccactgccctgtttcacttgagctctccaaagcagcaacagaagcaccagaaccccccaggccatccagctaaaatttgtgtgctgctatcttgacctgtcactcatcatggtagttattagggttgtcgagtagactagtattgggcccagggatgggcggatggccattgttttgacatttaccttcagtaaatctgaatatgccatgctaatgtgcaattcatgctcttgctgggatctgattgtatttatgatctagcaggctactagtactaatgctacaacactagaggttaggtaccattggcccattgccatttaagcaatgcagcttcgccatctttcctatgatttagcagatgtttgtttaagctgtaacgaatgtttgtgcctggcaaattatggaaccaacttggcaaggtataaaacatctgcgttttttcattagaattcaaaggaccgataaagagatgcaagagccgggctcctatctggctatcttgggaaaatgcactgcttgttctcc

SEQ ID NO: 1303 - DNA, 1613 bp, Setaria italica
atgaagttggaccaaacaaaaattagggtagaagcgttgctcactaagataagatatggagaggactcgagtgagccgcggggagctgccgccgcgccacagccaccgcaggcgatgaagcgcttcttccagcccgtgcccaaggacggctcctcagccaagaagaggcccgcagtcgctaccgactcgtgcgatggccccgccgcgaccggcgccggtggggaggaggggagccccggcgaggagccgtgcaagttcctgacgtggaacgccaacagcctgctccttcggatgaagagcgactggcccgctttctcgcagttcgtcgcccgcctcgatcccgacgtcatctgcgtgcaggaagtgcggatgccggcggctggttccaaaggggcacctaaaaatcctagtgaactgaaagatgacacaaactcatcacgggatgaaaagcaggtagttctgcgtgctttatcgagttcacctttcaaagactaccgtgtctggtggtctctttcagattcaaaatatgcaggaacagctatgtttataaagaaaaagtttgaacctaagaaggtgtcttttaacttggataaaacatcttcaaagcatgaaacggatgggcgtgttataattgtggaatttgaatcgtttctcttactgaacacttatgctccaaacaatggatggaaggaggaggaaaattcatttcaaagaagacgtaagtgggacaagagaatgctggaatttgttcaatgtgtagacaaacccttaatctggtgtggggacttgaatgtcagtcatgaagaaatcgatgtcagccatcctgatttttttagtagtgctaagcagaatggatataccccaccaaataaagaggactgtggacagccaggattcaccctagcagagaggcgtcgctttggcaacatattgtcccagggaaagctggtagatgcttacagacacctgcataaagaaaaagacatggacagtggcttctcttggtccggtcatccaattggcaagtaccggggaaagagaatgaggatcgactatttcattgtttcagaacaattgaagggcagagtaatttcatgtgaaatgcatggccgtggaattgaattagaaggattctatggtagtgatcactgccctgtttcacttgagctctccaaagcagcaacagaagtaccagaaccccccaagccgtccagctaaaacttgtgtgctgctctcttgacctgtcactcatcatggtagttattagggttgttgagtagactagtgttgggcccaggcatggccattgtttgacattttcctgcggtatctgaacatgccattccatgcaaatgtgcaatgcttgctcagatgctctagctgggatctgattgtatttatgatccagcaggctacaagtactatggtcagacactatgagttcagggctccattgccatttaagcaatgcaacttcgacatctctcctagagccatcccattgtcttgcagatgtttgtctaagttgtagcgaatgtttgcgtggcaaattatggaaaccaatttggcatgctataaaacatctgcgcttctttaggtgttgacattgcttt

SEQ ID NO: 1304 - DNA, 1402 bp, Panicum virgatum
gccagccccgccgccgcccgctggagatgaagcgcttcttccagcccgtgcccaaggacggctccccggctaagaagaggcccacaggcgctaccgactcaggcaatgcccccgccgcggccggcgccggcggggaggaggggagccccggcgaggagccgcgcaagttcctgacgtggaacgccaacagcctgctccttcggatgaagagcgactggcccgctttctctcagttcgtcgctcgcctcgatcccgacgtcatctgcatccaggaggtacggatgccggcggctggtttaaaaggggcacctaaaaatcctagcgaactaaaagatgacacaagctcgtcacgggacgaaaagcagatagttttgcgtgctttgtcgagttcacctttcaaagactaccgtgtctggtggtctctttcagattcaaaatatgcaggaacagctatgtttataaagaaaaagtttgaacctaagaaggtgtcttttaacctcgatagaacatcttccaagcatgaaatggatgggcgtgttataattgtggaatttgaatcatttttcgtactaaacacttatgctccaaacaatggatggaaggaggaagaaaaatcatttcaaaggagacgtaagtgggacaagagaatgctagaatttgttcaacatgtagacaaacccttaatctggtgtggcgacttgaacgtcagccatgaagaaatcgatgtcagccatcctgatttttttatcagtgctaagctgaatggatataccccgccaaataaagaggactgtggacagccaggattcaccctagcagagaggcatcgatttggcaacatattgtcccaaggaaagctgatagatgcttatagacacctgcataaagaaaaagatatggacagtggcttctcctggtccggtcatccaattggcaagtaccgaggaaagagaatgaggattgactatttcattgtttcagaacaattgaaggacagaataatttcatgtgaaatgcatggccgtggaattgaattagaaggattctatggaagtgaccactgccctgtttcccttgagctctccaaagcagcaacggaagcgccagaaccccccaggccatccagctaaaatttgtgtgctgctatcttgacctgtcactcgtcatggtagttattagggttgttgagtagactagtattgggcccagagatgaccattgtttagacattttccttcagtaaatctgaatttgcaattcatgctcgtgctgggatatgtttgtatttatgatctagcagactactagtactaatgctcgaacactagagcttaggtaccattggcccattgccatttaagcaatgcagcttcgccatctctgctatgatctagcagatgtt

SEQ ID NO: 1305 - DNA, 1781 bp, Oryza sativa
actaacgttttcgctaatccccgtacgacgccggcgcagccccgcacgcagaaagacgcgacgcgaggagcggccgccgccggcagctgttgcgatgaagcgcttcttccagcccgtgcccaaggatggctccccggcgaagaagaggcccgccgccgccgccgccgcctccgcctccgactccgactccctcggcggcgacgcccccgccgcggccgcctgcgccgtcggggagggggattctcctcccgctccccgcgaggaggaaccgcggaggttcgtgacgtggaacgccaacagcctgctcctccggatgaagagcgactggccggccttctgccagttcgtctcccgcgtcgaccccgacgtcatctgcgtccaggaagtgcggatgccagcagctggttccaaaggggcaccaaaaaatcctggtcaactgaaagatgacacaagctcatcacgagatgaaaagcaggtagtgctgcgtgctttgtcgagtccaccttttaaagactatcgtgtctggtggtctctttcagactccaaatatgcaggcacagctatgattataaagaagaagtttgaaccaaagaaagtgtcattcaacttggatagaacatcttccaagcatgaaccagatgggcgtgttattattgcagaattcgaatcgttcctcttgctgaacacttatgctccaaacaatggatggaaagaagaggaaaattcatttcaaagaagacggaaatgggataaaagaatgttggagtttgttcaacaggtagacaaacccttaatctggtgtggagacttgaatgtcagtcatgaagaaatcgatgttagccatcctgatttttttagcagtgctaaactcaatggatacatccctccaaataaagaggattgtggacagccaggattcaccctgtcagagaggcggcgcttcggcaatatattgtcccaaggaaagctggtagatgcttacagatatctgcacaaagagaaggacatggattgtggcttttcttggtctggacatccaattggcaagtaccgagggaagagaatgcgaattgactatttccttgtttcagaaaaactgaaggaccaaatagtttcatgtgacattcatggtcgtggaatagagctagaaggattttatggaagtgatcactgccccgtttcacttgagctctcggaagaagtagaagcaccaaaacccaagtcctccaactaatttctatatttcgcacttaaccagacatggtggagattttagattagctgaagcatatctgctttgtatctcttgagtcattatccattattcaaatattgtctcagtctagcagtatttctgatgatgaattggatgatctagctaggatcctgattgtaattataattagtatgttactatggtctgcaatgctatctttagatcctataagatcaaaaacttctaccatttgttccattgtttttaatccgaagaaaaacaatatatgcaagctaattctggtccgcaggtagaccgcgtttgagaacatgtggagttaacctttataaactactaactactccagtaataaagttgcgtgcataacctacatgataatagcatctgtagatttttgtctagtatgattctcccgggaaaactgcagaaattacaaaatgacatcccggtgcattacatttgtgcctaggttccatgttcgtctgacacaatggaagctacggctctggttgtttaggtatgctgtagaaaaaataaagaaaca

SEQ ID NO: 1306 - DNA, 1524 bp, Oryza sativa
actaacgttttcgctaatccccgtacgacgccggcgcagccccgcacgcagaaagacgcgacgcgaggagcggccgccgccggcagctgttgcgatgaagcgcttcttccagcccgtgcccaaggatggctccccggcgaagaagaggcccgccgccgccgccgccgcctccgcctccgactccgactccctcggcggcgacgcccccgccgcggccgcctgcgccgtcggggagggggattctcctcccgctccccgcgaggaggaaccgcggaggttcgtgacgtggaacgccaacagcctgctcctccggatgaagagcgactggccggccttctgccagttcgtctcccgcgtcgaccccgacgtcatctgcgtccaggaagtgcggatgccagcagctggttccaaaggggcaccaaaaaatcctggtcaactgaaagatgacacaagctcatcacgagatgaaaagcaggtagtgctgcgtgctttgtcgagtccaccttttaaagactatcgtgtctggtggtctctttcagactccaaatatgcaggcacagctatgattataaagaagaagtttgaaccaaagaaagtgtcattcaacttggatagaacatcttccaagcatgaaccagatgggcgtgttattattgcagaattcgaatcgttcctcttgctgaacacttatgctccaaacaatggatggaaagaagaggaaaattcatttcaaagaagacggaaatgggataaaagaatgttggagtttgttcaacaggtagacaaacccttaatctggtgtggagacttgaatgtcagtcatgaagaaatcgatgttagccatcctgatttttttagcagtgctaaactcaatggatacatccctccaaataaagaggattgtggacagccaggattcaccctgtcagagaggcggcgcttcggcaatatattgtcccaaggaaagctggtagatgcttacagatatctgcacaaagagaaggacatggattgtggcttttcttggtctggacatccaattggcaagtaccgagggaagagaatgcgaattgactatttccttgtttcagaaaaactgaaggaccaaatagtttcatgtgacattcatggtcgtggaatagagctagaaggattttatggaagtgatcactgccccgtttcacttgagctctcggaagaagtagaagcaccaaaacccaagtcctccaactaatttctatatttcgcacttaaccagacatggtggagattttagattagctgaagcatatctgctttgtatctcttgagtcattatccattattcaaatattgtctcagtctagcagtatttctgatgatgaattggatgatctagctaggatcctgattgtaattataattagtatgttactatggtctgcaatgctatctttagatcctataagatcaaaaacttctaccatttgttccattgtttttaatccgaagaaaaacaatatatgcaagctaattctggtccgc

SEQ ID NO: 1307 - DNA, 1546 bp, Sorghum bicolor
agcttattccgattttgcaatgctcaccgttcggtttctcctcgtacccagccgccgccgccgccgcagcctgcacccgcagtccgcaggcgatgaagcgcttcttccagccagtggccaaggacggctccccatccaagaagcggcaggcggccgctgccgaaccggagggcggccccgcctcagccggcgccgccaccggcggggatggagaggggagacccgccgaggagccgcgcaagttcctgacgtggaacgccaacagcctgctcctccggatgaagagcgactggcccgctttctcgcagctcgtcgcccgtctcgaccccgacgtcatctgcgtccaggaagtgcggatgccggcggctggttccaaaggggctcctaaaaaccctagtgaactgaaagacgacacaagctcgtcacgggatgaaaagcaggtagttctgcgtgctttgtcaacttcacctttcaaagactaccgtgtctggtggtctctttcagattcaaaatatgcggggacagctatgtttataaagaaaaagtttgagcctaagaaggtgtctttcaacttggatagaacatcttctaagcatgaaactgatgggcgcgttataattgcggaatttgaatcattcctcttactaaacacttatgctccaaacaatggatggaaggaggaggaaaattcgtttcaaagaagacgtaagtgggacaagaggatgctggaatttgttcaacatgtggacaaacccttaatctggtgtggggacttgaatgtcagtcatgaagaaatcgatgtcagccatcctgatttctttagcagtgctaagctgaatggatacaccccacccaatcaagaggactgtgggcagccaggattcaccccagcagagaggcggcgctttggcaacattttattccaaggaaagctggtagatgcttacaggcacctgcacaaagaaaaggacatggatggtggcttctcttggtccggtcatccaattggcaagtaccgaggaaagagaatgaggatcgactacttccttgtttcggagcagttaaaggacagaattgtttcatgtgaaatgcatggccgtggcattgaattagatggattttatggaagtgaccattgccctgttacacttgagctttccaaagctgtagcagaagcagcaccagaacagcccaagccatagattgtcctcttgacctgtcactcatcatggtagttattattagggatggtgagtaggctagtgttgggctcagccatggtggtcattgttgagacatttcctgtctttgattaaatctgattattccacgccatgcattgcgtgctctagctggaatttgattgtagttattattatgatgatccagcaggctacgagtaatatgctgagagtttagggttagtatagtttaggctaccagtactgcatccgtttagggctccattgccatttgagcaatgtaataacttcaacatgtctcttacatttggtctcactttgcttaaactgatgtttggtctcac

SEQ ID NO: 1308 - DNA, 1649 bp, Zea mays
tccgctgtttcccctgaccagcagaccgctgccgagagcccgagacagtgcccgctggtgagttcgaaaccccagagctttaaagcttttccgattccgcaatgctcaccgttcggttccttctcgtaccgagccgcgggtagccagccaaccgccgacgcagtccacaagcgatgaagcgcttcttccagccagtgcccaaggacggctccccgtccaagaagcggctagcgggtgctgctgaaccgggcgacggccccacatcagccggtgccgccaccggcgctggcggggatgtagaggggaggcccaccgaggagccgttcaagttcctgacgtggaacgccaacagcctgctcctccggatgaagagcgactggcctgctttctcgcagctcgtcgcccgccttgaccccgacgtcatttgtgtccaggaagtgcggatgccggcagctggttccaaaggggcacctaaaaaccccagtgaactaaaagatgacacaagcttgtcacgggatgaaaagcaggtagttctacgtgctttgtcagcttcacctttcaaagactaccgtgtctggtggtctctttcagattcaaaatatgctgggacagctatgtttataaagaaaaagtttgagcctaagaaggtgtctttcaacttggatagaacatcttctaagcatgaagccgatgggcgtgttataattgcggaatttgaatcattccttttactgaacacttattctccaaacaatggatggaaggaggaggaaaatgcatttcaaagaagacgtaagtgggacaagaggatgctggaatttgttcaacacgtggataaacccttaatctggtgtggggacttgaatgtcagtcatgaagaaatcgacgtcagccatcctgatttctttagcagcgctaagctgaatggatacaccccacccaataaagaggactgtggacagccaggattcaccccagcagagagacggcgttttggcaacatattattccaaggaaagctggtagatgcttacaggcacctgcacaaagaaaaggacatagacggtggcttctcttggtccggtcatccaattggcaagtaccgaggaaagagaatgaggatcgactacttccttgtttcggaacagttaaaggacagaatagtttcatgtgaaatgcatggccgtggcattgaattggatggattttatggaagtgaccactgccctgtttcgcttgagctttccgaagctgtagcagaagaagcaccaggacagcccaagccatccatctaaatataccaccatggtggtcattgttgagacatttccggtccttcattaaacctgactgttccatgcattgcctactctaggtagctgaggtttgattgtaggtattattatgatcccagtaggttaccagttcctgtggtcagggctggtatagtttagggatcattgccatttaagcagtgcaatttggacatctcattctgcttgaaatgttgtttgtctaagagcagccatggactacctaatacctcatggggatcgaagagattaatcccttcgtatccaattttaactagcaagggatttaatccacccctaacaagcacaataaaatcttgttcgttttttctacca

SEQ ID NO: 1309 - DNA, 795 bp, Triticum aestivum
agctcgtcacctccgtggacttcgaggacgacgtgatcaccgccaccgtcacgtcctccggcgacgccgtcaaagcctggctccgccagatccgctacgtctaccgctgggtctaccacaagctcatcgtgggactggacgtcgagtggcccccagctacggccgcgcgcagaaccccgtcgcgctcctgcagctctgcgtcggccgccgctgcctcgtcttccagctcctccacgccgacttcgtcccgcgggccctccaccgcttcctcgccaacccggacttccgattcgtcggcgtcggcgtgcaggacgacgccgaccgcctcagcaacgactacggcctcgaggtcgccaacgccgtcgacctgcgcaacctcgcggccgacgagatgcgcaggccgtggctccgccaggcggggctcaagggcgtcgcgggcgtcgtcatgggggccaacctcaacaagccacgcagggtcaggatggggccgtgggacgcctgccgcctctcccaagagcagatccagtacgccagcatcgacgccttcgtcttatttgaggtcggccggaagctcctcaccggcgactactcctccgaagaggaggactactgaggtgatcgattgccgtcgtcccatgtcctgctgaatctaccagctcccaagtactagtgcatttagatttagttgtttatctcgtaacgctaagcaatagatggtttattaggagtttacctccaaactctagctcttaagtttaggactttatggatctgtgatgaaaggatcagccagac

SEQ ID NO: 1310 - DNA, 1566 bp, Secale cereale
cttgtaccctggctagcatgccttgtcgtggctttcctctccttctatcttctcagcctcctcgcgcacgcgcgctccggcctgccaccgggcccccgcccactgccgctcatcggaagcctccacctcctcggcgacaagccgcaccgctcgctcgcccgcctagccaagatctacggcccgctcatgtccatccgactgggcgcggtcaccacggtggtcgtctcctcccccgccatggcccgcgagttcctgcagaggcatgactctgtgctcgccacccgatccgtgcccgacgccaccggcaagcacgcggcgggctccgttccctggctgcccccggcgccgcggtggcgcgcgctccgcaagatgatggccacggagctcttcgcgccccaccggctcgacgcgctccatcacctccggagcgacaaggtgagggagctcacggaccacgtcgcgcggctggcgcgcgagggcacggcggtgaacgtcggccgcgtggcgttcacgaccagtctgaaccttatctcccgcaccatcttctccgtcgacctgacgagcctcgacgacatgagcagttccaaagagttccaagaggtgatcacggccatcatggaaggcctggggaccccgaacttgtcggatttcttcccggtgctcgcgccggccgacctgcagggcatgcgccggcggctggcgcgactgttcgcgcggctgcacgccgtgttcgacgccgaggtggaccagaggctacacggccgcgacgccggccagcccaggaagaacgacttcctcgacgtgctgctcgatgtggcggcgcgtgaggacggcaaggacctgctcgaccgtgagacactacgatcacacttcacggatttgtttgctgccggtagtgacacaagctctagcacagtggaatgggcaatgactgagcttctccaaaacccatcatcaatggctaaggtctgcgacgagctagcacaagttatcggcacaagaagaaatatcgaagaagctgatattgttcgattgccctatctccaagctgtcataaaagagacttttcgactccaccctcccgctccactcttgttgccacgccaaccagagacgacagtcaaaatagcaggttgcacaatacctaagggttcacgcgtgttcataaacgtatgggcgataggtcgagataaagatgtatggactgaacctgagaagtttatgccggagaggttcttgggttcaacgattgactttaggggtgtggattttgagctccttccatttggtgctgggcgtcggatctgccctggaatggcattggcaattaggatggtgcatgtgatgctcgcttcattgttaaatcaatttaagtggagtctccctattgagctggaacgggatgggattgatatggaagatcagtttggcttgacactagcgaaggtcgtgcccctttgtattatagcaacacccatttgagccaacaactaaatgcaacattgttaagtagggtgttgttgatgtgtaataatttaaatgtatcagccttgtaatttatatcgt

SEQ ID NO: 1311 - DNA, 1889 bp, Triticum aestivum
aagttgagtattattccttaagttagattcccttatattttgggacagagcgactaacattgtgagatgaaccgggtttatatagtctagtctccaaaacatagctttgcccactagttttcaatttctctttgcctatttattaaatactcctgtggcgcaggccgaactgcacagaggatggaagcaatggtggccgtggctgtgcttgtgccttggctagcatggctcatcgtctctttcctttccctctacctcctcagcctgctcgcgcacgcgcgctccggcctccctccgggcccccgcccactgccgctcatcggcagtatccaccttctcggcgacaagccgcaccgctctcttgctcgcttagccaagatccacggcccgctcatgtccatccgcctcggcacggtcaccacggtcgtcgtctcctcccccgccatggcccgggagttcctgcagaggcatgactccgtgctcgccacccggtccgtgcctgacgccaccggcaagcacgcggtaggctccgtcgcttggctgcccccggtgccacggtggcgcgcgctccgcaagataatggccacggagctgttcgcgccgcagcggctcgacgcgctccaccacctccggagcgacaaagtgagggagctcacggaccacgtcgcgcggctggcgcgcgagggcacgccggtgaacatcggccgcgtggccttcacgacgagcctgaaccttgtctcccgaaccatcttctccatcgacctcacgagcctcggtgaccacggccgctccaaggagttccatgaggtgatcacgggcatcatggaaggcttggggacccccaacgtgtcggacttcttcccggtgctggcgccggccgacctgcagggcatgcgctggcggttggcgcggctgtttgcacggctgcacgccgtgttcgacgccgaggtggaccagaggctgcgcggccgcgacgccggccagcccaggaagaacgactacctcgacgtgctgctcgacttggcggcgagtgaggatcggaaggacctgctcgaccgtgagacgctacgctcacattttacggatttgtttgctgctggtagtgatacaaactctagcacagtggaatgggcaatgaccgagcttctccaaaaccgatcatcaatggctaaggtttgcgacgagcttgcgcaagttatcggcgtaagaaaaaacactgaagaagctgacattgctcggttgccctatcttcaagctgtcataaaagagactcttcgactccaccctcctgctccattgttgttgccacgccaagcaaaaacaactgtcaaaatagaaggttacacaatacccatggattcacgcttgttcataaacgtatgggcaataggacgagataaagatgtgtggactaaacctcagaagtttatgccggagaggttcttgggatcgactattgactttaggggtatggattttgagctccttccatttggtgcggggcgtcggatctgccctggaataacattggcaattcggatggtgcatgtgatgctcgcttcattgttaaatcaatttaggtggagtctccctgttgagatggaacatgatgggattgatatggaagatcagtttggcattacactagcgaaggtcgtgcctctttgtattatagcaacaccaatttgatccgataagaaattgcaacattgttaagagtggattagatgttgttaatgtgtaataatttaaatgaatggaccatgtgatttgtaccattatttatgtgacaacttccatattctctcatagttccaaccttttgtgccttcattatccactgatttgttggaaatatgcccaagaggcaataataaatataattatcc

SEQ ID NO: 1312 - DNA, 1807 bp, Secale cereale
tcagcaatggtggtggctgtgcttgtgccgtggctagcatggctcatcgtctctttcctttccctctacctcctcagcctcctcgcgcactcgcgctccggcctccctccgggcccccgcccactgccgctcatcggcagcatccaccttctcggcgacaagccgcaccgctctcttgctcgcctagccaagatccacggcccgctcatgtccatccgccttggcacggtcaccacggtcgtcgtctcctcccccgccatggcccgggagttcctgcagaggcatgactccgtgctcgccacccggtccgtacctcatgccaccggcaagcacgcggtaggctccgtcgcctggatgccccccacgccacagtggcgtgcgctccgcaagataatggccacggagctgttcgcgccgcaccggctcgacgcgctccaccacctcaggagcgacaaggtgagggagctcacggaccacgtcgcacggctggcgcgcgagggcacggcggtaaacatcggccgcgtggccttcacgacgagcctgaaccttgtctcccgcaccatcttctccatcgacctcacgagcctcggcgaccacggccgctccaaggagtttcaggaggtgatcacgggcatcatggaaggcttggggacccccaacgtgtcggacttcttcccggtgctggcgccggccgacctgcagggcatgcgccggcggctggcgcggctgtttgcacggctgcacgccgtcttcgatgccgaggttgaccagaggctgcacgaccgcgacgccggccagccgaggaagaacgactaccttgacgtgctgctcgacgtggtgactactgtggacggcaaggtcctgctcgaccgtgagacgctacgctcacatttcacggatttgtttgctgccggtagtgataccaactctagcacagtggaatgggcaatgactgagcttctccaaaacccatcatcaatggctaaggtttgcggcgagctagaacaatttatcggctcaagaaaaaatattgaagaaggtgacatcgctcggttgccttatcttcaagctgtcataaaagagactcttcgactccaccctcccgctccactattgttgccacgccagccaggaacaacggtaaaaatagaaggttacacaatacctaccggttcacgcttgttcataaacgtatgggccataggtcgagataaagatgtgtggactaaacctgagaagtttatgccagagaggttcttgggttcgactgttgactttaggggtgtggattttgagctccttccatttggcgccgggcgtcggatctgccctggaataacattggcaattcggatggtgcatgtgatgctcggttcattgttaaatcagtttaagtggagtctccctgttgagatggaacatgatgggattgatatggaagatcagtttggcattacactagcgaaggtcgtgcctctttgcattatggcaacaccaatttgatccaataagaaaatacaacattgttaagagaggattagatgttgttaatgtgtaataattcaaatgaatgagccatgtaatttgtaccattatttatgtgacaattttcatattcgctcatagttccaaacctttttgcgcctttcattatccaaataatttgttggaaatatgcctaagggctaatactgaatttaattatttaatttaccaaaaactaaaaaaaaaaaaaaaaaaaacaaaaaaaaaaaaaacctaaagaagaactagtaccgaaggacaacaacaagggaagtaggagaca

SEQ ID NO: 1313 - DNA, 1735 bp, Triticum aestivum
cctagcagcacaaggaaaaggaagcaataatggtggcggtggcggtgcttgtgccgtggctagcatggctcgtcgtctccttgctctccctctacctcctcaacctcctcaaccacgcgcgctccggcctcccgccggggccgcgcccgctgccgctcatcggcagcctccacctcctcggcgacaagccacaccgctccctcgcacgcctggccaggacccacggcgccccgctcatgtccctccgcctcggcgcggtcaccacggtggtcgcctcctcccccgccatggcccgggagttcctgcagaggcacgacgccgcgttcgccgcccggtccgtgcccgacgccaccggcatgcacgcggccggctccgtcccctggctgcctcccgcgccgcggtggcgcgcgctccgcaagatgatggccacggagctcttcgcgccgcaccgcctcgacgcgctccaccacctccggagcgagaaggtgggcgagctcatggaccacgtcgcgcggctggcgcgcgacggcaagccggtgaacgtggggcgcgtggccttcaccaccagcctgaacctgctctcccgcaccatcttctcccacgacctcacgagcctcgacgacgacagccgctccggggagttccaggaggtggtgacggccatcatggaggccgtggggaccccaaacgtgtcggacttcttcccggtgctcgcgccggccgacctgcagggcacccgccggcggctggcgaggctgttcgctcggctgcacgtggtgttcgacgccgaggtggaccagaggctgcgcgctcgcgacgccggccagccccggaagaacgacttcctggacgtgctgctcgacgtggcggcgcgtgaggatggcaaggacctgctcgaccgccagacgctacgctcacttttcacggatttgtttgccgccggcactgacacaagctctagcacagtggaatgggcaatgaccgagcttctccaaaatccatcatcattagctaaggcttgcaatgagcttgaacaagttatcggcccaagaagaaacattgaagaagctgacattgttcggttgccctatatgcaagctatcataaaagagacttttcgactccatcctcctgctccactcttgttgccacgccaacctgaggcaacactgaaaatagcaggctacacaataccgaaaggttcacgcattttcataaacgtatgggcgataggtcgagataaagatgtatgggatgaacctgagaaatttatgccggaaaggttcttgggttccacagttgactttagaggtgcggattttgagctccttccatttggtgccggacgtcggatctgccctgggatgacattggcaactaggatggtgcatttgatcctcgcttcgttgttacatcagtttaagtggagtctccctgctgagctggaaagggatgggattgacatggaagataagtttggcctcacacttactaaggtcgttcccctttgtattgtagcaacaccggtttgaattgaccaaaaaaatataatttgtatgagtgctttaggtgttgctaatatgtaataactcaaatgtgtcacacatggaatttataccattatttatgtgacaatgataatgaatcttctagaaaactcaactttctagcgattcacaagctgaacaatgtatgttgtgttattaaaatgttgttcctacaaagatattcatac

SEQ ID NO: 1314 - DNA, 1677 bp, Triticum aestivum
tgtttcattccagactcctgtcgtgcgctgaactgcacaaattgaaggaagcaaagcaatggcgcccgtggcagtgcttgtgccgtggctagcatggctcgtcgcctctttcctctccgtctacctcctcaacctcctcgcacgggcgcgctccggcctcccgccgggcccccacccgctgccgctcatcggcagcctccacctcctcggcgacaagccgcaccgctcccttgcccgcctggccaaggcccacggcccgctcatgtccctgcgcctcggcgcggtcaccacggtggtcgtttcctcccccgccatggcccgggtgttcctgcagcgccacgactccgcgttcgccgcccggtccgtgcccgacgccaccggcgagcacgcggcgggctccgtggcctggctgccccctgcgccgcggtggcgcgcgctgcgcaagatgatggccacggagctgttcgccccgcaccggctcgacgcgctgcgccacctgcggagcgaaaaggtgcgggagctcgtggaccacgtcgcgcggctggcgcgcgagggcgcgccggtgaacgtcggccgcgtggccttcacgacgagcctgaacctcctctcccgcaccatcttctccgccgacctgacgagcctcgacgaccgcggccgctcggaggagttccagcaggtggtgacggccatcatgcaggccgtggggagccccaacgtgtcggacttcttcccgctgctcgcgccggccgacctgcagggcacgcgccggcggctggcgcggctgctcgcgcggctgcacgcggtgttcgacgccgaggtggacgggaggctgcgcggccgcgacgccggccagccgaggaagaacgacttcctcgacgcgctgctcgacgtggcggcgcgtgaggacggcaaggacctgctggaccgccagacgctacgatcacttttcacggatttgttctctgctggtagtgacacaagctctagcacagtggaatgggcaatgacagagctgctccaaaacccatcatcaatgtccagcgcttgcaacgagcttgcagaagttattggcttcaaaagaaacattgaagaagatgatattgttcggttgccctatctccaagctgtcataaaagagacttttcgacttcatcctcccggtccactcttgttgccacggaaacctgagaggacagtggaaatagcaggttacacaatacctaaagattcgcgtgtgttcataaacgtatgggcgataggtcgagacaaagattatggtctgagcctgagaagtttatgccagagaggttcttgggttcaagaattgactttaggggtgctgattttgagctccttccatttggtgctggacgtcggatctgccctggaatgccattggctattagaacggtgcatttgatcctcgcttcgttgttaaaccagtttaaatggagtctccctgttgagcttgaaagggatggaattgatatggaagaaaagtttggcctatcactaacgaaggttgtgcctctttgtattgtaccaacaccggtttgaattcataaaaatgtatcctagtaagattgccttagatgttttcaatatgtagtaattcaaatgtatcaaccatggaatttatgtcattatttatgtgataattaaataagtattctagaa

SEQ ID NO: 1315 - DNA, 1707 bp, Hordeum vulgare
gctagcagtttcatcagagacgcctgtccagtgccgccggccgacctgcacatgggaaaggaagcaacaatggtggccgtggcagtgcttgcgccgtggcttgcctggctcgtcgtctctttcgtctccctctacctcctcaacctcctcacccacgcgcgctccggcctcccgccgggcccgcgcccgctgcctctcatcggcagcctccacctcctcggcgacaggcctcaccgctccctcgcacgcctggccatgacccacgccgccccgctcatgtccctccgcctcggctcggtcaccacggtggtcgcctcctcccccgccatggcccgggagctcctgcaacggcacgacgcagcgttctccacccggtccgtgcccgacgccaccggcatgcacgcggccggctccgtcccctggctccccccggccccgcggtggcgcgcgctccgcaagttgatggccacggagctcttcgcgccgcaccggctcgacgcgctccaccacctccggagcggcaaggtgcgggagctcatggaccacgtcgcgcggctggcgcgcgacggcaagccggtgaacgtggggcgcgtggccttcacgaccagcctgaacctgctctcccggaccatcttctcccgcgacctgacgagcctcgacgacgacaaccgctccggggagttccaggaggtggtgacggggatcatggaggccgtggggaccccgaacgtgtcggacttcttcccggtgctcgcgccggccgacctgcagggcacgcgccggcggctggcgaggctgttcgctcggctgcacgtggtgttcgacgccgaggtggaccagaggctgcgccgccgcgacgacggccagccaaggaagaacgacttcctcgacgtgctgctcgacgtggcggcgcgtgaggatggcaaggacctcctcgaccgcccgacgctacgctcacttttcacggatttgtttgtcgccggcagtgacacaagctctagcacagtggaatgggcaatgtccgagcttcttcaaaatccatcatcattgtctaaggcttgcaatgagcttgaaaaagttatcggccaaagaagaaacattgaagaatctgacattgttcggttgccctatattcaagctatcataaaagagacttttcgactccatcctcctgctccactcctgttgccacgccaacctgaggcaacactgaaaatagcaggctacacaataccaaagggctcacgtgttttcgtaaatgtatgggccataggtcgagataaagacgtatgggatgaacctgagaaatttatgccggaaaggtttctgggttccacaattgactttagaggtgtggattttgagctccttccatttggtgccggacgtcggatctgccctgggatgacattggcagctaggatggtgcatttgatgcttgcttcgttgttacatcagtttaagtggagtctcccggttgagctggaaagggatgggattgacatggaagataagtttggcctcacactaactaaggtcgtgcccctttgtattgtagcaacaccagtttgaattgatgggaaaaaatataatctgtatgagtgctttaggtgttcttaatatgtaataactcaaatgtgtcatgcatgtaatttataccgtcatttatgtgtgacaatgattgaatcttctagaaaacttgacttt

SEQ ID NO: 1316 - DNA, 1704 bp, Hordeum vulgare
gtgtttcattcgagactcctgtcggtcgtgtgctgcatgcgccgcgcgctaggactgcacaaattaaagctaggaagcaagcaatggcatctgtggcagtgcttgtgccgtggctagcatggctcgccgtctctttcctcgccgtctacctcctcagcctcatccctcacgcgcgctccggcctcccgccgggcccccgcccgctgccgctcatcggcagcctccacctcctcggcgacaagccgcaccgctccctcgcccgcctggccagtacccacggcccgctcatgtccctgcgcctcggcgcggtcaccacggtggtcgtctcctcccccgccatggcccgggagttcctgcagcggcacgactccgcgttcgccgcccggtccgtgcccgacgccaccggcgaccacgcggcgggctccgtggcctggctgcccccctcgccgcgctggcgcgcgctgcgcaaggtgatggccacggagctcttcgccccgcaccggctcgacgcgctgcgccacctccggagcgacaaggtgcgggacctcgtggaccacgtcgcgcggctggctctcgagggcgcgccggtgaacgtcggccgcgtggccttcacgacgagcctgaacctcctgtcccgcaccatcttctctgccgacctgacgagcctcgacgaccgcggccgctccgacgagttccagcagctggtgacggccatcatgcaggccgtggggagcccaaacgtgtcggacttcttcccgcttctcgcgccggctgacctgcagggcacgcgccggcggctggcgcggctgttggcgcgcctgcacgcggtgttcgacgccgaggtggaccagaggctgcacggccgcgacgccggcgagcccaagaagaacgacttcctcgacgtgctgctcgacgtggcggcgcgtgaggacggcaaggacctgctggaccgcccgacgctacgatcacttttcacggatttgttctctgctggtagtgacacaagctctacgacagtggaatgggcaatgacagagcttctccaaaacccatcatcaatgtccaacgcttgtaatgagcttgcagaagttattggcttcaaaagaaacattgatgaagatgatattgttcggctgccctacctccaagctgtcataaaagagacttttcgacttcaccctcccggcccactcttgttgccacgcaagcctgagagaactctggaaatagcaggctacataatacctgaagattcacgtgttttcataaacgtatgggcgataggccgagataaagatgtatggattgaacctgagaagtttatgccagagaggttcttgggttcaacaattgactttaggggtgctgattttgagctccttccatttggtgccggacgtcgaatatgccctggtatgccactggctattagaacagtgcatttgatcctcgcttcattgctaaatcagtttaagtggagtctccctgttgagcttgaaagggatgggattgatatggaagaaaagtttggcatatcactaacaaaggtcgtgcctctttgtattgtaccaacactggtttgaattcataaaataatatggacatggcaagactgctttatatgttttcaatctgtaataattcgaatgtaccaccaatgtaatttataccattatttatgtgataattaaataattattcgag

SEQ ID NO: 1317 - DNA, 772 bp, Secale cereale
ttatctccccacctaccgaaaataacgaccggtagcctagcatagcaggattgtcaatcaagttacgaaaccgacgcctatatatagagctgctggcagccttagccagccacaacactacaacaacagaaatcattctactccgcacaagtgaagcaagagcttttcacgaaaagttttatcagcaaccatgaagggcaccaagctggcggcgatcctgatcctccaggccgtcctggtcatgggagtcctctcacacgtgaacgccgactttttccccaagtgctgcaataactgcaggtccttctcgggcgtcgacgtctgcgacgacgcccatcccaagtgccccgccggctgctcggcctgccgcgtggtgaccacgaacccccaaacgtggcgctgcgccgatatgaaggccaccgttgacggcacctgcggcgggccctgcaaaaagtactgatcggttcgtgcacacatgatatgttccgcctaaaataaaataaaagctcagatgagatgagcagagtcgtgtgcgtgtgtgtggacaaagatatgtataccattgcatcgtgcctttgtcggtgtgttttctccctcgagaaaaaatatgtcgttgcttgttgttcagctacccatctgtaatgattgtgcgtgtctactcaataagatgaatatcagctgtattgtatttatactggcccatatggcatccgcaaagttggcatgtaagcagtatgtttagatgcttataattagtttaattgtagagtac

SEQ ID NO: 1318 - DNA, 612 bp, Secale cereale
cattctactccgcacaagtgaagcaagagctttgcacgaaaagtttcatcagcaaccatgaagggcaccaagctggcggcgatcctgatcctccaggccgtcctggtcatgggagtcctctcacacgtgaacgccgactttttccccaagtgctgcaacaactgcaggtccttctcgggcgtcgacgtctgcgacgacgcccatcccaagtgccccgccggctgctcggcctgccgcgtggtgaccacgaacccccaaacgtggcgctgcgccgatatgaaggccaccgtcgacggcacctgcggtgggccctgcaaaaagtactgatcggctcgtgcacacatgatatgttccgcctaaaataaaataaaagctcacatgagatgagcagagtcgtgtgcgtgtgtgtggacaaagatatgtataccattgcatcgtgcctttgtcggtgtgttttctccctcgagaaaaatatgtcgttgcttgttgttcagctacccatctgtaatgattgtgcgtgtctactcaataagatgaatatcagctgtattgtatttatactggccaataataggacaataccgacaaaagttaggacaattagtttaaagt

SEQ ID NO: 1319 - DNA, 573 bp, Secale cereale
actccgcacaagtgaagcaagagctttgcacgaaaagtttcatcagcaaccatgaagggcaccaagctggcggcgatcctgatcctccaggccgtcctggtcatgggagtcctctcacacgtgaacgccgactttttccccaagtgctgcaacaactgcaggtccttctcgggcgtcgacgtctgcgacgacgcccatcccaagtgccccgccggctgctcggcctgccgcgtggtgaccacgaacccccaaacgtggcgctgcgccgatatgaaggccaccgtcgacggcacctgcggtgggccctgcaaaaagtactgatcggctcgtgcacacatgatatgttccgcctaaaataaaataaaagctcacatgagatgagcagagtcgtgtgcgtgtgtgtggacaaagatatgtataccattgcatcgtgcctttgtcggtgtgttttctccctcgagaaaaatatgtcgttgcttgttgttcagctacccatctgtaatgattgtgcgtgtctactcaataagatgaatatcagctgtattgtatttatactggcccatatggcatccg

SEQ ID NO: 1320 - DNA, 784 bp, Secale cereale
gactaaacaaagaaaaataacaaattaactaaactaccgacaacaaagtagaaagacaagagcttttcacgaaaagttttatcagcaaccatgaagggcaccaagctggcggcgatcctgatcctccaggccgtcctggtcatgggagtcctctcacacgtgaacgccgactttttccccaagtgctgcaataactgcaggtccttctcgggcgtcgacgtctgcgacgacgcccatcccaagtgccccgccggctgctcggcctgccgcgtggtgaccacgaacccccaaacgtggcgctgcgccgatatgaaggccaccgttgacggcacctgcggcgggccctgcaaaaagtactgatcggttcgtgcacacatgatatgttccgcctaaaataaaataaaagctcagatgagatgagcagagtcgtgtgcgtgtgtgtggacaaagatatgtataccattgcatcgtgcctttgtcggtgtgttttctccctcgagaaaaaatatgtcgttgcttgttgttcagctacccatctgtaatgattgtgcgtgtctactcaataagatgaatatcagctgtattgtatttatactggcccatatggcatccgcaaagttggcatgttaagcagtatgttttagatgcttataattagtttaattaataaaacgaaaaaaaaaaaaaaaacggaaaaaaagggggggggcttaggatagtttaatcctactacatactagccttaccaatcgtgccaccagacatgtactcttaagtgcctctg

SEQ ID NO: 1321 - DNA, 535 bp, Secale cereale
gcacgaaaagtttcatcagcaaccatgaagggcaccaagctggcggcgatcctgatcctccaggccgtcctggtcatgggagtcctctcacacgtgaacgccgactttttccccaagtgctgcaacaactgcaggtccttctcgggcgtcgacgtctgcgacgacgcccatcccaagtgccccgccggctgctcggcctgccgcgtggtgaccacgaacccccaaacgtggcgctgcgccgatatgaaggccaccgtcgacggcacctgcggtgggccctgcaaaaagtactgatcggttcgtgcacatatgatatgttccgcctaaaataaaataaaagctcacatgagatgagcagagtcgtgtgcgtgtgtgtggacaaagatatgtataccattgcatcgtgcctttgtcggtgtgttttctccctcgagaaaaatatgtcgttgcttgttgttcagctacccatctgtaatgattgtgcgtgtctactcaataagatgaatatcagctgtattgtatttatactggccca

SEQ ID NO: 1322 - DNA, 695 bp, Secale cereale
ggtcgcgttgtcaatgcacagcgaccggtacgcctagcatagcaggattgttaatacaagttacgaaccgacgcctatatatagagctgctggcagccttagccagccacaacactacaacaacagaaatcattctactccgcacaagtgaagcaagagctttgcacgaaaagtttcatcagcaaccatgaagggcaccaagctggcggcgatcctgatcctccaggccgtcctggtcatgggagtcctctcacacgtgaacgccgactttttccccaagtgctgcaacaactgcaggtccttctcgggcgtcgacgtctgcgacgacgcccatcccaagtgccccgccggctgctcggcctgccgcgtggtgaccacgaacccccaaacgtggcgctgcgccgatatgaaggccaccgtcgacggcacctgcggtgggccctgcaaaaagtactgatcggctcgtgcacacatgatatgttccgcctaaaataaaataaaagctcacatgagatgagcagagtcgtgtgcgtgtgtgtggacaaagatatgtataccattgcatcgtgcctttgtcggtgtgttttctccctcgagaaaaatatgtcgttgcttgttgttcagctacccatctgtaatgattgtgcgtgtctactcaataagatgaatatcagctgtattgtatttatactggc

SEQ ID NO: 1323 - DNA, 706 bp, Secale cereale
tctttaatatgcaaagaaaacatgatgaaacaagaaaatccacctacatttatttctgattggtacaaactaaaaaagactcgactgagcgatcaacgctctcataagtagaaaaaacaacactacaacaacagaaatcattctactccgcacaagtgaagcaagagcttttcacgaaaagttttatcagcaaccatgaagggcaccaagctggcggcgatcctgatcctccaggccgtcctggtcatgggagtcctctcacacgtgaacgccgactttttccccaagtgctgcaataactgcaggtccttctcgggcgtcgacgtctgcgacgacgcccatcccaagtgccccgccggctgctcggcctgccgcgtggtgaccacgaacccccaaacgtggcgctgcgccgatatgaaggccaccgttgacggcacctgcggcgggccctgcaaaaagtactgatcggttcgtgcacacatgatatgttccgcctaaaataaaataaaagctcagatgagatgagcagagtcgtgtgcgtgtgtgtggacaaagatatgtataccattgcatcgtgcctttgtcggtgtgttttctccctcgagaaaaaatatgtcgttgcttgttgttcagctacccatctgtaatgattgtgcgtgtctactcaataagatgaatatcagctgtattgtatttatactggccc

SEQ ID NO: 1324 - DNA, 552 bp, Secale cereale
cattctactccgcacaagtgaagcaagagctttgcacgaaaagtttcatcagcaaccatgaagggcaccaagctggcggcgatcctgatcctccaggccgtcctggtcatgggagtcctctcacacgtgaacgccgacttttcccaacgtgctgcaacaactgcaggtcctctcggcgtcgacgtctgcgacgacgcccatcccaacgtgccccgccggctgctcggcctgccgcgtggtgaccacgaacccccaaacgtggcgctgcgccgatatgaaggccaccgtcgacggcacctgcggtgggccctgcaaaaagtactgatcggttcgtgcacatatgatatgttccgcctaaaataaaataaaagctcacatgagatgagcagagtcgtgtgcgtgtgtgtggacaaagatatgtataccattgcatcgtgcctttgtcggtgtgttttctccctcgagaaaaatatgtcgttgcttgttgttcagctacccatctgtaatgattgtgcgtgtctactcaataagatgaatatcagctgtattgta

SEQ ID NO: 1325 - DNA, 381 bp, Secale cereale
cattctactccgcacaagtgaagcaagagcttttcacgaaaagttttatcagcaaccatgaagggcaccaagctggcggcgatcctgatcctccaggccgtcctggtcatgggagtcctctcacacgtgaacgccgactttttccccaagtgctgcaataactgcaggtccttctcgggcgtcgacgtctgcgacgacgcccatcccaagtgccccgcggctgctcggcctgccgcgtggtgaccacgaacccccaaacgtggcgctgcgccgatatgaaggccaccgttgacggcacctgcggcgggccctgcaaaaagtctgatcggttcgtgcacacatgatatgttccgacctaaaataaataaaagctcagatgag

SEQ ID NO: 1326 - DNA, 496 bp, Secale cereale
gaagggcaccaagctggcggcgatcctgatcctccaggccgtcctggtcatgggagtcctctcacacgtgaacgccgtctttttccccaagtgctgcaataactgcaggtccttctcggcgtcgacgtctgcgacgacgcccatccccagtgcccgccggctgctcggcctgccgcgtggtgaccacgaacccccaaacgtggcgctgcgccgatatgaaggccaccgtcgacggcacctgcggtgggccctgcaaaaagtactgatcggttcgtgcacatatgatatgttccgcctaaaataaataaaaagctcacatgagatgagcagagtcgtgtgcgtgtgtgtggacaaagatatgtataccattgcatcgtgcctttgtcggtgtgttttctccctcgagaaaaatatgtcgttgcttgttgttcagctacccatctgtaatgattgtgcgtgtctactcaataagatgaatatcagctgtattgtattt

SEQ ID NO: 1327 - DNA, 624 bp, Festuca arundinacea
ggcacgaggacaacataaagcattccccagctaggcgggacaacagagagcttttgctcactcgaaaagcttagaagcaacgatgaagaacaccaagctcgtggcgatcctcgttctccaggccgtcctggtcatggggatcctctcacacgtgaacgccgactacttcccgccgtgctgcgacaattgcaggtccttctccggcgtcgacgtctgcgacgacgcccacccccagtgccccaccggctgctcggcgtgccgcgtggtgacgactaacccccagacgttccggtgcgccgacatgaagcccaccgtcgacggcacctgcgggggaccctgcaagaagtactgatcggtccaagctctggacgacgacatgaagatacatatactccgccaaaaataaagctcagatgatatgagcaaagtcatcgtattgtgcgtgccgacaatatgtcgtcgtcggcgttattgcttgcctattctctctcgagaaatgttgttgttgcttgcctatcagctgtgtgtgttgtgtcctcgcctccgtcaataaaacaatacctgttgtgatttgtgtatctctgcttaataacatgaataaacactacctgttgttatttgtgt

SEQ ID NO: 1328 - DNA, 684 bp, Pseudoroegneria spicata
  misc_feature (672)..(672): n is a, c, g, or t
caacaagagagcattctaccactagaccgcacaagtgaagtgagagctttgcacgagaagttcaccagcaaccatgaagaacaccaagctcgcggcgatcctgatcctccaggccgtcctggtcatgggagtcctctcccacgtgaacgccgacttcttccccaagtgctgcaacaactgcaggtccttctcgggggtcgacgtctgcgacgacgcccaccccaagtgccccaagggctgctcggcgtgccgcgtggtgaccacgaacccccaaacgtggcgctgcgccgatatgaagaacaccgtcgacggcacctgcggtgggccctgcaagaagtactgatcggttcatgcccacatgatatgttccgcctaaaatagaataaaagctcagatgagatgagcagagtcatcgtgcctatgcgtgtgtgtgtggccaacaatatgtcgtgtctttgtcgctgtgttttctctctcgagaaaaagttggtgcttgttgttcagctatccggaatatcctccgtgaataaacagctgtaatggttgtgcgtggctgccaataatatgagttctcttgtccacgcgttacatgtttcccgttgtatttatactccgatatgatcaccgttgttgacatgttaagcagtatatataatatatattagatgcttngtttattttatt

SEQ ID NO: 1329 - DNA, 566 bp, Secale cereale
gactcaacagaaatcattctactccgcacaagtgaagcaagagctttgcacgaaaagtttcatcagcaaccatgaagggcaccaagctggcggcgatcctgatcctccaggccgtcctggtcatgggagtcctctcacacgtgaacgtccgactttttccccaagtgctgcaacaactgcaggtccttctcgggctcgacgtctgcgacgacgcccatcccaagtgccccgccggctgctcggcctgccgcgtggtgaccacgacccccaaacgtggcgctgcgccgatatgaaggccaccgtcgacggcacctgcggtgggccctgcaaaaagtactgatcggctcgtgcacacatgatatgttccgcctaaaataaataaaaagctcagatgagatgagcagagtcgtgtgcgtgtgtgtggacaaagatatgtataccattgcatcgtgcctttgtcggtgtgttttctccctcgagaaaaatatgtcgttgcttgttgttcagctacccatctgtaatgattgtgcgtgtctactcaataagatgaatatcagctgtattgt

SEQ ID NO: 1330 - DNA, 568 bp, Secale cereale
ccactagaccgaccgcacaagtgaggtgagagctttgcgctaagggttcatcagcaaccatgaagagcaccaagctcgccgcgatcctgatcctccaggccgtcctggtcatggggatcctctcacacgtgaacgccgactatttccccaagtgctgcaacaactgcaggtccttctcgggggtcgacgtctgcgacgacgcccacccccagtgccccaagggctgctccgcctgccgcgtggtgacgccgagcccccacaagacgttccggtgcgctgacatgaagagcaccgtcgacggcacctgcggcgggccatgcaaaaagtactgatccgtccagggcttcaggctcagacgaggtgtgccgcctaaaataaagctcacatgagatgagcagtcatggtgcctatgcttgtgtgtgggtcgtgttatacagccaacaatatgtatactgctatcgtcgtgtcttcgtcaatgtgttttctctctcgagaaaggctggtggtgcttgtactagttcacctatcctccgtgaataaacacatgtgatgattgtgtgtgcctact

SEQ ID NO: 1331 - DNA, 606 bp, Secale cereale
aaggcattctaccactagaccgaccgcacaggtgaggtgagagctttgcgctaagggttcatcagcaaccatgaagagcaccaagctcgccgcgatcctgatcctccaggccgtcctggtcatggggatcctctcacacgtgaacgccgactatttccccaagtgctgcaacaactgcaggtccttctcgggggtcgacgtctgcgacgacgcccacccccagtgccccaagggctgctccgcctgccgcgtggtgacgccgagcccccacaagacgttccggtgcgctgacatgaagagcaccgtcgacggcacctgtggcgggccatgcaaaaagtactgatccgtccagggcttcaggctcagacgaggtgtgccgcctaaaataaagctcacatgagatgagcagtcatggtgcctatgcttgtgtgtgggtcgtgctatacggccaacagtatgtatactgctaccgtcgtgtcttggtcaatgtgttttctctctcgagaaaggctggtggtgcttgtacttgtccacctatcctccctgaataaacacatgtgataattgtgtgtgccaactctataacatgagaaccagttgtcctgt

SEQ ID NO: 1332 - DNA, 449 bp, Secale cereale
tcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgcaagaagtactgatcggctcatgccagcatgatatgttccgcctaaaatgaaataaaagctcagacgagatgagcagcgtcatcgtgcctatgcgtgtgtgtgtggccaacaaatatgtataccagtatgccgtgtcttcgtcgctgtgttttctctctcgagtaaaagttggtgttgctttg

SEQ ID NO: 1333 - DNA, 552 bp, Triticum aestivum
ccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgcaagaagtactgatcggctcatgccagcatgatatgttccgcctaaaatgaaataaaagctcagacgagatgagcagcgtcatcgtgcctatgcgtgtgtgtgtggccaacaaatatgtataccagtatgccgtgtcttcgtcgctgtgttttctctctcgagaaaaagttggtgttgcttgttgttcagatatccggaatatcctccgtgaataagtaatgattgtgcgttggtggcaataa

SEQ ID NO: 1334 - DNA, 622 bp, Setaria italica
accacaacaacacagagcattctaccaccgcaccgcacgagtgaagtgagagctttgcacgaaaagttcatcagcaaccatgaagggcaccaagctcgcggcgatcctgatcctccaggccgtcctggtcatgggagtcctctcacacgtgaacgccgactatttccccaagtgctgcaacaactgcaggtccttctcgggggtcgacgtctgcgacgacgcccaccccaagtgtcccaagggctgctcggcgtgccgcgtggtgtcgacgagccccgaaatgtggcgctgcgcggatatgaaatccaccgtcgacggcacctgcggtggaccctgcaagaagtactgatcggttcatgccggcatgatatgttccgcctaaaatgaaataaaagctcagacgagatgagcagcgtcatcgtgcctatgcgtgtgtgtgtggccaacaaatatgtataccagtatgccgtgtcttcgtcgctgtgttttctctctcgagaaaaagttggtgttgcttgttgttcagatatccggaatatcctccgtgaataagtaatgattgtgcgttggtggcaataatgtgagttctcttgtccacgcgttacatgtttcagatcggaag

SEQ ID NO: 1335 - DNA, 580 bp, Leymus cinereus x Leymus triticoides
  misc_feature (422)..(422): n is a, c, g, or t
  misc_feature (425)..(425): n is a, c, g, or t
gcacgaggggaccgcacgagtgaagtgagagctttgcacgaaaagttgatcagcaaccatgaagagcaccaagctcgcggcgatcctgatcctccaggccgtcctggtcatgggaatcctctcgcacgtgaacgccgacttcttccccaagtgctgcaacaagtgcaggtccttctcgggggtcgacgtctgcgacgacgcccaccccaagtgccccaagggctgctcggcctgccgcgtggtgacgacgaacccccaaacgtggcgctgcgccgatatgaagaacaccgtcgacggcacctgcggtgggccctgcaagaagtactgatcggttcaggctcacatgatatgttccgcctaaaataaaataaaagctcagacgagatgagcagcgtcatcgtgcctatgcgtgtgtgtgtggncancaatatgtataccagtacatgtcgtgtctttgtcgctgtgttttctctctcgagaaaaagttggtgttgcttgttgttcagctatccgaaatatcctccgtgaataaacagctgtaatgattgtgcgtgcctgccaataatgagttctcttgtcc

SEQ ID NO: 1336 - DNA, 669 bp, Triticum aestivum
gaattcactagtgattaacgtggtcgcgggcgaggtacaacaaaagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgcaagaagtactgatcggctcatgccagcatgatatgttccgcctaaaatgaaataaaagctcagacgagatgagcagcgtcatcgtgcctatgcgtgtgtgtgtggccaacaaatatgtataccagtatgccgtgtcttcgtcgctgtgttttctctctcgagaaaaagttggtgttgcttgttgttcagatatccggaatatcctccgtgaataagtaatgattgtgcgttggtggcaataatgtgagttctcttgtccacgcgttacatgtttcccgttgtatttatatcctctccgata

SEQ ID NO: 1337 - DNA, 687 bp, Triticum aestivum
aacagagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgcaagaagtactgatcggctcatgccagcatgatatgttccgcctaaaatgaaataaaagctcagacgagatgagcagcgtcatcgtgcctatgcgtgtgtgtgtggccaacaaatatgtataccagtatgccgtgtcttcgtcgctgtgttttctctctcgagaaaaagttggtgttgcttgttgttcagatatccggaatatcctccgtgaataagtaatgattgtgcgttggtggcaataatgtgagttctcttgtccacgcgttacatgtttcccgttgtatttatatcctctccgatatgatatccattgttcacatgttaagcagtatgttagatgctttgcttattttcccct

SEQ ID NO: 1338 - DNA, 543 bp, Triticum aestivum
caacagagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgcaagaagtactgatcggctcatgccagcatgatatgttccgcctaaaatgaaataaaagctcagacgagatgagcagcgtcatcgtgcctatgcgtgtgtgtgtgggcaacaaatatgtatacaagtatgccgtgtcttcgtcgctgtgttttctctctcgaagaaaaattggtgttgcttgttgttcaaatatccggatacctccgtgaataa

SEQ ID NO: 1339 - DNA, 567 bp, Triticum aestivum
caacagagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgcaagaagtactgatcggctcatgccagcatgatatgttccgcctaaaatgaaataaaagctcagacgagatgagcagcgtcatcgtgcctatgcgtgtgtgtgtggccaacaaatatgtataccagtatgccgtgtcttcgtcgctgtgttttctctctcgaaaaaaaattggtgttgcttgttgttcaaatatccggaatatcctccgtgaataagtaatgattgtgcgttggtggc

SEQ ID NO: 1340 - DNA, 540 bp, Triticum aestivum
aacaacagagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgcaagaagtactgatcggctcatgccagcatgatatttccgcctaaaatgaaataaaagtcaagacgagatgagcagcgtcatcgtgcctatcgtgtgtgtgtggcaacaaatatgtatacaatatccgtgtctcgtcgctgtgtttctctctcgagaaaaattggtgttgcttgttgtcaaatatccggaatactccgtgaataagtaa

SEQ ID NO: 1341 - DNA, 968 bp, Triticum aestivum
gcgacgaaatgcttcggggagttgaaaataagcatagatccggagattcccaaataggtcaaccttttaaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctagatggctaaagtccagtagccgaaagcatcactagcttacgctctgacccgacaacagagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgcaagaagtactgatcggctcatgccagcatgatatgttccgcctaaaatgaaataaaagctcagacgagatgagcagcgtcatcgtgcctatgcgtgtgtgtgtggccaacaaatatgtataccagtatgccgtgtcttcgtcgctgtgttttctctctcgagaaaaagttggtgttgcttgttgttcagatatccggaatatcctccgtgaataagtaatgattgtgcgttggtggcaataatgtgagttctcttgtccacgcgttacatgtttcccgttgtatttatatcctctccgatatgatatccattgttca

SEQ ID NO: 1342 - DNA, 535 bp, Secale cereale
gtgagagcttagcgctaagggttcatcagcaaccatgaagagcaccaagctcgcagcgatcctgatcctccaggccgtcctggtcatggggatcctctcacacgtgaacgccgacttcttccccaagtgctgcaacaactgcaggtccttttcgggggtcgacgtctgcgacgacgcccacccccagtgccccaagggctgctccgcctgccgcgtggtgacgccgagcccccacaagacgttccggtgcgctgacatgaagagcaccgtcgacggcacctgcggcgggccatgcaaaaagtactgatccgtccagggcttcaggctcagacgaggtgtgccgcctaaaataaagctcacatgagatgagcagtcatggtgcctatgcttgtgtgtgggtcgtgttatacagccaacaatatgtatactgctatcgtcgtgtcttggtcaatgtgttttctctctcgagaaaggctggtggtgcttgtactagttcacctatcctccgtgaataatcacatgtgatgattgtgtg

SEQ ID NO: 1343 - DNA, 672 bp, Secale cereale
gcagaaggcattctaccactagaccgaccgcacaggtgaagtgagagcttagcgctaagggttcatcagcaaccatgaagagcaccaagctcgcagcgatcctgatcctccaggccgtcctggtcatggggatcctctcacacgtgaacgccgacttcttccccaagtgctgcaacaactgcaggtccttttcgggggtcgacgtctgcgacgacgcccacccccagtgccccaagggctgctccgcctgccgcgtggtgacgccgagcccccacaagacgttccggtgcgctgacatgaagagcaccgtcgacggcacctgcggcgggccatgcaaaaagtactgatccgtccagggcttcaggctcagacgaggtgtgccgcctaaaataaagctcacatgagatgagcagtcatggtgcctatgcttgtgtgtgggtcgtgttatacagccaacaatatgtatactgctatcgtcgtgtcttggtcaatgtgttttctctctcgagaaaggctggtggtgcttgtactagttcacctatcctccgtgaataatcacatgtgatgattgtgtgtgcctactcaataacatgagaaccagttgtcttgtccaatattgcatttatacatgactactagtatgctatcccctttctgacgactgcctaaggc

SEQ ID NO: 1344 - DNA, 603 bp, Secale cereale
tctaccactagaccgaccgcacaggtgaagtgagagcttagcgctaagggttcatcagcaaccatgaagagcaccaagctcgcagcgatcctgatcctccaggccgtcctggtcatggggatcctctcacacgtgaacgccgacttcttccccaagtgctgcaacaactgcaggtccttctcgggggtcgacgtctgcgacgacgcccacccccagtgccccaagggctgctcggcctgccgcgtggtgacgccgagccctcacaagacgttccgttgcgccgacatgaagagcactgtcgacggcacctgtggcgggccatgcaaaaagtactgatccgtccagggcttcaggctcagacgaggtgtgccgcctaaaataaagctcacatgagatgagcagtcatggtgcctatgcttgtgtgtgggtcgtgctatacggccaacagtatgtatactgctaccgtcgtgtcttggtcaatgtgttttctctctcgagaaaggctggtggtgcttgtacttgtccacctatcctccctgaataaacacatgtgaattaaatttagttagttagttagtacctaaaacttaacttaaaaaaaaa

SEQ ID NO: 1345 - DNA, 612 bp, Secale cereale
ggggcggctacaacagcagaaggcattctaccactagaccgaccgcacaggtgaagtgagagcttagcgctaagggttcatcagcaaccatgaagagcaccaagctcgcagcgatcctgatcctccaggccgtcctggtcatggggatcctctcacacgtgaacgccgacttcttccccaagtgctgcaacaactgcaggtccttctcgggggtcgacgtctgcgacgacgcccacccccagtgccccaagggctgctcggcctgccgcgtggtgacgccgagccctcacaagacgttccgttgcgccgacatgaagagcactgtcgacggcacctgtggcgggccatgcaaaaagtactgatccgtccagggcttcaggctcagacgaggtgtgccgcctaaaataaagctcacatgagatgagcagtcatggtgcctatgcttgtgtgtgggtcgtgctatacggccaacagtatgtatactgctaccgtcgtgtcttggtcaatgtgttttctctctcgagaaaggctggtggtgcttgtacttgtccacctatcctccctgaataaacacatgtgataattgtgtgtgccagctctataacatgagaa

SEQ ID NO: 1346 - DNA, 602 bp, Secale cereale
gcattctaccactagaccgaccgcacaggtgaagtgagagcttagccctaggggttcatcagcaaccatgaagagcaccaagctcgcagcgatcctgatcctccaggccgtcctggtcatggggatcctctcacacgtgaacgccgacttcttccccaagtgctgcaacaactgcaggtccttctcgggggtcgacgtctgcgacgacgcccacccccagtgccccaagggctgctcggcctgccgcgtggtgacgccgagccctcacaagacgttccgttgcgccgacatgaagagcactgtcgacggcacctgtggcgggccatgcaaaaagtactgatccgtccagggcttcaggctcagacgaggtgtgccgcctaaaataaagctcacatgagatgagcagtcatggtgcctatgcttgtgtgtgggtcgtgctatacggccaacagtatgtatactgctaccgtcgtgtcttggtcaatgtgttttctctctcgagaaaggctggtggtgcttgtacttgtccacctatcctccctgaataaacaacaatagtagaataaattaagttaagttaagttaagtaacctaaaaaatta

SEQ ID NO: 1347 - DNA, 787 bp, Triticum aestivum
tcaagggattaagttgggaaccccaaggtttcccaggcacgaccgtttaaacgacggcaagtgattgtatttccgccacctcatagcgatgggcccgaactcgcatgctcccgcccgcaatggcccgggatagcgtggtccccgccgaggtaaagcattctaccactagaccgaccgcaccaggtgaagtgggagctttgcgctaagggctcattagcaaccatgaagagcaccaagctcgcggcgatcctgatcctccaggccgtcctggtcatggggatcctctcacacgtgaacgccgactatttccccaagtgctgcaacaattgcaggtccttctcgggggtcgacgtctgcgacgacgcccacccccagtgccccaagggctgctcggcctgccgcgtggtgacgcccagccctcacaagacgttccggtgcgccgacatgaagagcaccgtcgacggcacctgcggcgggccatgcaaaaagcactgatccgttcagggcttcaggctcagacgaggtgtgccgcctaaaataaagctcagatgagatgagcagtcatggtgcctatgcttgtgtgtgggtcgtgctatacggccaacagtatgtataatgctatcgtcgtgtcttggtcaatgtgttttctctctcgagaaaggctggtggtgctagtacttgttcacctacctccgtgaataaacacatgtgatgattgtgtgtgcctactcaataacatgagaaccagttctcttgtcgaatattgcatttatactctccgatatgc

SEQ ID NO: 1348 - DNA, 615 bp, Triticum aestivum
tctaccaccagaccgaccgcacagttgaagtgagatctgcgctaagggttcatcagcaaccatgaagagcaccaagctcgcggcgatcctgatcctccaggccgtcctggtcatggggatcctctcacacgtgaacgccgactatttccccaagtgctgcaacaactgcaggtccttctcgggggtcgacgtctgcgacgacgcccacccccagtgccccaagggctgctcggcctgccgcgtggtgacgccgagccctcacaagacgttccggtgcgccgacatgaagagcaccgtcgatggcacctgcggcgggccatgcaagaagcactgatccgttcagggcttcaggctcagacgaggtgtgccgcctaaaataaagctcagatgagatgagcagtcatggtgcctatgcttgtgtgtgggtcgtgctatacggccaacaatatgtatactgctatcgtcgtgtcttggtcaatgtgttttctctctcgagaaaggctggtggtgcttgtacttgttcacctattctccgtcaataaacacatgtgatgattgtacttgttcacctatccgccgtgaataaacacatgtgatgattgtgcttgtactcta

SEQ ID NO: 1349 - DNA, 631 bp, Secale cereale
  misc_feature (572)..(572): n is a, c, g, or t
ccacgcgtccgcaacagcagaaggcattctaccactagaccgaccgcacaggtgaagtgagagcttagcgctaagggttcatcagcaaccatgaagagcaccaagctcgcagcgatcctgatcctccaggccgtcctggtcatggggatcctctcacacgtgaacgccgacttcttccccaagtgctgcaacaactgcaggtccttttcgggggtcgacgtctgcgacgacgcccacccccagtgccccaagggctgctccgcctgccgcgtggtgacgccgagcccccacaagacgttccggtgcgctgacatgaagagcaccgtcgacggcacctgcggcgggccatgcaaaaagtactgatccgtccagggcttcaggctcagacgaggtgtgccgcctaaaataaagctcacatgagatgagcagtcatggtgcctatgcttgtgtgtgggtcgtgttatacagccaacaatatgtatactgctatcgtcgtgtcttggtcaatgtgttttctctctcgagaaaggctggtggtgcttgtactagttcacctatcctccgtgaataancacatgtgatgattgtgtgtgcctactcaataacatgagaaccagttgtcttgtccaaa

SEQ ID NO: 1350 - DNA, 634 bp, Triticum aestivum
cattctaccaccagaccgaccgcacagttgaagtgagatctgcgctaagggttcatcagcaaccatgaagagcaccaagctcgcggcgatcctgatcctccaggccgtcctggtcatggggatcctctcacacgtgaacgccgactatttccccaagtgctgcaacaactgcaggtccttctcgggggtcgacgtctgcgacgacgcccacccccagtgccccaagggctgctcggcctgccgcgtggtgacgccgagccctcacaagacgttccggtgcgccgacatgaagagcaccgtcgatggcacctgcggcgggccatgcaagaagcactgatccgttcagggcttcaggctcagacgaggtgtgccgcctaaaataaagctcagatgagatgagcagtcatggtgcctatgcttgtgtgtgggtcgtgctatacggccaacaatatgtatactgctatcgtcgtgtcttggtcaatgtgttttctctctcgagaaaggctggtggtgcttgtacttgttcacctattctccgtcaataaacacatgtgatgattgtgtgtgcctactcaataacatgagaaccagttctcttgtcgaaaaaaaaaaaaacctcggccgcgaccacgct

SEQ ID NO: 1351 - DNA, 655 bp, Secale cereale
tcaggcagaaggcattctaccactagaccgaccgcacaggtgaagtgagagcttagcgctaagggttcatcagcaaccatgaagagcaccaagctcgcagcgatcctgatcctccaggccgtcctggtcatggggatcctctcacacgtgaacgccgacttcttccccaagtgctgcaacaactgcaggtccttttcgggggtcgacgtctgcgacgacgcccacccccatgtgccccaagggctgctccgcctgccgcgtggtgacgccgagccccccacaagacgttccggtgcgctgacatgaagagcaccgtcgacggcacctgcggcgggccatgcaaaaagtactgatccgtccagggcttcaggctcagacgaggtgtgccgcctaaaataaagctcacatgagatgagcagtcatggtgcctatgcttgtgtgtgggtcgtgttatacagccaacaatatgtatactgctatcgtcgtgtcttcgtcaatgtgttttctctctcgagaaaggctggtggtgcttgtactagttcacctatcctccgtgaataatcacatgtgatgattgtgtgtgcctactcaataacatgagaaccagttgtcttgtccaatattgcatttatacatgcactagtatgcatcccca

SEQ ID NO: 1352 - DNA, 512 bp, Secale cereale
gactacaacagtcagaaggcattctaccactagaccgaccgcacaggtgaggtgagagctttgcgctaagggttcatcagcaaccatgaagagcaccaagctcgccgcgatcctgatcctccaggccgtcctggtcatggggaatcctctcacacgtgaacgccgactatttccccaagtgctgcaacaactgcaggtccttctcgggggtcgacgtctgcgacgacgcccacccccagtgccccaagggctgctccgcctgccgcgtggtgacgccgagcccccacaagacgttccggtgcgctgacatgaagagcaccgtcgacggcacctgtggcgggccatgcaaaaaggtctgatccgtccagggcttcaggctcagacgaggtgtgccgcctaaaataaagctcacatgagatgagcagtcatggtgcctatgcttgtgtgtgggtcgtgctatacggccaacagtatgtatactgccaccgtcgtgtcttggtcaatgtgttttc

SEQ ID NO: 1353 - DNA, 545 bp, Secale cereale
ttcatcagcaaccatgaagagcaccaagctcgcagcgatcctgatcctccaggccgtcctggtcatggggatcctctcacacgtgaacgccgacttcttcccaagtgctgcaacaactgcaggtccttctcgggggtcgacgtctgcgacgacgcccacccccagtgccccaagggctgctcggcctgccgcgtggtgacgccgagccctcacaagacgttccgttgcgccgacatgaagagcactgtcgacggcacctgtggcgggccatgcaaaaagtactgatccgtccagggcttcaggctcagacgaggtgtgccgcctaaaataaagctcacatgagatgagcagtcatggtgcctatgcttgtgtgtgggtcgtgctatacggccaacagtatgtatactgctaccgtcgtgtcttggtcaatgtgttttctctctcgagaaaggctggtggtgcttgtacttgtccacctatcctccctgaataaacacatgtgataattgtgtgtgccagctctataacatgagaaccagttgtcc

SEQ ID NO: 1354 - DNA, 642 bp, Secale cereale
ccctagtgtctagtacaataacactatccccttctgcccccctccaatctgtcgacaaaacaacattctaccaccagaccgcacgaatgaagtgagagctttgcacgaaaagttcataatcaaacatgaagagcaccaaggtcgcggcgatcctgatcctccaggccgtcctggtcatgggaatcctctcgcacgtgaatgccgacttcttccccaagtgctgcaacaactgcaggtccttctcgggggtcgacgtctgcgacgacgcccatcccaagtgccccacgggctgctcggcgtgccgcgtggtgacgacgaaccccgaaatgtggcgctgcgcggatatgaaatccaccgtcgacggcacctgcggtgggccctgcaagaagtactgatcggttcatgccagcaggatatgttccgcctaaaataaaataaaagctcaggcgagatgagcagcgtcatcgtgcctatgcgtgtgtgtgtggccaacaatatgtataccagtatgtcgtgtcatcgtcgctgtgttttctctctcgagaaaaaagttggtgttgcttgttgttcagctatccgggatatcgtccgtgaataaacacctgtaatgattgtgcatggctgccaataatatgagttctc

SEQ ID NO: 1355 - DNA, 563 bp, Secale cereale
tcaggcacgagtgaagtgagagctttgcacgaaaagttcataatcaaacatgaagagcaccaaggtcgcggcgatcctgatcctccaggccgtcctggtcatgggaatcctctcgcacgtgaatgccgacttcttccccaagtgctgcaacaactgcaggtccttctcgggggtcgacgtctgcgacgacgcccatcccaagtgccccacgggctgctcggcgtgccgcgtggtgacgacgaaccccgaaatgtggcgctgcgcggatatgaaatccaccgtcgacggcacctgcggtgggccctgcaagaagtactgatcggttcatgccagcaggatatgttccgcctaaaataaaataaaagctcaggcgagatgagcagcgtcatcgtgcctatgcgtgtgtgtgtggccaacaatatgtataccagtatgtcgtgtcatcgtcgctgtgttttctctctcgagaaaaaagttggtgttgcttgttgttcagctatccgggatatcgtccgtgaataaacacctgtaatgattgtgcatggctgccaataatatgagtt

SEQ ID NO: 1356 - DNA, 555 bp, Triticum aestivum
cctccacacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgtgacgacgcccaccccaagtgtcccaagggctgctcggcgtgccgcgtggtgtcgacgagccccgaaatgtggcgctgcgcggatatgaaatccaccgtcgacggcacctgcggtggaccctgcaagaagtactgatcggttcatgccggcatatgatatgttccgcctaaaattaaataaaagctcggacgagatgagcagcgtcatcgtgcctatgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacc

SEQ ID NO: 1357 - DNA, 699 bp, Triticum aestivum
tataggagctggccatgtttgaagtcattacccttaaccgtacctcgtgccgaattcggcacgagagcattctactcctccacacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtcgacgagccccgaaatgtggcgctgcgcggatatgaaatccaccgtcgacggcacctgcggtggaccctgcaagaagtactgatcggttcatgccggcatatgatatgttccgcctaaaattaaataaaagctcggacgagatgagcagcgtcatcgtgcctatgcgtgtgtgtgtgaccaacaaatatgtataccagtatgtcgtgtcttcgtcgctgtgttttctctctcgagaaaaagttggtgttgcttgttgttcagctatccggaatatcctccgtgaataaacacctgtagtgattgtgcgtggctgccaataatgtgagttctcttgtccacgcagttacatgtttcccgttgtatttatatactctccgatatgata

SEQ ID NO: 1358 - DNA, 810 bp, Triticum aestivum
aagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtcgacgagccccgaaatgtggcgctgcgcggatatgaaatccaccgtcgacggcacctgcggtggaccctgcaagaagtactgatcggttcatgccggcatatgatatgttccgcctaaggccccgcttggatcgtcggtttgctcctaaatacacttgtaaccaaaacagacctcgagccgtcgttttcaatctaggcggaaataacactgcgaccggtaaaatacacttgtagattaaatccgggtgtataagtttacaccgaatccaagcggggcctaaaattaaataaaagctcggacgagatgagcagcgtcatcgtgcctatgcgtgtgtgtgtgaccaacaaatatgtataccagtatgtcgtgtcttcgtcgctgtgttttctctctcgagaaaaagttggtgttgcttgttgttcagctatccggaatatcctccgtgaataaacacctgtagtgattgtgcgtggctgccaataatgtgagttctcttgtccacgcagttacatgtttcccgttgtatttatatactctccgatatgataaaaaaaaaaaacacctgcccgggcggccgctcg

SEQ ID NO: 1359 - DNA, 750 bp, Triticum aestivum
ttctactcctccacacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtcgacgagccccgaaatgtggcgctgcgcggatatgaaatccaccgtcgacggcacctgcggtggaccctgcaagaagtactgatcggttcatgccggcatatgatatgttccgcctaaggccccgcttggatcgtcggtttgctcctaaatacacttgtaaccaaaacagacctcgagccgtcgttttcaatctaggcggaaataacactgcgaccggtaaaatacacttgtagattaaatccgggtgtataagtttacaccgaatccaagcggggcctaaaattaaataaaagctcggacgagatgagcagcgtcatcgtgcctatgcgtgtgtgtgtgaccaacaaatatgtataccagtatgtcgtgtcttcgtcgctgtgttttctctctcgagaaaaagttggtgttgcttgttgttcagctatccggaatatcctccgtgaataaacacctgtagtgattgtgcgtggctgccaataatgtgagttctcttgtccacgca

SEQ ID NO: 1360 - DNA, 656 bp, Triticum aestivum
ctcctccacacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtcgacgagccccgaaatgtggcgctgcgcggatatgaaatccaccgtcgacggcacctgcggtggaccctgcaagaagtactgatcggtcatgccggcatatgatatgttccgcctaaaataaataaaactcggacgagatgagcagcgtcatcgtgcctatgcgtgtgtgtgtgaccaacaaatatgtatacccagtatgtcgtgtcttcgtcgctgtgttttctctctcgagaaaaagttggtgttgcttgttgttcagctatccggaatatcctccgtgaataaacacctgtagtgattgtgcgtggctgccaataatgtgagttctcttgtccacgcagttacatgtttcccgttgtatttatatactccccgatctgataaaaaaaaaaaacacctgcccgggcggccgctcg

SEQ ID NO: 1361 - DNA, 515 bp, Triticum aestivum
gtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtcgacgagccccgaaatgtggcgctgcgcggatatgaaatccaccgtcgacggcacctgcggtggaccctgcaagaagtactgatcggttcatgccggcatatgatatgttccgcctaaaattaaataaaactccggacgagatgagcaacgtcatcgtgcctatgcgtgtgtgtgtgaccaacaaatatgtatacagtagtcgtgtcttcgtcgctgtgttctctctcccagaaaaattgggttgcctgttgttcactatccgggatatcccccgtgaataaacacctg

SEQ ID NO: 1362 - DNA, 528 bp, Triticum aestivum
caacagagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgccggatatgaaatccaccgtccgacggcacctgcggtgggccctgcaagaattactgatcggtcaatgccaacatgatatttccgcctaaaatgaaataaaactcaagacgagatgacagcgtcatcgtgcctatgcgtgtgtgtgtgggcaacaaatattatacaagtatgcgtgtctcctcgcgtttttctctccccagaaactggcgttctgttgttcagatatccggatactccgtga

SEQ ID NO: 1363 - DNA, 2963 bp, Triticum aestivum
aaataaaataagctaagcatctagtaagatactgcttaacacgccaacaaatatcatatcggagagtatataaatacaacgggaaacatgtaactgcgtggacaagagaactcacattattggcagccacgcacaatcactacaggtgtttattcacggaggatattccggatagctgaacaacaagcaacaccaactttttctcgagagagaaaacacagcgacgaagacacgacatactggtatacatatttgttggtcacacacacacgcataggcacgatgacgctgctcatctcgtccgagcttttatttaattttaggcggaacatatcatatgccggcatgaaccgatcagtacttcttgcagggtccaccgcaggtgccgtcgacggtggatttcatatccgcgcagcgccacatttcggggctcgtcgacaccacgcggcacgccgagcagcccttgggacacttggggtgggcgtcgtcgcagacgtcgacccccgagaaggacctgcagttgttgcagcacttggggaagaagtcggcgttgacgtgcgagaggactcccatgaccaggacggcctggaggatcaggatcgccgcgagcttggtgcccttcatagttgctgatgaactttcagcgcaaagctctcacttcacttgtgtggaggagtagaatgcgcctccttccctccgcccacagcatattcctccaaatctcgccaccaccccaccaacgccacctcaccggcgcatcgcatcgcatcgcatggcggctgcggcggtggcctccaacgggggcgcggcgcccgtgcccgggcgcctcgcgtccgtctacagcgaggtgcagacgagccgcatcgcgcacgcgctgcccctcccctccgtcctccgctcccacttcaccctcgccgacgggcccgccagcaccgccgccggaagccccgatgagatcgccaagctgttcccctgcctgtacggccagccgtcggccgccgtggtgccgtccgccgagccggtcgagacgaagccgctcaagatcggcgtcgtgctctccggtggccaggcgccaggcgggcacaatgtgatctgcggcatctttgattacctgcaggagcgtgccaaaggcagcaccatgtatggattcaagggaggcccagctggtgtcatgaagggcaagtacgtcgagctgactactgatttcgtgtacccctacagaaaccagggcggatttgatatgatctgcagtggaagggacaagattgaaacaccagagcagttccagcaagctgaagacacagtcaacagacttgatttggatggacttgttgtcatcggtggtgatgattcaaacactaacgcatgcctcctcggtgaatacttcaggggaaggaacttgaagactcgcgttattggttgcccaaagactattgatggagatctgaaatgcaaggaggtcccaacaagctttggatttgacactgcttgcaagatatactccgaaatgattggcaatgtcatgactgatgcacggtcaacaggcaaatactaccactttgtgaggcttatgggtcgtgctgcttctcacattacactagagtgtgctctacagacacaccctaatgttgcactcatcggtgaagaggttgctgagaagaaggaaacactcaagaatgtcacagactacattaccgatgttgtttgcaaacgtgcagaacttggttacaactatggagttgtcctaataccggaaggcctgattgatttcatcccagagattcaaaaactcattgcagaattgaatgaaattttggcacatgatgttgttgacgaggcaggggcttggaaaagcaagcttgaaccagcatctagggagttgtttgacttcttgcccaaaaccattcaggagcagcttttgcttgaaagagatccccatggcaatgttcaggttgcaaaaattgaaactgagaaaatgcttattgccatggttgaaactgaattggagaagagaagagcggcggggaagtactctgcacatttcagaggccagtctcacttcttcggatatgaaggaagatgcggcctccctaccaattttgattccagctattgctatgcattaggctatggtgctggtgctcttctccaatttggcaagacaggacttatttcgtcggttggtaacctggctgctcctgtggaagaatggactgttggaggaactgcactgactgcgttgatggatgttgagagaaggcatggcaagaacaagccagtgatcaagaaggctatggtggaacttgatgctgcgccatttaagaagtttgcctcgctgcgagatgaatgggccagcaagaaccgatacatcagccctggtcccatccagttcagcggccctggaagcgatgcgtcgaaccacaccttgatgttggagcttggcgctgagatatagaggcggcggtgtagagtgtatttctttcaaattttctacttcttccttgcagttttgagagtggagaacaaactcccatagcggagcggcagtctccgcattgtggaatgtttaataagaggttgagttggagtgggttcagtggatgtcgtaataactaattttagcttttctatgacccgattgctccccatatatcaaacccccacctacccctgaagtttttttttcctataactgtctgaaccataggctattgaagttgcggctatcattagcgatttgacttttgagtaattttcgttttacatgtgcttgagctgaaagatgacttgcctatctgtaagctgagcatgtctaaaatacccataaattctcaaaatgtgtttattgttgatggattaattggtttttggtatgtttcgtctagttcaaagccactatgcaaaatgcaaaacacctcacctagtttcattgctttttagtgcatctctaaccgatcaccaag

SEQ ID NO: 1364 - DNA, 548 bp, Hordeum vulgare
cctcgtgccgaattcggcacgaggaaagcattctaccactagaccgcacaggtaaagctcgagctttgcgctaagagagttcatcggcagccatgaagagcaccaagctcgcggcgatcctgatcctccaggccgtcctggtcatggggatcctctcccacgttaacgccgacttcttccccaagtgctgcaacaactgcaggtccttctcgggggtcgacgtctgcgacgacgcccacccccagtgccccaagggctgctccgcctgccgcgtggtgaccccgagccctcacaagacgttccgctgcgccgacatgaagagcaccgtcgacggcacctgcggtggcccatgcaaaaagcactgatcgcttcagggcttcaggctcggacgaggtgtgccgcctagaataaagctcagatgagatgagcagtcatcgtgttgctatgtttgtgtgtgggccgtgctatacggccaacaatatgtacgctgtttatcgtcactgtgttttctccctcgagaaaaagctggtgttgcttgtcaataaaca

SEQ ID NO: 1365 - DNA, 600 bp, Triticum aestivum
ccacgcgtccgcccacgcgtccgacagagcattctaccactagaccgaccgcacaggtgaagtgagagctttgcgctaaagggttcatcagcaagcatgaagagcaccaagctcgcggcgatcctgatcctccaggccgtcctggtcatggggatcctctcacacgtgaacgccgacttcttccccaagtgctgcaacaactgcaggtccttctccggggtcgacgtctgcgacgacgcccacccccagtgccccaagggctgctcggcctgccgcgtggtgacgcccagccctcacaagacgttccggtgcgccgacatgaagagcaccgtcgatggcacctgcggcgggccatgcaaaaagcactgatccgttcagggcttcagacgaggggtgccgcctaaaataaagctcagatgagatgagcagtcatggcgcctatgcttctctgtgggtcgtgctatacggccaacaatatgtatactgctatcgtcgtgtcttgtcaatgtgtttcctctctcgagaaaggtggtggtgcttgtacttgtgttcacctatcctccgtgaataaacacatgtgatgattgtgtgtgcctactc

SEQ ID NO: 1366 - DNA, 636 bp, Triticum aestivum
ggcagaaagcattctaccactagaccgaccgcaccaggtgaagtgggagctttgcgctaagggctcattagcaaccatgaagagcaccaagctcgcggcgatcctgatcctccaggccgtcctggtcatggggatcctctcacacgtgaacgccgactatttccccaagtgctgcaacagttgcaggtccttctcgggggtcgacgtctgcgacgacgcccacccccagtgccccaagggctgctcggcctgccgcgtggtgacgcccagccctcacaagacgttccggtgcgccgacatgaagagcaccgtcgacggcacctgcggcgggccatgcaaaaagcactgatccgttcagggcttcaggctcagacgaggtgtgccgcctaaaataaagctcagatgagatgagcagtcatggtgcctatgcttgtgtgtgggtcgtgctatacggccaacagtatgtataatgctatcgtcgtgtcttggtcaatgtgttttctctctcgaagaaaggctggtggtgctaatacttgttcacctacctccgtgaataaacacatgtgatgattgtgtgtgcctactcaataaaaaactcgggcgcgacacgctaatcgaattccgcggccgcaatgg

SEQ ID NO: 1367 - DNA, 692 bp, Hordeum vulgare
ccacgcgtccgccatcacaaagcattctaccactagaccgcacaggtaaagctcgagctttgcgctaagagagttcatccgcagccatgaagggcaccaagctggcggcgatcctcatcctccaggccgtcctggtcatggggatcctctcccacgtgaacgccgacttcttccccaagtgctgcaacaactgcaggtccttctcgggggtcgacgtctgcgacgacgcccaccccaagtgccccaaaggctgctccgcctgccgcgtggtgaccccgagccctcacaagacgttccgctgcgccgacatgaagagcaccgtcgacggcacctgcggtggcccatgcaaaaagcactgatcgcttcagggcttcaggctcggacgaggtgtgccgcctagaataaagctcagatgagatgagcagtcatcgtgttgctatgcttgtgtgtgggccgcgttatacggccaacaatatgtacgctgtttatcgtcactgtgttttctctctcgacaaaaagctggtgttgcttgttgaataaacacctctgatggttgtgcgtgtctactcatcaaaaacatgaaaatcagttctcttgcgcaatactgtacatctattctctccgatctatatgacatccatcaatggcatattaagcacgaatacaagtggggcatgtatttttagttcttc

SEQ ID NO: 1368 - DNA, 700 bp, Hordeum vulgare
agagagagagagagagagagagagagagagagagagagcctcgtgccgaattcggcacgaggaagcattctaccactagaccgcacaggtaaagctcgagctttgcgctaagagagttcatcggcagccatgaagagcaccaagctcgcggcgatcctgatcctccaggccgtcctggtcatggggatcctctcccacgttaacgccgacttcttccccaagtgctgcaacaactgcaggtccttctcgggggtcgacgtctgcgacgacgcccacccccagtgccccaagggctgctccgcctgccgcgtggtgaccccgagccctcacaagacgttccgctgcgccgacatgaagagcaccgtcgacggcacctgcggtggcccatgcaaaaagcactgatcgcttcagggcttcaggctcggacgaggtgtgccgcctagaataaagctcagatgagatgagcagtcatcgtgttgctatgtttgtgtgtgggccgtgctatacggccaacaatatgtacgctgtttatcgtcactgtgttttctctctcgagaaaaagctggtgttgcttgttgaataaacacctctgatggttgtgcgtgtctactcatcaaaaacatgaaaatcagttctcttgcgcaatactgtacatctattctctccgatctatatgacatccatcaatggcatattaagc

SEQ ID NO: 1369 - DNA, 1201 bp, Avena sativa
gcaagatcaagcattcgacaactagacgcgacagccgagagctctgcattctcacacgaaaagcttagaagttagaagcaacgagatgaagaacaccaagctcgtggcgatcctcgtcctccaggccgtcctggtcatggggatcctctcgcacgtgaacgccgactacttcccgacgtgctgcgacaactgcaggtccttctcgggcgtggacgtctgcgacgacgcccacccgacgtgccccaccggctgctcggcctgccgcgtggtgcagaccaccccgacccagaccttccgctgcgccgacatgaagaacaccgtcgacggcacctgcgggggaccctgcaccaagtactgatccatccatcgaccaaaaaataaatacgagtagtaaataaagctcggatgagatgagcagactcgtcatgtcctgctcgtgcgtgctgccgacactagctagctagctatgtcgtcggcgcgcggcgctattgcttgtctatatattctctctcgagaagtgctggtattgtttggcctgtcagctgtgtgtcgtgtgtcctccctcaataaacgctactacatgtggtgatttgtgtgtctatgcttgtaataagacgaaaatcagttcattcgacatatgcattatttagcgattttttttaaataatacgaattaattaattaaaaaaaaaaaaaaaaactcgagcgcctcaaacaggagtcaaagaggtgcgaggatgacctgatggccgccgcagccgatagagaaaaggggttcacagaacaacttttctctatcacacaagcgctatctggtatgtgtttatctgatctttttcgttggccttgtattttcctttttggtcatgcctgcaacttagatggaatgcaattccacatgcttccagtgttggcttcgactactaggctctggcctgtggggatgccttgatcgatgttgtgaccatggttgaagatcgcggtgcctccgctcaagacgccctcaagaaggccagagccattctagggctcctccatgataagatgctccccaaggccaagctagttgaagatcttaatggcctagtcaagaacttcgcaggtggcgtgcctgtggacatccagaacgcgtagaaaggagctggagcatccatggcgttggcgatggcataatgctgtgggcgcaatatggacgtcagcc

SEQ ID NO: 1370 - DNA, 617 bp, Triticum aestivum
cattctaccactagaccgaccgcaccaggtgaagtgggagctttgcgctaagggctcattagcaaccatgaagagcaccaagctcgcggcgatcctgatcctccaggccgtcctggtcatggggatcctctcacacgtgaacgccgactatttccccaagtgctgcaacagttgcaggtccttctcgggggtcgacgtctgcgacgacgcccacccccagtgccccaagggctgctcggcctgccgcgtggtgacgcccagccctcacaagacgttccggtgcgccgacatgaagagcaccgtcgacggcacctgcggcgggccatgcaaaaagcactgatccgttcagggcttcaggctcagacgaggtgtgccgcctaaaataaagctcagatgagatgagcagtcatggtgcctatgcttgtgtgtgggtcgtgctatacggccaacagtatgtataatgctatcgtcgtgtcttggtcaatgtgttttctctctcgagaaaggctggtggtgctagtacttgttcacctacctccgtgaataaacacatgtgatgattgtgtgtgcctactcaataacatgagaaccagttctcttgtcgaaaaaaaaaaaaa

SEQ ID NO: 1371 - DNA, 599 bp, Triticum aestivum
cattctaccactagaccgaccgcacaggtgaagtgagagctttgcgctaagggttcatcagcaaccatgaagagcaccaagctcgcggcgatcctgatcctccaggccgtcctggtcatggggatcctctcacacgtgaacgccgacttcttccccaagtgctgcaacaactgcaggtccttctccggggtcgacgtctgcgacgacgcccacccccagtgccccaagggctgctcggcctgccgcgtggtgacgcccagccctcacaagacgttccggtgcgccgacatgaagagcaccgtcgatggcacctgcggcgggccatgcaaaaagcactgatccgttcagggcttcagtctcagacgaggggtgccgcctaaaataaagctcagatgagatgagcagtcatggcgcctatgcttctctgtgggtcgtgctatacggccaacaatatgtatactgctatcgtcgtgtcttgtcaatgtgtttcctctctcgagaaaggtggtggtgcttgtacttgtgttcacctatcctccgtgaataaacacatgtgatgattgtgtgtgcctactcaataaaatgagaaccagttctct

SEQ ID NO: 1372 - DNA, 646 bp, Triticum aestivum
aagcattctaccactagaccgaccgcaccaggtgaagtgggagctttgcgctaagggctcattagcaaccatgaagagcaccaagctcgcggcgatcctgatcctccaggccgtcctggtcatggggatcctctcacacgtgaacgccgactatttccccaagtgctgcaacagttgcaggtccttctcgggggtcgacgtctgcgacgacgcccacccccagtgccccaagggctgctcggcctgccgcgtggtgacgcccagccctcacaagacgttccggtgcgccgacatgaagagcaccgtcgacggcacctgcggcgggccatgcaaaaagcactgatccgttcagggcttcaggctcagacgaggtgtgccgcctaaaataaagctcagatgagatgagcagtcatggtgcctatgcttgtgtgtgggtcgtgctatacggccaacagtatgtataatgctatcgtcgtgtcttggtcaatgtgttttctctctcgagaaaggctggtggtgctagtacttgttcacctacctccgtgaataaacacatgtgatgattgtgtgtgcctactcaataacatgagaaccagttctcttgtcgaaaaaaaaaaaaaaaacctcggccgcgaccacgctaatc

SEQ ID NO: 1373 - DNA, 498 bp, Triticum aestivum
caacagagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtgggcgctgcgcgggatatgaaatccaccgtcgacggcacctgcggtgggcctgcaagaattactgatcggtcatgccaacatgatatttccgcctaaaatgaaataaaactcagacgagatgagcagcgtcatcgtgcctagcgtgttgtgtggcaacaaatatttacaatatgccgttctcgcgcgtgtttccccccagaaaattggcgttgcttgttgt

SEQ ID NO: 1374 - DNA, 655 bp, Triticum aestivum
gcgcgcgagcgaccgacccagagagagagaccctcgccccgaattcggcacgaggcaaacaacacagagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaagtactgatcggttcatgccggcatgatatgttccgcctaaaattaaataaaagctcaggcgagatgagcagcgtcatcgtgcctatgcgtgtgtgtgtggccaacaatgcttataccagtatgtcgtctcttcgtcgctgtgttttctctctcgagaaaaagttggtgttgcttgttgttcagctatccggaatatcctccgtgaataaacagctgtaatgattgtgcgtggctgccaataatatgagttctcttgtccac

SEQ ID NO: 1375 - DNA, 488 bp, Triticum aestivum
acaacacagagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaagtactgatcggttcatgccggcatgatatgttccgcctaaaataaaataaaactcaagcgagatgagcagcgtcatcgtgcctatgcgtgtgtgtgtgggcaacaatgcttataccaatatgtcgtctcttcgtcgctgtgttttctctctc

SEQ ID NO: 1376 - DNA, 515 bp, Triticum aestivum
caacacagagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaagtactgatcggttcatgccggcatgatatgttccgcctaaaataaaataaaagctcaggcgagatgagcagcgtcatcgtgcctatgcgtgtgtgtgtgggcaacaatgcttataccaatatgtcgtctcttccgtcgctgtgttttctctctccaaaaaaaattggtgttgcttgttgt

SEQ ID NO: 1377 - DNA, 626 bp, Triticum aestivum
aacaacacagagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaagtactgatcggttcatgccggcatgatatgttccgcctaaaataaaataaaagctcaggcgagatgagcagcgtcatcgtgcctatgcgtgtgtgtgtggccaacaatgcttataccagtatgtcgtctcttcgtcgctgtgttttctctctcgagaaaaagttggtgttgcttgttgttcagctatccggaatatcctccgtgaataaacagctgtaatgattgtgcgtggctgccaataatatgagttctcttgtccacgcattacatgtttcccgttgtatttata

SEQ ID NO: 1378 - DNA, 751 bp, Triticum aestivum
ttatctccccacctaaccgaataataacgaccgctagcctagcagccctaccaggattgtcaatcaagttacgaaatcgacggctatatatagagctgcccgcagctttagccagccacaccaccacaacaacacagagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaagtactgatcggttcatgccggcatgatatgttccgcctaaaataaaataaaagctcaggcgagatgagcagcgtcatcgtgcctatgcgtgtgtgtgtggccaacaatgcttataccagtatgtcgtctcttcgtcgctgtgttttctctctcgagaaaaagttggtgttgcttgttgttcagctatccggaatatcctccgtgaataaacagctgtaatgattgtgcgtggctgccaataatatgagttctcttgtccacgcaaaaaaaaaaaaaaaacacctcgg

SEQ ID NO: 1379 - DNA, 778 bp, Secale cereale
agaaatcattctactccgcacaagtgaagcaagagctttgcacgaaaagtttcatcagcaaccatgaagggcaccaagctggcggcgatcctgatcctccaggccgtcctggtcatgggagtcctctcacacgtgaacgccgactttttccccaagtgctgcaacaactgcaggtccttctcgggcgtcgacgtctgcgacgacgcccatcccaagtgccccgccggctgctcggcctgccgcgtggtgaccacgaacccccaaacgtggcgctgcgccgatatgaaggccaccgtcgacggcacctgcggtgggccctgcaaaaagtctgatcggttcgtgcacacatgatatgttccgcctaaaaataaataaaagctcacatgagatgagcagagtcgtgtgcgtgtgtgtggacaaagatatgtataccattgcatcgtgcctttgcggtgtgttttctccctgagaaaaatttgtcgttgcttgttgttcagctaccatctgtaatgattgtgcgtgtctactcaatagatgaatatcagctgtattgaaaatttaaaaaacaaaacaaaaacaaaaaaacaaagacatagacagacactacaggataggtagacgtagtacgtagtagaccgttagaccgttacgacgttacgtagtaccgagtaacgttcgtaccgaaggtccttaaggccttacgaaggtaccttgaaccgtagttccgacgtaagttacggctaacgtccgttaaggcttaacgcggttacaacggtct

SEQ ID NO: 1380 - DNA, 473 bp, Triticum aestivum
caacagagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtccaacgagcccgaaatgtggcgctgcgcggatatgaaatccaccgtcgacggacctgcggtgggcctgcaagaagtactgatcgggtcatgccacatgatatgttccgcctaaaatgaaataaaactcaagacgagatgacagctcatcgtgcctatgcttgtgtgtgtcgcaacaaatattctacaactatccgtgtctcgtccctgtgtttc

SEQ ID NO: 1381 - DNA, 568 bp, Avena sativa
gatgaagaacaccagcaccaagctcgtggcgatcctcgtcctccaggccgtcctggtcatggggatcctctcgcacgtgaacgccgactacttcccgacgtgctgcgacaactgcaggtccttctccggcgtggacgtctgcgacgacgcccacccgacgtgccccaccggctgctcggcctgccgcgtggtgcagaccaccccgacccagaccttccgctgcgccgacatgaagaacaccgtcgacggcacctgcgggggaccctgcaccaagtactgatccatccatcgaccaaaaaataaatacgagtagtaaataaagctcggatgagatgagcagactcgtcatgtcctgcttgtgcgtgctgccgacgctagctagctagctatgtcgtcggcgcgcggcgctattgcttgtctatatattctctctcgagaagtgctggtattgtttggcctgtcagctgtgtgtcgtgtgtcctccctcaataaacgctactacatgtggtgatttgtgtgtctatgcttgtaataagacgaaaatcagttcattcgacatatgcattat

SEQ ID NO: 1382 - DNA, 576 bp, Secale cereale
gactgaccgcacgaatgaagtgagagctttgcacgaaaagttcataatcaaacatgaagagcaccaaggtcgcggcgatcctgatcctccaggccgtcctggtcatgggaatcctctcgcacgtgaatgccgacttcttccccaacgtgctgcaacaactgcaggtccgttctcggggtcgacgtctgcgacgacgcccactcccaacgtgcccacgggctgctcggcgtgccgcgtggtgacgagaaccccgaaattgtggcgctgcgcggatatgaaatccaccgtcgacggcacctgcggtgggccctgcaagaagtactgatcggttcatgccagcaggatatgttccgcctaaaataaaataaaagctcaggcgagatgagcagcgtcatcgtgcctatgcgtgtgtgtgtggccaacaatatgtataccagtatgtcgtgtcatcgtcgctgtgttttctctctcgagaaaaaagttggtgttgcttgttgttcagctatccgggatatcgtccgtgaataaacacctgtaatgattgtgcatggctgccaataatatgagttctcttgt

SEQ ID NO: 1383 - DNA, 594 bp, Avena sativa
cagactacaacacagttccccccacaaccagacggcacaactgagagctttcctcactcgaccgagaagcttagaatcaacaatgaagaacaccaagctcgtggcgatcctccttctccaggccctcctggtcatggggatcctctcgcacgtgaacgccgactatttccccaagtgctgcaacaactgcaggtccttttcggggatcgacgtgtgcgacgacgcccatcccacctgccccaagggctgctcggcgtgccgcacggtgacgacgagccctaagaagacgtaccggtgcgccgatatgaagaacactgtcgacggcacatgcgggggaccctgcaagaagtactgaccaatcggctaataaaacggctcggaacatggcatagatgtcttcctccaaaaataatgctcagatgcgatgagcagatctagccatcgtgcttgtgcgagctgtgccgacgatgtacacaccgtcggcggcggcgttactgtgttttctctctcgaggaatgttgtcgttgcttgcctaccagttgcatgtgtgtaagcgtggtgtatccaccgtcaataaacatataatatatattg

SEQ ID NO: 1384 - DNA, 623 bp, Avena sativa
gagactacaacacagttccccccacaaccagacggcacaactgagagctttcctcactcgaccgagaagcttagaatcaacaatgaagaacaccaagctcgtggcgatcctccttctccaggccctcctggtcatggggatcctctcgcacgtgaacgccgactatttccccaagtgctgcaacaactgcaggtccttttcggggatcgacgtgtgcgacgacgcccatcccacctgccccaagggctgctcggcgtgccgcacggtgacgacgagccctaagaagacgtaccggtgcgccgatatgaagaacactgtcgacggcacatgcgggggaccctgcaagaagtactgaccaatcggctaataaaacggctcggaacatggcatagatgtcttcctccaaaaataatgctcagatgcgatgagcagatctagccatcgtgcttgtgcgagctgtgccgacgatgtacacaccgtcggcggcggcgttactgtgttttctctctcgaggaatgttgtcgttgcttgcctaccagttgcatgtgtgtaagcgaggtgtatccaccgtcaataaacatataatatatattgtcatactcataaaaaaaaaaaaaaaaaaa

SEQ ID NO: 1385 - DNA, 667 bp, Avena sativa
acagactacagcacagatccccccacacccagacggcaggcacaactgagctttcctcactcgagaagcttaggagcaacgatgaagaacaccaagctcgtggcggtcctcctcctccaggccctcctggtcatggggatcctcgctcacgtgaacgccgactatttccccaagtgctgcaacaactgcaggtccttctcgggggtggacgtctgcgacgacacccaccccacctgccccaagggatgctcggcgtgccgcgcggtgacgacgagccccaagaagacgttccggtgcgccgacatgaagagcaccgtcgacggcacgtgcgggggaccctgcaagaagtactgatcgatcggctacaaaggctcgatcggaacatgggcagacatgtgtatgtgttccgcccaaataatgctcaactgagatgagcagatctagccgtcgtgcttgtgcgtgtgctgtgccgacgatgtacgtacacaccgtcggcggcggcggcgttactgtgttttctctcgcgagaatgttgtcgttgcttgcctaccggttgcatgtgtgtaagcgtggtgtatccaccgtcaataaacttctgttgtcatacctgtgtggctgtgtgtgtctctacctaacaagatgaaaatgagttcacttgtcaaacatt

SEQ ID NO: 1386 - DNA, 625 bp, Avena sativa
gacacagactacagcacagatccccccacacccagacggcaggcacaactgagctttcctcactcgagaagcttaggagcaacgatgaagaacaccaagctcgtggcggtcctccttctccaggccctcctggtcatgggggttatcgctcacgtgaacgccgactatttccccaagtgctgcaacaactgcaggtccttctcgggggtggacgtctgcgacgacacccaccccacctgccccaagggatgctcggcgtgccgcgcggtgacgacgagccccaagaagacgttccggtgcgccgacatgaagagcaccgtcgacggcacgtgcgggggaccctgcaagaagtactgatcgatcggctacaaaggctcgatcggaacatgggcagacatgtgtatgtgttccgcccaaataatgctcaactgagatgagcagatctagccgtcgtgcttgtgcgtgtgctgtgccgacgatgtacgtacacaccgtcggcggcggcggcgttactgtgttttctctcgcgagaaatgttgtcgttgcttgcctaccggttgcatgtgtgtaagcgtggtgtatccaccgtcaataaacttctgttgtcaaaaaaaaaaaaaaaaaa

SEQ ID NO: 1387 - DNA, 373 bp, Secale cereale
attctaccaccagaccgcacgaatgaagtgagagctttgcacgaaaagttcataatcaaacatgaagagcaccaaggtcgcggcgatcctgatcctccaggccgtcctggtcatgggaatcctctcgcacgtgaatgccgacttcttccccaagtgctgcaacaactgcaggtccttctcgggggtcacgtctgcgacgacgcccatcccaagtgccccagggctgctcggcgtgccgcgtggtgacgacgaaccccgaaatgtggcgctgcgcggatatgaaatccaccgtcgacggcacctgcggtggccctgcaagagtactgatcggttcatgccagcaggatatgttccgcctaaaataaataaagct

SEQ ID NO: 1388 - DNA, 490 bp, Secale cereale
ccaggccgtcctggtcatgggagtcctctcacacgtgaacgccgactttttccccaacgtgctgcaacaactgcaggtccttctcgggcgtcgacgtctgcgacgacgcccatcccaagtgccccgccggctgctcggcctgccgcgtggtgaccacgaaccccccaaacgtggcgctgcgccgatatgaaggccaccgtcgacggcacctgcggtgggccctgcaaaaagtactgatcggttcgtgcacatatgatatgttccgcctaaaataaaataaaagctcacatgagatgagcagagtcgtgtgcgtgtgtgtggacaaagatatgtataccattgcatcgtgcctttgtcggtgtgttttctccctcgagaaaaatatgtcgttgcttgttgttcagctacccatctgtaatgattgtgcgtgtctactcaataagatgaatatcagctgtattgtatttatactggcccatatggcatccgc

SEQ ID NO: 1389 - DNA, 502 bp, Festuca arundinacea
ggcacgaggccacgatccaaaagctcagaagaagctagcaacgatgaagaacaccaagctcgtggcgatcctcgttctccaggccatcctcgtcatgggcatcctctcgcacgtgaacgccgacttcttccccaagtgctgcaacaactgcaggtccttctccggggtcgacgtctgcgatgacgcccatcccaagtgccccaagggctgctcgcaatgccgcgtggtgacgaccaagcctaagacgacgtaccgctgcgccgacatgaagagcaccgtcgacggcacctgtggcggaccctgcaagcactgatcgacaggttaaagaggctcggaatatggcgcaacatatattccgccaaaaataatgctcccacgagatgagcagatctagtcatcgtgcgtgtatggctgtgtgtgcgtgccgacgatatcacaccgacgtcgtggcagcgttattgtgtgctttctctctcgagaaataatgtcgatgctcgactat

SEQ ID NO: 1390 - DNA, 565 bp, Lolium multiflorum
tcgagcggccgcccgggcaggtacgcggggacctgaccagcctacgacacaaatcattccacgttccaaaagctcagaagaagctagcaacgatgaagaacaccaagctcgtggcgatcctcgttctccaggccatcctcgtcatgggcatcctctcgcacgtgaacgccgacttcttccccaagtgctgcaacaactgcaggtccttctccggggtcgacgtctgcgatgacgcccatcccaagtgccccaagggctgctcgcaatgccgcgtggtgacgaccaagcctaagatgacgtaccgctgcgccgacatgaagagcaccgtcgacggcacctgtggcggaccctgcaagcactgatcgacgagttaaagaggctcggaatatggcgtaacatatattccacccaaaataatgctcccacgagatgagcagatctagtcatcgtgcctacctgtgtggctctgtgtgcgtgccgacgatatcagtatcacgccgtcggcggcggcgttgtcgtgttttctctctcgaggaattatgtcgatgctggcctataattaagt

SEQ ID NO: 1391 - DNA, 668 bp, Triticum aestivum
taccactagaccgaccgcaccaggtgaagtgggagctttgcgctaagggctcattagcaaccatgaagagcaccaagctcgcggcgatcctgatcctccaggccgtcctggtcatggggatcctctcacacgtgaacgccgactatttccccaagtgctgcaacagttgcaggtccttctcgggggtcgacgtctgcgacgacgcccacccccagtgccccaagggctgctcggcctggcccccccgggggcccccgtggtgacgcccagccctcacaagacgttccggtgcgccgacatgaagagcaccgtcgacggcacctgcggcgggccatgcaaaaagcactgatccgttaagggcttcaggctcagacgaggtgtgccgcctaaaataaagctcagatgagatgagcagtcatggtgcctatgcttgtgtgtgggtcgtgctatacggccaacagtatgtataatgctatcgtcgtgtcttggtcaatgtgttttctctctcgagaaaggctggtggtgcttgtacctgtccacctatcctccgtgaataaacacatgtgatgattgtgtgtgcctactcaataacatgagaaccagttctcttgtcgaaaaaaaaaaaaaaaaaaacctcggccgcgcccacgttaatcattagtgaattc

SEQ ID NO: 1392 - DNA, 2121 bp, Hordeum vulgare
gccggccgccgggtatataaaccccgaccgccacccccatttcccccagacccacgactcgccctcctccgcacagcagccccacctaccgacccgctgcgcatctcgcccctcccctcccctcccgccgcagcaatggcgctcgccaccaactccgccgccgcggccgcagcggccgccgcgctgtccggcggcgcggcccagccccgccgcgcgggcttcctaccgctcaagcgccgcaccatctccgcggtgcacgccgccgaccccgcccggagcggcggcgcgtccgtcccggcggccgccaagacctcgtccccgaccgtggcgccggaggccgccgccgccgcggcaaagcccgcgagctggtccgtcgacagctggaggaagaagaaggcgctgcagctgcccgagtaccccaacaaggaggagctcgacacggtgctgaagaccatcgagaccttcccgccgatcgtgttcgcaggggaggcgcgtcatctcgaggagcgcctcgccgaggccgccatgggccgcgccttcgtcctccagggcggcgactgcgccgagagcttcaaggagttcaacgccaataacatccgtgacaccttccgtgtgctcctccagatgggcgccgtcctcatgttcggcggccaggtccccgtcgtcaaggtgggacgcatggctggccagttcgccaagcccaggtccgacaacttcgaagagaaggacggggtgaagctgccgagttacaggggcgacaacgtcaacggcgacgccttcgacctcaagagccgcacgcctgaccccgataggatgatccgggcgtacgctcagtcagtggcgacccttaacttgctccgcgcgttcgccaccggaggctacgcagctatgcagcgggtcatccagtggaacctggatttcatggatcacaatgagcagggagacaggtaccgtgagttggcacatagggtggacgaagctcttggcttcatgacagcagctggactaggaatggaccatccgataatgacgactactgacttctggacatcccacgagtgtctcctcttgccatatgagcaggctcttacccgtgaggactccacaagtggccttttctacgactgctcggcccatatggtgtgggttggtgagcgtactcgtcaactcgatggggctcatgttgaattcctccgtggcattgccaaccctcttggcattaaggtgagcgataaaatgaaccctgctgaattggtgaagctgattgacattttgaacccttcaaacaagccgggaaggatcaccataattacaaggatgggggctgagaacatgagggtgaagttgcctcatctcatccgtgctgtccgcaattctggacagattgtcacatggattactgaccccatgcacggaaacaccatcaaggccccatgtggtctgaagactcgtccattcgactccattatgaacgaggtgcgtgcattcttcgatgtgcatgaccaagaaggaagccacccaggaggcatccaccttgaaatgactggacagaacgtaaccgagtgcatcggtggatcgcggaccgtgaccttcgatgacctgggtgaccgctaccacactcactgcgacccaaggctgaatgcatcacagtctctggagctcgctttcattatcgccgagagactcaggaagaggaggatgaagtcaggactcaccaacaacctgccactgcccccattggctttctaagaaggaagcatcagggaggaggggttagatagttggcatctgcaagcggtatccaaatgcgcattccattgagtttgtatggtgggctgctctttgcacaagctgtatgcttatgaggtattggtacttgtcgaggacagcaggggatagcgtactcgtggtgttgcactatgttttgtttctttgtttttatttttgagtgtttgatctgtttgagcctttgtgatcggagaaaataaagataatatgagttaccttggttaatttatttattcctcattgttgcatctagtcggtgatgcgaaatctgtccttgtaaacattgtttgaaatcattaacatcttttataaattcatgaatatttaatgaaa

SEQ ID NO: 1393 - DNA, 2018 bp, Secale cereale
ctgcgcatctcgccgcccaagccctcccctaccgtcgtagcaatggcgctcgccaccaactccgccgccgcggccgcagcgatcgccgcgctgaccggaggcgcggcccagccccgccgcgcgggcttcctccccctcaagcgccgcaccatctccgcggtccacgccgccgaccccgccaggagcggcccgtccgtcccggctgccgccgcggccaagacctcgtccccgacggtggcgccggaggccgccgccgtggcgcggcccgcgagctggtccgtcgacagctggaggaagaagaaggcgctgcagctacccgagtaccccaacaaggaggagctcgacgcggtcctcaagacgatcgagacgttcccgcccatcgtcttcgccggggaggcgcgacacctcgaggagcgcctcgccgaggctgccatggggcgcgccttcgtcctccagggcggcgattgcgccgagagcttcaaggagttcaacgccaacaacatccgtgacaccttccgtgtgctgctccagatgggcgccgtcctcatgttcggcggccaggtccccgtcgtcaaggtgggacggatggccggtcagttcgccaagcccaggtctgacaacttcgaagagaaggacggtgttaagctgccgagttacaggggcgacaacgtcaacggcgacgccttcgacctcaagagccgcacgcctgaccccgataggatgatcagggcgtacgcccagtcggtggcgacgctgaacttgctccgcgcgttcgcgaccggaggctatgcagctatgcagcgggtcatccagtggaacctggatttcatggatcacaacgagcagggagacaggtaccgtgagttggcacatagggtggacgaggctcttggcttcatgacagcagctgggctggggatggaccatccgataatgacgactactgacttctggacatcccacgagtgtctcctcttgccatatgagcaggctcttacccgtgaggactccacaagtggcctcttctacgactgctcggcccatatggtgtgggttggtgagcgtactcgtcaactcgatggggctcatgttgaattcctccgtggtattgccaaccctcttggcattaaggtgagcgacaagatgaaccctgctgaattggtgaagctgattgacattttgaacccttcaaacaagccgggaaggatcaccataattacaaggatgggggctgagaacatgagggtgaagttgcctcatctcatccgtgctgtccgcaactctggacagattgtcacatggattaccgaccccatgcacggaaacaccatcaaggccccatgtggtctgaagactcgtccatttgactctattatgaatgaggtgcgtgcattcttcgacgtgcatgaccaggaaggcagccacccaggaggtatccaccttgaaatgactggacagaatgtgactgagtgcatcggtggatcgcggaccgtgaccttcgatgacctgggtgaccgctaccacacccactgtgacccaaggctgaacgcgtcgcagtctctggagctcgctttcatcattgccgagagactcaggaagaggaggatgaagtcaggactcgccaacaacctgccgctgcccccattggctttctaagcaggaagcagcagggaggaggggttagatagttggcatttgcaagcggtatccaaatgcgcattccattgagtttgtatggtgggctgctctttgcacaagctgtgtgcttatgaggtgttggtacttgtcgaggacagcagggtgggtagcgtactcgtcgtgttgcactatgttttgtttctttgttttatttttgagtgtttggtctgtttgagcctttgtgatcggagaaaataaagataatatgagttaccttcgttaatttatttatttctcattgttccatctatgtggtgatgtaaaatctgtcctctcaagcatgtacaactttatttttgattatactaaacttaaatttt

SEQ ID NO: 1394 - DNA, 1967 bp, Triticum aestivum
tcgccctccgcacagcagccccacctaccgacctaccgcccgagcagctgcgcatctcgccgcccagcccctcccctcccctccccacccgccgcagcaatggcgctcgccaccaacaccgccgccgcggccgcagcgctgaccggcagcgcggcccagccccgccgcgcggggttcctccccctcaagcgccgcaccatctccgcggtgcacgccgccgaccccgccaggagcggcgcgtccgtcccggcggccgcggcagccaagacctcgtccccgacggtggcgccggaggccgcggccgtgacccggcccgcgagctggtccgtcgacagctggaggaagaagaaggcgctgcagctgcccgagtaccccaacaaggaggagctcgacgcggtcctcaagacgatcgagaccttcccgcccatcgtgttcgccggcgaggcgcgccacctcgaggaccgcctcgccgaggccgccatgggccgcgccttcgtcctccagggcggcgactgcgccgagagcttcaaggagttcaacgccaacaacatccgtgacaccttccgtgtgctgctccagatgggcgccgtcctcatgttcggcggccaggtccccgtcgtcaaggtgggacggatggctggccagttcgccaagcccaggtctgacaacttcgaagagaaggacggcgtcaagctgccgagttacaggggcgacaacgtcaacggcgacgccttcgacctcaagagccgcacgcctgaccccgacaggatgatcagggcctacgcccagtcggtggcgacgctgaacttgctccgcgcgttcgcgaccggaggctacgcagctatgcagcgggtcatccagtggaacctggatttcatggatcacaacgagcagggagacaggtaccgtgagttggcacatagggtggacgaggctcttggcttcatgacagcagctgggctggggatggaccatccgataatgacgactactgacttctggacatcccacgagtgtctcctcttgccatatgagcaggctcttacccgtgaggactccacaagtggccttttctacgactgctcggcccatatggtgtgggttggtgagcgtactcgtcaactcgacggggctcatgttgaattcctccgtggtattgccaaccctcttggcattaaggtgagtgacaagatgaaccctgctgaattggtgaagctgattgacattttgaacccttcaaacaagccgggaaggatcaccataattacaaggatgggggctgagaacatgagggtgaagttgcctcatctcatccgtgctgtccgcaattctggacagattgtcacatggattaccgaccccatgcacggaaacaccatcaaggccccatgtggtctgaagactcgtccatttgactctattatgaatgaggtgcgtgcattcttcgacgtgcacgaccaagaaggaagccacccaggaggtatccaccttgaaatgactggacagaatgtgaccgagtgcatcggtggatcgcggactgtgaccttcgatgacctgggtgaccgctaccacacccactgcgacccaaggctgaacgcgtcgcagtctctggagctcgctttcatcatcgccgagagactcaggaagaggaggatgaagtcaggactcaccaacaacctgccactgcccccattggctttctaagcaggaagcaccagggaggaggggttagatagttggcatttgcaagcggtaaccaaatgcgcattccattgagtttgtatggtggctgctctttgcacaagctgtgtgcttatgaggtgttggtacttgtcgaggacagcaggggggtagcgtactcgtggtgttgcactatgttttgtttctttgttttatttttgagtgtttgatctgtttgagcctttgtgatccgagaaaataaaaataatatgagttacctttgttaa

SEQ ID NO: 1395 - DNA, 1957 bp, Hordeum vulgare
cgctgtccggcggcgcggcccagccccgccgcgcgggcttcctaccgctcaagcgccgcaccatctccgcggtgcacgccgccgaccccgcccggagcggcggcgcgtccgtcccggcggccgccaagacctcgtccccgaccgtggcgccggaggccgccgccgccgcggcaaagcccgcgagctggtccgtcgacagctggaggaagaagaaggcgctgcagctgcccgagtaccccaacaaggaggagctcgacacggtgctgaagaccatcgagaccttcccgccgatcgtgttcgcaggggaggcgcgtcatctcgaggagcgcctcgccgaggccgccatgggccgcgccttcgtcctccagggcggcgactgcgccgagagcttcaaggagttcaacgccaataacatccgtgacaccttccgtgtgctcctccagatgggcgccgtcctcatgttcggcggccaggtccccgtcgtcaaggtgggacgcatggctggccagttcgccaagcccaggtccgacaacttcgaagagaaggacggggtgaagctgccgagttacaggggcgacaacgtcaacggcgacgccttcgacctcaagagccgcacgcctgaccccgataggatgatccgggcgtacgctcagtcagtggcgacccttaacttgctccgcgcgttcgccaccggaggctacgcagctatgcagcgggtcatccagtggaacctggatttcatggatcacaatgagcagggagacaggtaccgtgagttggcacatagggtggacgaagctcttggcttcatgacagcagctggactaggaatggaccatccgataatgacgactactgacttctggacatcccacgagtgtctcctcttgccatatgagcaggctcttacccgtgaggactccacaagtggccttttctacgactgctcggcccatatggtgtgggttggtgagcgtactcgtcaactcgatggggctcatgttgaattcctccgtggcattgccaaccctcttggcattaaggtgagcgataaaatgaaccctgctgaattggtgaagctgattgacattttgaacccttcaaacaagccgggaaggatcaccataattacaaggatgggggctgagaacatgagggtgaagttgcctcatctcatccgtgctgtccgcaattctggacagattgtcacatggattactgaccccatgcacggaaacaccatcaaggccccatgtggtctgaagactcgtccattcgactccattatgaacgaggtgcgtgcattcttcgatgtgcatgaccaagaaggaagccacccaggaggcatccaccttgaaatgactggacagaacgtaaccgagtgcatcggtggatcgcggaccgtgaccttcgatgacctgggtgaccgctaccacactcactgcgacccaaggctgaatgcatcacagtctctggagctcgctttcattatcgccgagagactcaggaagaggaggatgaagtcaggactcaccaacaacctgccactgcccccattggctttctaagaaggaagcatcagggaggaggggttagatagttggcatctgcaagcggtatccaaatgcgcattccattgagtttgtatggtgggctgctctttgcacaagctgtatgcttatgaggtattggtacttgtcgaggacagcaggggatagcgtactcgtggtgttgcactatgttttgtttctttgtttttatttttgagtgtttgatctgtttgagcctttgtgatcggagaaaataaagataatatgagttaccttggttaatttatttattcctcattgttgcatctagtcggtgatgcgaaatctgtccttgtaaacattgtttgaaatcattaacatcttttataaattcacgaatatttaatgaaattgtgaaggttttattg

SEQ ID NO: 1396 - DNA, 1982 bp, Triticum aestivum
gcggccgcagcgctgaccggcagcgcggcccagccccgccgcgcgggcttcctccccctcaagcgccgcaccatctccgccgtgcacgccgccgaccccgccaggagcggcgcgtccgtcccggcggccgcggcagccaagacctcgtccccgacggtggcgccggaggccgcggccgtgacccggcccgcgagctggtccgtcgacagctggaggaagaagaaggcgctgcagctgcccgagtaccccaacaaggaggagctcgacgcggtcctcaagacgatcgagaccttcccgcccatcgtgttcgccggcgaggcgcgccacctcgaggaccgcctcgccgaggccgccatgggccgcgccttcgtcctccagggcggcgactgcgccgagagcttcaaggagttcaacgccaacaacatccgtgacaccttccgtgtgctgctccagatgggcgccgtcctcatgttcggcggccaggtccccgtcgtcaaggtgggacggatggctggccagttcgccaagcccaggtctgacaacttcgaagagaaggacggcgtcaagctgccgagttacaggggcgacaacgtcaacggcgacgccttcgacctcaagagccgcacgcctgaccccgacaggatgatcagggcctacgcccagtcggtggcgacgctgaacttgctccgcgcgttcgcgaccggaggctacgcagctatgcagcgggtcatccagtggaacctggatttcatggatcacaacgagcagggagacaggtaccgtgagttggcacatagggtggatgaggctcttggcttcatgactgcagctgggctgggaatggaccatccgataatgacgactactgacttctggacatcccacgagtgtctcctcttgccatatgagcaggctcttacccgtgaggactccacaagtggccttttctacgactgctcggcccatatggtgtgggttggtgagcgcactcgtcaactcgatggggctcatgttgaattcctccgtggtattgccaaccctcttggcattaaggtgagtgacaagatgaaccctgctgaattggtgaagctgattgacattttgaacccttcaaacaagccgggaaggatcaccataattacaaggatgggggctgagaacatgagggtgaagttgcctcatctcatccgtgctgtccgcaattctggacagattgtcacatggattaccgaccccatgcacggaaacaccatcaaggccccatgtggtctgaagactcgtccatttgactctattatgaatgaggtgcgtgcattcttcgacgtgcacgaccaagaaggaagccacccaggaggtatccaccttgaaatgactggacagaatgtgaccgagtgcatcggtggatcgcggactgtgaccttcgatgacctgggtgaccgctaccacacccactgcgacccaaggctgaacgcgtcgcagtctctggagctcgctttcatcatcgccgagagactcaggaagaggaggatgaagtcaggactcaccaacaacctgccactgcccccattggctttctaagcaggaagcaccagggaggaggggttagatagttggcatttgcaagcggtaaccaaatgcgcattccattgagtttgtatggtgggctgctctttgcacaagctgtgtgcttatgaggtgttggtacttgtcgaggacagcaggggggtagcgtactcgtggtgttgcactatgttttgtttctttgttttatttttgagtgtttgatctgtttgagcctttgtgatccgagaaaataaaaataatatgagttacctttattaatttatttatatctcattgtttcatctatttggtgatgtaaatctgtcctctcaaacatgtcaaacattttttgaaattgtaaacatttcttaaaactacaacttttttgaaacacgagaaatttagaaagaatgtgattt

SEQ ID NO: 1397 - DNA, 1739 bp, Avena sativa
cgccgacccggccaggaacagcggctccgtcccggcggccgcgaagacctcgtccccgacggtggcgccggagaaatcggtcgcggcggcccccgcggcctgggcggtggacagctggaagtccaagaaggcgctgcagctccccgagtacccgaacaaggaggagctggacacggtgctccagacgatcgagaccttcccgcccatcgtcttcgccggggaggcgcgccacctcgaggaccgcctcgcagaggccgccatgggccgcgccttcgtcctccagggcggggactgcgccgagagcttcaaggagttcaacgccaacaacatcagggacaccttccgtgtcctgctccagatgggcgccgtcctcatgttcggcggccaggttcccgtcgtcaaggtggggaggatggctggccagttcgccaagcctaggtctggcaacttcgaggagaaggacggggttaagctgcccagttacaggggtgacaacattaacggcgacgccttcgacatgaagagccgcactccggacccggacaggatgatcagggcctatgcccagtccgtggcgacgctcaacttgctccgcgccttcgcgaccggaggctatgccgctatgcagcgggtcatccaatggaacctcgatttcatggaccacaacgagcagggagacaggtaccgcgagttggcacatagggtggatgaggctcttggcttcatgactgcagctgggctggggatagaccatccgataatgacaactactgacttctggacatcccatgagtgtctcctcttgccctatgagcaggctcttactcgtgaggactccacaagtggccttttctatgactgctcagctcacatggtctgggttggtgagcgtactcgtcaactcgatggggctcatgttgaattcctccgtggtattgccaacccccttggcataaaggtgagcgataaaatggaccctgctgaattggtaaagctgattgacatcttgaacccatcaaacaagccgggaaggatcaccataattacaaggatgggagctgagaacatgagggtgaagttgcctcatctcatccgcgctgtccgcaattctggacagattgttacatggattaccgatcccatgcacgggaacacaatcaaggccccatgtggtctgaagactcgtccattcgactccattatgaatgaggtacgtgcattcttcgacgtgcatgatcaagagggaagccacccaggaggtatccaccttgaaatgactggacagaacgtaaccgagtgcatcggtgggtcgcggaccgtgacctttgacgaccttggtgaccgttaccacacccactgcgacccaaggctgaatgcgtcgcaatctctggagctcgccttcatcatcgccgagagactcaggaagaggaggatgcagtcagggctcacaaacaacctgccactgcctccactggccttctaaaccctgaacaggggagtagcagggaggagggggttagatagtttcgatttgcaagcgatgcgcattcaattgagtttgtatggtgggggtgctcttttgcacaagctgtaagcgtatgagatattcgtactcgtcgagaacagtagtatactcgtggggtactagtatgtttttgctttctttgttctatttttgaatgtttgttctgcttgagcctttggtgaccggaggaaataaaaataagatgagttccctt

SEQ ID NO: 1398 - DNA, 1741 bp, Avena sativa
cgccgacccggccaggaacagcggctccgtcccggcggccgcgaagacctcgtccccgacggtggcgccggagaaatcggtcgcggcggcccccgcggcctgggcggtggacagctggaagtccaagaaggcgctgcagctccccgagtacccgaacaaggaggagctggacacggtgctccagacgatcgagaccttcccgcccatcgtcttcgccggggaggcgcgccacctcgaggaccgcctcgcagaggccgccatgggccgcgccttcgtcctccagggcggggactgcgccgagagcttcaaggagttcaacgccaacaacatcagggacaccttccgtgtcctgctccagatgggcgccgtcctcatgttcggcggccaggttcccgtcgtcaaggtggggaggatggctggccagttcgccaagcctaggtctggcaacttcgaggagaaggacggggttaagctgcccagttacaggggtgacaacattaacggcgacgccttcgacatgaagagccgcactccggacccggacaggatgatcagggcctatgcccagtccgtggcgacgctcaacttgctccgcgccttcgcgaccggaggctatgccgctatgcagcgggtcatccaatggaacctcgatttcatggaccacaacgagcagggagacaggtaccgcgagttggcacatagggtggatgaggctcttggcttcatgactgcagctgggctggggatagaccatccgataatgacaactactgacttctggacatcccatgagtgtctcctcttgccctatgagcaggctcttactcgtgaggactccacaagtggccttttctatgactgctcagctcacatggtctgggttggtgagcgtactcgtcaactcgatggggctcatgttgaattcctccgtggtattgccaacccccttggcataaaggtgagcgataaaatggaccctgctgaattggtaaagctgattgacatcttgaacccatcaaacaagccgggaaggatcaccataattacaaggatgggagctgagaacatgagggtgaagttgcctcatctcatccgcgctgtccgcaattctggacagattgttacatggattaccgatcccatgcacgggaacacaatcaaggccccatgtggtctgaagactcgtccattcgactccattatgaatgaggtacgtgcattctttgacgtgcatgatcaagaaggaagccacccaggaggtatccaccttgaaatgactggacagaacgtaaccgagtgcatcggtgggtcgcggaccgtgacctttgacgaccttggtgaccgttaccacacccactgcgacccaaggctgaacgcgtcgcaatctctggagctcgccttcatcatcgccgagagactcaggaagaggaggatgcagtcagggctcacaaacaacctgccactgcctccactggccttctaaaccctgagcaggggagtagcagggaggagggggttagatagtttcgatttgcaagcgatgcgcattcaattgagtttgtatggtgggggtgctcttttgcacaagctgtaagcgtatgagatattcgtactcgtcgagaacagtagtatactcgtggggtactagtatgtttttgctttctttgttctatttttgaatgtttgttctgcttgagcctttggtgaccggaggaaataaaaataagatgagttcccttgg

SEQ ID NO: 1399 - DNA, 2269 bp, Oryza sativa
agtatcttttccaagtcaggtcatatagatacgaagaaaaactacgaaactacccttccccaccaccccttcttcctccctcctctcacaccctcgtcgccgccaaccaccatccaacccatccaccaacccctcctcctccccttcgccgtcgaccccgcctataaatacccctcaccccacccacctccaccttcagaggagccccgcctaccgccgccctcacgcctcctcccacctacctcacctcgaagctgacgtcagcaatggcgctcgccaccaactccgccgctgtttccggtggcgctgcggccgcggcgtcgtcggcgccccagccgcggctcgccgccacgttcctcccgatgaggaggcgaaccgtctcggcggtccacgcggccgacccggcgaagagcaacgggcccgtgcaggccgcggcgaaggcctcgtccccgtcgacggtggcggcgccggagaagaagccggtggggttggggaagtggacggtggatagctggaaggcgaagaaggcgctgcagctgcccgagtacccgagccaggaggagctcgactccgtgctcaagacgatcgagacgttcccgcccgtggtgttcgccggggaggcgcgccacctcgaggagcgcctcgccgacgccgccatgggccgcgccttcgtcctccagggcggcgactgcgccgagagcttcaaggagttcaacgccaacaacatccgtgacaccttccgcatcctgctccagatgggcgccgtcctcatgttcggcggccagatgcccgtcgtcaaggtcgggaggatggctggccagttcgccaagccgaggtctgattcgttcgaggagagggacggggttaagctgccgagttacaggggagacaacatcaatggcgacaccttcgacgagaagagccgcgtgccggacccgcagcggatgatccgcgcgtacgcgcagtcggtggcaacgctcaacctgctccgcgccttcgccacgggagggtacgccgccatgcagcgcgtcacgcagtggaacctcgatttcatggatcacagcgaacaaggagacaggtaccgtgaattggcacaccgggtggatgaggcacttggcttcatgactgcagcagggctaacagtcgaccatccgataatgacaacaactgacttctggacatcccatgagtgcctcctcttaccatatgagcagtctcttacacgtgaggattccaccagtggcctcttctatgactgctcagcccacatgctatgggttggtgagcgcactcgccagctcgatggagctcatgttgaatttctccgtggtgttgccaaccctcttggcataaaggtgagtgacaaaatgaacccccgtgacttggtgaagctcattgagattttgaacccatcaaacaagcctggaaggataaccataattacaagaatgggggcagagaacatgagggtgaaattgcctcatcttatccgtgctgtccgcaactctggacagattgtcacatggattactgatcccatgcatggaaacaccatcaaggctccatgtggtctgaagactcgtccattcgattccattctggctgaagtacgtgcgttcttcgatgtccatgatcaagaaggtagccacccaggaggtatccacctggaaatgactgggcagaacgtgactgaatgcatcggtggatcaaggaccgtcaccttcgatgacctgagcgaccgctaccacacccactgtgacccaaggctgaacgcgtcgcaatccctggagctcgccttcatcatcgccgagagactgaggcggaggaggatgcggtccggggtcaacagcaacctgccattgcccccattggctttctaaactgctgaaacgggggaagggaaaagaaactgggaggagggggtagaatagtttcaactcgccggcggtgatatctgcatgtgttctgtcaaatgtttgtatggtggttgttgagtgttcttggcactataggcagttgtcgaggatatggtagcatatatactcgccgtgttgtaataagttttttgatggatgtgttctgatgaatttttaagggggcctcagctctgtgctgtttggccttggggacaggagaaaataaagctagatggtttgcttggttacttttgtactcgtagatacgatcgatgcctctctatctgcttctcttttttttttctctgcgattggaagtttggaacgtgccaggctgcgacatgcgtttcccc

SEQ ID NO: 1400 - DNA, 2139 bp, Oryza sativa
acgaaactacccttccccaccaccccttcttcctccctcctctcacaccctcgtcgccgccaaccaccatccaacccatccaccaacccctcctcctccccttcgccgtcgaccccgcctataaatacccctcaccccacccacctccaccttcagaggagccccgcctaccgccgccctcacgcctcctcccacctacctcacctcgaagctgacgtcagcaatggcgctcgccaccaactccgccgctgtttccggtggcgctgcggccgcggcgtcgtcggcgccccagccgcggctcgccgccacgttcctcccgatgaggaggcgaaccgtctcggcggtccacgcggccgacccggcgaagagcaacgggcccgtgcaggccgcggcgaaggcctcgtccccgtcgacggtggcggcgccggagaagaagccggtggggttggggaagtggacggtggatagctggaaggcgaagaaggcgctgcagctgcccgagtacccgagccaggaggagctcgactccgtgctcaagacgatcgagacgttcccgcccgtggtgttcgccggggaggcgcgccacctcgaggagcgcctcgccgacgccgccatgggccgcgccttcgtcctccagggcggcgactgcgccgagagcttcaaggagttcaacgccaacaacatccgtgacaccttccgcatcctgctccagatgggcgccgtcctcatgttcggcggccagatgcccgtcgtcaaggtcgggaggatggctggccagttcgccaagccgaggtctgattcgttcgaggagagggacggggttaagctgccgagttacaggggagacaacatcaatggcgacaccttcgacgagaagagccgcgtgccggacccgcagcggatgatccgcgcgtacgcgcagtcggtggcaacgctcaacctgctccgcgccttcgccacgggagggtacgccgccatgcagcgcgtcacgcagtggaacctcgatttcatggatcacagcgaacaaggagacaggtaccgtgaattggcacaccgggtggatgaggcacttggcttcatgactgcagcagggctaacagtcgaccatccgataatgacaacaactgacttctggacatcccatgagtgcctcctcttaccatatgagcagtctcttacacgtgaggattccaccagtggcctcttctatgactgctcagcccacatgctatgggttggtgagcgcactcgccagctcgatggagctcatgttgaatttctccgtggtgttgccaaccctcttggcataaaggtgagtgacaaaatgaacccccgtgacttggtgaagctcattgagattttgaacccatcaaacaagcctggaaggataaccataattacaagaatgggggcagagaacatgagggtgaaattgcctcatcttatccgtgctgtccgcaactctggacagattgtcacatggattactgatcccatgcatggaaacaccatcaaggctccatgtggtctgaagactcgtccattcgattccattctggctgaagtacgtgcgttcttcgatgtccatgatcaagaaggtagccacccaggaggtatccacctggaaatgactgggcagaacgtgactgaatgcatcggtggatcaaggaccgtcaccttcgatgacctgagcgaccgctaccacacccactgtgacccaaggctgaacgcgtcgcaatccctggagctcgccttcatcatcgccgagagactgaggcggaggaggatgcggtccggggtcaacagcaacctgccattgcccccattggctttctaaactgctgaaacgggggaagggaaaagaaactgggaggagggggtagaatagtttcaactcgccggcggtgatatctgcatgtgttctgtcaaatgtttgtatggtggttgttgagtgttcttggcactataggcagttgtcgaggatatggtagcatatatactcgccgtgttgtaataagttttttgatggatgtgttctgatgaatttttaagggggcctcagctctgtgctgtttggccttggggacaggagaaaataaagctagatggtttgcttggttacttttgtactcgtagata

SEQ ID NO: 1401 - DNA, 2452 bp, Setaria italica
atgcacaagccgtcaactattgtatcaggtcagcggctcggtcgattaatagccgagccgaacgcggaaaacctaccttccacgcatactcccacggtcccaccaccccaggctatctgtgacagggccctacttgtcattgacgcaaactccttacctaacccggttgctccaaccctgtcgaaatccccaaactgcccttcccctttcgttccaccacccggcggcaactaccatctgcatccacccccgtcgtcgctcaccgctaccaaccccctcctcctccgtccgccaataaatacctccccgctcgccgcctccatttcctcagaggagacgccttgcaccgtacgactcctcccccaaaccctacctacccccctctcgcccgcctcgcaatggcgctcgccaccaactccgcggcaaccgccgccgcggcggcggccgtatccggcggcgcggcatcccagccgcgccgcgcggccgcgttcgtcccgctgaagaggcgcaccatctccgccatccacgccgccgacccgtcgaagaacaacgggtccgccgtccccgccgccgccgcctcctccaaggcctcgtcctttgcggtggcgacgccggagaagaagccggcggcgcaagggaagtggacggtagacagctggaagtcgaagaaggcgctgcagctccccgagtacccgagccaggaggagctggactccgtgctcaagacgatcgagacgttcccgccggtggtgttcgccggggaggcgcgccacctcgaggagcgcctcgccgaggccgccatgggccgcgccttcgtcctccagggtggagattgcgctgagagcttcaaggagttccacgccaacaacatccgtgacaccttccgcatcctgctccagatgggcgctgtcctcatgttcggcggtcaggtcccggtcgtcaaggtggggaggatggctggccagttcgccaagccaaggtccgaggcattcgaggagagggacggcgttaagctgccgagctacaggggcgacaacgtgaacggagacgatttcaccgagaagagccgcgtgccggacccgcagaggatgatccgcgcctacgcgcagtcggtggccacgctcaaccttctccgcgcgttcgcgactggaggctacgctgctatgcagcgcgtcacacagtggaatctcgatttcatggatcacagcgagcaaggtgataggtaccgtgaattggcccatagggtggatgaggctcttggattcatgactgcagcggggcttacagttgaccacccgataatgacgactactgacttctggacctcgcacgagtgccttctcttaccatacgagcaggctcttacccgtgaggactccaccagtggccttttctatgattgttcggcccacatgctgtgggttggggagcgcactcgccaacttgatggggctcatgttgaattcctcagaggtgttgccaaccctcttggcataaaggtgagtgacaaaatgaaccccagtgacttggtgaagctgattgagattttgaacccttcaaacaagcctggaagaatcaccataattacaaggatgggggcagagaacatgagagtgaagttgcctcatcttatccgtgctgtccgcaatgctggactgattgtcacatggattactgatcctatgcatggaaacacaatcaaggccccttgtggtttgaagactcgtccattcgactccattcttgctgaagtacgtgcattcttcgatgtgcatgaccaagaagggagccacccaggaggtatccacctggagatgactgggcagaacgtgactgagtgcattggtggatcacggaccgtgaccttcgatgacctgagcgaccgctaccacacccactgtgacccaaggctgaacgcctcccagtcccttgagcttgccttcatcattgccgagaggctcaggaagaggaggatgcggtcagggctcaacaacagcctgccgctgccactggctttctaaagtgccgaaaccaaacagagagggtagaatagttgcgacaacttgaaagcagtgaccgatgcctattcattcgttggtgcttggtatggtgggtgctcttggcacaagttacatgctcttgagctataggaggcacttgtggagctgtggaagacagtagctagcattatgtgttgtaatagtactatgtttttgtttgatgttttgggtgtgcgacttgccgacttagctgtttctggggttttgaccttggtaaggagaaaataaaagagataatgggattgcaatgcctagtgaactggtactcaataaattgatcccttgatggttctgtttggttatcttctgaggcgcctctctcagattcagtgatgtgaaatgtttgtttgtgtggttcctgctctttcggaggaaatgcagtgaactgtgtg

SEQ ID NO: 1402 - DNA, 2206 bp, Sorghum bicolor
cacaatccccaaactacccttccccctccgttccatttccaccacctcctatcgtcgccacccggcggcaactaccccacccctccgtcgtcgccgctcacggctaccaacccctcctcctcccgcccgtcaataagtaccgccccgctcgccacctccatttcctcagaggagacgccctgcactgcacgactcctccccatctaccactaccaacccatctatctaccacccctcgctcgcaatggcgctggccaccaactccgccgccgccgccgcagcagcagcggccgtatccggtggcgcgtcatcccagccgcgccgcgcggccgtgttcctcccgctgaagaggcgcaccatctccgccatccacgccgccgacccgtcaaagaacaacggacccgccgtccccgcggcggccgctgccaagtcttccgcctcggcggtggccacgccggagaagaagccggcggctccggggaagtgggcggtcgacagctggaaatcgaagaaggcgctgcagctccccgaatacccgaaccaggaggagctggacacggtgctcaagaccatcgaaacgttcccgccggtcgtgttcgccggagaggcgcgccacctcgaggagcgcatggcagaggctgccatgggccgcgccttcgtcctccagggcggcgactgcgccgagagcttcaaggagttccacgccaacaatatccgtgacaccttccgtattctgctccagatgggcgccgtgctcatgttcggtggtcaggtgccggtcgtcaaggtggggaggatggctggccagttcgccaagccaaggtccgaaccgttcgaggagagggatggtgttaagctgccgagctacaggggtgacaacgtcaacggcgatgacttcaccgagaagagccgcgtgccagacccgcagaggatgatccgcgcctacgcgcagtcggtggcgacgctcaacctgctccgcgcgttcgccacaggagggtatgctgccatgcagcgtgtcacacaatggaacctcgacttcatggatcacagcgagcaaggtgataggtaccgtgaattggcccatagggtggatgaggctcttgggttcatgactgcagcaggacttaccgttgaccacccgataatgacgactactgacttctggacctcgcacgagtgccttctcttaccctatgagcaggctcttacccgtgaggactccaccagtggccttttctatgattgttcagcccacatgttgtgggttggtgagcgcactcgtcaacttgatggagctcatgttgaattcctccgtggtgtggccaaccctcttggcataaaggtgagtgacaaaatgaatcccagtgacttggtgaagctgattgagattctgaacccttcaaacaaacccggaaggatcaccataattacaaggatgggggcagagaacatgagagtaaagttgcctcatctcatccgtgctgtccgcaatgctggattgattgtcacatggattactgatcctatgcatggaaacaccataaaggccccttgtggcttgaagactcgtcctttcgattccattctggctgaagtgcgcgcattcttcgacgtgcatgaccaagaaggaagtcacccaggaggtatccaccttgaaatgactgggcagaacgtgaccgagtgcattggtggatcacggactgtgacctttgacgacctgagcgaccgctaccacacccactgtgacccaagactgaacgcctcccagtccctggagcttgccttcatcattgcagagaggctcaggaagaggaggatgcggtcagggctcaacaacagcctgccgctgccaccactggctttctgaatggccaaagccgaacagagagggtagaaatagttgcagtgagtcgaaagaggtgatcggcgcctatttatttgttgatgttcggtgtggtggcctggtgggtgctcttggcacaagttacatgctggggagctataggaggtacttgttgtatcctggaagacagtagctagcattatgtgttgtaattgtatgctttcgtttcctgttttgggtgcgtgacttgccgacttagctgcttctggtgttttgaccttggtaaggagagaataaagagataatgggagtgcaatgtttgctgaactggtgctcaataaattgatcgatccccttgatggt

SEQ ID NO: 1403 - DNA, 2557 bp, Sorghum bicolor
gcacaagccgtcaaccatttgggcggcttcatcgatatatagccaagccgaacatccacgcctaccagctaccatagcgagcccgcacctaccctctttctctgccgtcacggccccacattgtcatagacgtagactcgccaccaaaccctggtggtacgaccgctctaattgcagccacaatccccaaactacccttccccctccgttccatttccaccacctcctatcgtcgccacccggcggcaactaccccacccctccgtcgtcgccgctcacggctaccaacccctcctcctcccgcccgtcaataagtaccgccccgctcgccacctccatttcctcagaggagacgccctgcactgcacgactcctccccatctaccactaccaacccatctatctaccacccctcgctcgcaatggcgctggccaccaactccgccgccgccgccgcagcagcagcggccgtatccggtggcgcgtcatcccagccgcgccgcgcggccgtgttcctcccgctgaagaggcgcaccatctccgccatccacgccgccgacccgtcaaagaacaacggacccgccgtccccgcggcggccgctgccaagtcttccgcctcggcggtggccacgccggagaagaagccggcggctccggggaagtgggcggtcgacagctggaaatcgaagaaggcgctgcagctccccgaatacccgaaccaggaggagctggacacggtgctcaagaccatcgaaacgttcccgccggtcgtgttcgccggagaggcgcgccacctcgaggagcgcatggcagaggctgccatgggccgcgccttcgtcctccagggcggcgactgcgccgagagcttcaaggagttccacgccaacaatatccgtgacaccttccgtattctgctccagatgggcgccgtgctcatgttcggtggtcaggtgccggtcgtcaaggtggggaggatggctggccagttcgccaagccaaggtccgaaccgttcgaggagagggatggtgttaagctgccgagctacaggggtgacaacgtcaacggcgatgacttcaccgagaagagccgcgtgccagacccgcagaggatgatccgcgcctacgcgcagtcggtggcgacgctcaacctgctccgcgcgttcgccacaggagggtatgctgccatgcagcgtgtcacacaatggaacctcgacttcatggatcacagcgagcaaggtgataggtaccgtgaattggcccatagggtggatgaggctcttgggttcatgactgcagcaggacttaccgttgaccacccgataatgacgactactgacttctggacctcgcacgagtgccttctcttaccctatgagcaggctcttacccgtgaggactccaccagtggccttttctatgattgttcagcccacatgttgtgggttggtgagcgcactcgtcaacttgatggagctcatgttgaattcctccgtggtgtggccaaccctcttggcataaaggtgagtgacaaaatgaatcccagtgacttggtgaagctgattgagattctgaacccttcaaacaaacccggaaggatcaccataattacaaggatgggggcagagaacatgagagtaaagttgcctcatctcatccgtgctgtccgcaatgctggattgattgtcacatggattactgatcctatgcatggaaacaccataaaggccccttgtggcttgaagactcgtcctttcgattccattctggctgaagtgcgcgcattcttcgacgtgcatgaccaagaaggaagtcacccaggaggtatccaccttgaaatgactgggcagaacgtgaccgagtgcattggtggatcacggactgtgacctttgacgacctgagcgaccgctaccacacccactgtgacccaagactgaacgcctcccagtccctggagcttgccttcatcattgcagagaggctcaggaagaggaggatgcggtcagggctcaacaacagcctgccgctgccaccactggctttctgaatggccaaagccgaacagagagggtagaaatagttgcagtgagtcgaaagaggtgatcggcgcctatttatttgttgatgttcggtgtggtggcctggtgggtgctcttggcacaagttacatgctggggagctataggaggtacttgttgtatcctggaagacagtagctagcattatgtgttgtaattgtatgctttcgtttcctgttttgggtgcgtgacttgccgacttagctgcttctggtgttttgaccttggtaaggagagaataaagagataatgggagtgcaatgtttgctgaactggtgctcaataaattgatcgatccccttgatggttctattttgttctcttctgcagtgatgtgaaatgcttgttcgtaactgtggcctgcagttgcagttgccagcaccactgtgcttacaagcttgtgtcgggctgtgggcaagtagtggcgcccatgggcagtttgcaatcatgcggcggccaatctctttctatacgagacatt

SEQ ID NO: 1404 - DNA, 2061 bp, Zea mays
acccctcctccgcccgccaataagtaccgccccgctcgccacctccatctcagaggagagagtcgctctgcactgcacgactcctcccccatctaccactacctgtctacctacccagcccatcgatcacccctcgcaacgcaatggcgctggccaccaactccgccgctgccgcagcagctgccgtatccggcggcgcggcatcccagccgcaccgcgcggccacgttcctcccgctgaagaggcgcaccatctccgccatccacgccgccgacccgtctaagaacaacgggcccgccgtccccgcggccgccgccgctaagtcatctgcctctgcggtggccacgccggagaagaatccggcggcgccggtaaagtgggcggtcgacagctggaagtcgaagaaggcactgcagctcccagagtacccgaaccaggaggagctggacacggtgctcaagaccatcgagacgttcccgccggtggtgttcgccggagaggcgcgccaccttgaggagcgcatggccgaggccgccatgggccgcgccttcatcctccagggcggcgactgcgccgagagcttcaaggagttccacgccaacaacatccgtgacaccttccgtatcctgctccagatgggcgccgtgctcatgttcggtggtcaggtgccggtcgtcaaggtggggaggatggctggccagtttgccaagccaaggtccgaaccgttggaggagagggacggcgtcaagctgccaagctacaggggcgacaacgtcaacggcgacgacttcaccgagaagagccgcgtgccagacccgcagaggatgatccgcgcctactcgcagtcggtggcgacgctcaacctgctccgcgcgttggcgaccggagggtacgctgccatgcagcgcgtcacacagtggaacctcgatttcatggatcacagcgagcaaggtgataggtaccgtgaattggcccatagggtggatgaggctcttgggttcatgactgcagcagggcttacagttgaccacccgataatgacgactactgacttctggacctcgcacgagtgccttctcttaccctacgagcagtctcttacccgtaaagactccaccagtggccttttctacgattgttcggcccacatgttgtgggttggtgagcgcactcgtcaactcgatggagcgcatgttgaattccttcgtggtgttgccaatcctcttggcataaaggtgagcgacaaaatgaaccccagtgacttggtgaagctgattgagattctgaacccttcaaacaaacctggaaggatcaccataattacaaggatgggggcagagaacatgagagtgaagttgcctcatctcatccgtgctgttcgcaatgctggattaattgtcacatggattactgatcctatgcatggaaacaccatcaaggccccttgtggcctgaagactcgtccattcgactcaattctggctgaagtgcgcgcattcttcgacgtgcatgatcaagaaggaagtcacccaggaggcatccaccttgaaatgactgggcagaacgtgaccgagtgcattggtggatcacggactgtgaccttcgatgacctgagcgaccgctaccacacccactgtgacccaaggctgaacgcctcccagtccctggagctcgccttcatcattgcagagaggctcaggaagaggaggatgcggtcggggctcaacaacagcctgcctctgccaccactggctttctaagtagccgaagctgaacagagaaggtagagggatagttgcggcgactcgaaagattacgcctgtttatttgttgatgcttggtgtggaggcctggtgggtgctcttggcacaagttacatgctggggagctataggagggtacctgttgcgttgtggaagacagtagctagtattatgtgttgtaattgtatgccttcgtttcatgttctgggtgcgtgacttgtcgactttgctgcttctggggttctgaccttggtaaggagagaataaagagataatatgagtgcgagatgcttgctga

SEQ ID NO: 1405 - DNA, 2220 bp, Zea mays
tccccaaactacccttcccctctccgttccatttccaccgcctcgtctccacccggcggcaactacccctccgtcgccgctcacggctaccaaccccaccacctcctccgcccgccaataaataccccccgctcgccacctccatttcctcagaggaaacgccctgcacagcacgactcctccccatctaccgctacctttctacctacccatctagcacccctcgctcgcaaatcgcaatggcgctggccaccaactccgccgcagcagccgcggccgtgtccggtggcgtggcatcgcagccgcgccgcgcggccgtgttcctcccgctgaagaggcgtaccatctccgccatccacgccgccgacccgtccaagaacaacgggcccgcggtccccgcggccgcaggcgccaactcctccgcctcggcggtggccacgccggagaagaagccggcagcgcacgggaagtgggcggtctacagctggaggtcgaagaaggcgttgcagctccccgagtacccgaacgcggaggagctggacgcggtgctgaagaccatcgagacgttcccgccggtggtgttcgccggagaggcgcgccgcctcgaggagcgcatggccgaggccgccatgggccgcgccttcgtcctccagggtggcgactgcgccgagagtttcaaggagttccacgccaacaacatccgtgacaccttccgcgtccttctccagatgggcgtcgtgctcatgttcggtggccagatgccggtcgtcaaggtggggaggatggctggccagttcgccaagccaaggtctgagccgttcgaggagaaggacggagttaagctgccgagctacaggggcgacaacgtcaacggcgacgacttcaccgagaagagccgcgtgccggacccgcagaggatgatccgcgcctacgcacagtcggtggcgacactcaacctgctccgcgcgttcgccaccggagggtacgctgccatgcagcgcgtcactcagtggaacctcgatttcatggatcacaacgagcaaggtgataggtaccgtgaattggcccatagggtggatgatgctcttgggttcatgactgcatcggggcttacagtcgaccacccgataatgacgactactgacttctggacctcgcacgagtgccttctcttaccctacgagcaggctcttacccgtgaggattccaccagtggccttttctatgattgttcggcccacatgttgtgggttggtgagcgcactcgacaactcgatggagctcatgttgaattcctccgtggtgttgccaaccctctgggcataaaggtgagcgacaaaatgaaccccagtgagttggtgaagctgattgatattctgaacccttcaaacaaacctggaaggatcaccataattacaaggatgggggcagagaacatgagggtgaagttgcctcatctcatccgtgctgttcgcaatgctggactgattgtcacatggattactgatcctatgcatggaaacaccatcaaggccccttgtggcctgaagactcgtccatttgactccattctggctgaagtgcgtgccttcttcgatgtgcatgaccaagaaggaagccaccctgggggcgtccaccttgaaatgactgggcagaacgtgaccgagtgcatcggtggatcacggaccgtgaccttcgacgatctgagcgaccgctaccacacccactgcgacccaaggctgaatgcctcccagtccctggagctcgcctttatcatcgcagagaggctgaggaagaggaggatgcgatcggggctcaacagcagcctgccactgccgccactggctttctgagtagccggagccaaacacaaaggagggtaggaatagctgtggtgactcggaagagaaagagacagtcgacgccttgttttgttgatgcttagtgtggtgacctggtggtggtggtggtgggtgttcttggcacaagttacatgctggggatagctataggaggtacctgttgaggtgtgtaagacagtagctagcaaccgtatgccttggtttcctgtttgggtgcgtgacttgccgactttctagctgcttctggggttttgacctcggtaaggaaagaataaaaagataatcggagtgcaatgcttgctgaactggtgctcaataaattgatcccttgatgcctctattttcttcttttgtgttt

SEQ ID NO: 1406 - DNA, 1776 bp, Secale cereale
aggccgccgccgcggcgcggcccgcgagctggtctgtcgacagctggaggaagaagaaggcgctgcagctccccgagtaccccaacaaggaggagctcgacgccgtcctcaagacgatcgagacgttcccgcccatcgtcttcgccggggaggcgcgccacctcgaggagcgcctcgccgaggccgccatgggccgcgccttcgtcctccagggtggcgactgcgccgagagcttcaaggagttcaacgccaacaacatccgtgacaccttccgtgtgctgctccagatgggcgccgtcctcatgttcggcggccaggtccccgtcgtcaaggtgggacggatggccggtcagttcgccaagcccaggtctgacaacttcgaagagaaggacggcgttaagctgccgagttacaggggcgacaacgtcaacggcgacgccttcgacctcaagagccgcacgcctgaccccgataggatgatcagggcgtacgcccagtcggtggcgacgctgaacttgctccgcgctttcgcgaccggaggctacgcagctatgcagcgggtcatccagtggaaccttgatttcatggatcacaacgagcagggagacaggtaccgtgagttggcacatagggtggacgaggctcttggcttcatgacagcagctgggctggggatggaccatccgataatgacgactactgacttctggacatcccacgagtgtctcctcttgccatatgagcaggctcttactcgtgaggactccacaagtggccttttctatgactgctcggctcatatggtgtgggttggtgagcgtactcgtcaactcgatggggctcatgttgaattcctccgtggtattgccaaccctcttggcattaaggtgagcgacaagatgaaccctgctgaattggtgaagctgattgacattttgaacccttcaaacaagccgggaaggatcaccataattacaaggatgggggctgagaacatgagggtgaagttgcctcatctcatccgtgctgtccgcaactctggacagattgtcacatggattacggaccccatgcacggaaacaccatcaaggccccatgtggcctgaagactcgtccatttgactctattatgaatgaggtgcgtgcattcttcgacgtgcatgaccaagaaggcagccacccaggaggcatccaccttgaaatgactggacagaatgtgaccgagtgcatcggtggatcacggaccgtgaccttcgatgacctgggtgaccgctaccacacccactgtgacccaaggctgaacgcgtcgcagtctctggagctcgctttcatcatcgccgagagactcaggaagaggaggatgaagtcaggactcgccaacaacctgccactgcccccattggctttctaagcaggaagcagcagggaggaggggttagatagttggcatttgcaagcggtatccaaatgcgcattccattgagtttgtatggtgggctgctctttgcacaagctgtgtgcttatgaggtattggtacttgtcgaggacagcagggggtagcgtactcgtcgtgttgcactatgttttgtttctttgttttatttttgagtgtttgatctgtttgagcctttgtgatcggagaaaataaagataatatgagttaccttcgttaatttatttatttctcattgttccatctgtgggggatgtaatctgtcctctcaaacatatcaaacattttttgaaatcgtaaacatttttccaaaaaaaaaaa

SEQ ID NO: 1407 - DNA, 2176 bp, Setaria italica
ggtcgcttcgtccaacaaccgcgccaccacctccctcacggtctcgctccacctactctccggcccgccccgggcggctccggccgcgtataagtagcctacgccccgctcccctccgacccaggagacaccgcgcccgccacacgcacgcatcgcctcctccactacccgaaccgtaacacccgattagattgcattctgtgatttctctgttctccgcaatggcgctcgccaccaacgccgccgccgccgccgccgcggcagcagccatctccggcgcggccgcgtcgcagcccagccgcgctccgtcgttcctcccgatgaggcgccgctgcgccgtccgcgccgtgcacgccgcggagccgtcgaagagccacggcgtcccggcggcggcgaagacctcggcgccgacggtcgcgcccgagaaggaggcggcccctgtcgcggccccggccccggccccggccccgaaggcgcctgcgaagtgggcggtggacagctggaggtcgaagaaggccctgcagctgccggagtacccgaacgcggcggagctggaggccgtgctcaagacgatcgaggccttcccgccgatcgtgttcgccggggaggcgcgccacctcgaggagcgcctcgccgacgccgccatgggccgcgccttcctcctccagggcggcgactgcgccgagagcttcaaggagttcaacagcaacaacatccgcgacaccttccgcgtcctcctccagatgtccgccgtcctcatgttcggcgcccaaatgcccgtcgtcaaggttggtaggatggccgggcaattcgccaagccgaggtcggacccgtttgaggtcagggacggggtgaagctgcccagctaccggggcgacaacatcaacggcgaggcgttcgacgagaagagccgcgtccccgacccgcagaggatgatcagggcgtacgcccaatccgccgccacgctcaacctgatccgtgcgttcgccaccggagggtacgccgccatgcagcgcgtcacgcagtggaacctcgatttcaccgaacacagcgagcagggcgacaggtaccgtgaattggcacatcgggttgatgaagcccttggcttcatgtctgcagctgggctaacagcggaccacacgttgatgaagactactgaattctggacctcacatgaatgcctcctcctaccctacgaacaagctctaacccgtcaggattccacctctggtcttttctatgattgctctgcccacatgctctgggttggcgagcgcactcgccagcttgatggtgctcatgttgagttcctaaggggcattgccaacccccttggcatcaaggtgagtgacaaaatgaaccccagcgatttggtgaagctgattgagatattgaatccatcaaacaagcctgggagaattaccatcattacaaggatgggggcggagaacatgagggtcaagttacctcatcttattcgtgctgtccgccaagcaggactaattgtcacatggatcactgatcccatgcacggtaacaccatcaaggctccttgcggtctaaagactcgccccttcgactccattttggctgaggtacgggccttttttgatgtgcacgagcaagagggaagccacccaggaggcgtccaccttgagatgactgggcaaaacgtaactgaatgcatcggtggatcacgcaccgtgacttttgatgacctgagcgaccgctaccacactcactgcgacccaaggttgaacgcgtcccagtcgctggagctctcatttatcattgccgagaggctgaggaagaggaggatccggtcatcgtctggtctcaacaacatcttgcccttgccgccttttggtttctgaatgggtagacagggccagcaagagagatgtgtgtattccatttgttggtagttgctcttggtaaaactatatgcctatgagctgtccgcactccaggatggatctgttcgattttttttatcttttgtgtgggtaaatactatgtaatgcatatgactgcacttgtcgacactaagttttctatttataccatatatgagagaataataatgaaatatagatgagttggcgttgtgaataactggcaactgatctcttcaactcgctttcagccttccagttgatttttatccttttacaga

SEQ ID NO: 1408 - DNA, 1939 bp, Setaria italica
tgatttctctgttctccgcaatggcgctcgccaccaacgccgccgccgccgccgccgcggcagcagccatctccggcgcggccgcgtcgcagcccagccgcgctccgtcgttcctcccgatgaggcgccgctgcgccgtccgcgccgtgcacgccgcggagccgtcgaagagccacggcgtcccggcggcggcgaagacctcggcgccgacggtcgcgcccgagaaggaggcggcccctgtcgcggccccggccccggccccggccccgaaggcgcctgcgaagtgggcggtggacagctggaggtcgaagaaggccctgcagctgccggagtacccgaacgcggcggagctggaggccgtgctcaagacgatcgaggccttcccgccgatcgtgttcgccggggaggcgcgccacctcgaggagcgcctcgccgacgccgccatgggccgcgccttcctcctccagggcggcgactgcgccgagagcttcaaggagttcaacagcaacaacatccgcgacaccttccgcgtcctcctccagatgtccgccgtcctcatgttcggcgcccaaatgcccgtcgtcaaggttggtaggatggccgggcaattcgccaagccgaggtcggacccgtttgaggtcagggacggggtgaagctgcccagctaccggggcgacaacatcaacggcgaggcgttcgacgagaagagccgcgtccccgacccgcagaggatgatcagggcgtacgcccaatccgccgccacgctcaacctgatccgtgcgttcgccaccggagggtacgccgccatgcagcgcgtcacgcagtggaacctcgatttcaccgaacacagcgagcagggcgacaggtaccgtgaattggcacatcgggttgatgaagcccttggcttcatgtctgcagctgggctaacagcggaccacacgttgatgaagactactgaattctggacctcacatgaatgcctcctcctaccctacgaacaagctctaacccgtcaggattccacctctggtcttttctatgattgctctgcccacatgctctgggttggcgagcgcactcgccagcttgatggtgctcatgttgagttcctaaggggcattgccaacccccttggcatcaaggtgagtgacaaaatgaaccccagcgatttggtgaagctgattgagatattgaatccatcaaacaagcctgggagaattaccatcattacaaggatgggggcggagaacatgagggtcaagttacctcatcttattcgtgctgtccgccaagcaggactaattgtcacatggatcactgatcccatgcacggtaacaccatcaaggctccttgcggtctaaagactcgccccttcgactccattttggctgaggtacgggccttttttgatgtgcacgagcaagagggaagccacccaggaggcgtccaccttgagatgactgggcaaaacgtaactgaatgcatcggtggatcacgcaccgtgacttttgatgacctgagcgaccgctaccacactcactgcgacccaaggttgaacgcgtcccagtcgctggagctctcatttatcattgccgagaggctgaggaagaggaggatccggtcatcgtctggtctcaacaacatcttgcccttgccgccttttggtttctgaatgggtagacagggccagcaagagagatgtgtgtattccatttgttggtagttgctcttggtaaaactatatgcctatgagctgtccgcactccaggatggatctgttcgattttttttatcttttgtgtgggtaaatactatgtaatgcatatgactgcacttgtcgacactaagttttctatttataccatatatgagagaataataatgaaatatagatgagttggcgttgtgaataactggcaactgatctcttcaactcgc

SEQ ID NO: 1409 - DNA, 2002 bp, Pennisetum glaucum
gatctgcggtgcgtgcgtgtggcgggcgcggtgtctcctccactatccgagatcattgcattctgtgatttctgtcccgcaatggcgctcgccaccaacgccgccgccgcggcagcagccatatccggcgcggcctcttcccagcccagccgagctccgtcgttcctcccgctgaggcgccgctgcgccgtccgcgccgtgcacgccgcggagccgtccaagagccacggcgtcccggcggcggcgaagaccttggcgccgaccgtcgcgcccgagaaggaggcgccccccgccgcggccccggccccgaaggcgcacgcgaagtgggcggtggacagctggaggtcgaagaaggccctgcagctgccggagtacccgaacgcggcggagctggaggccgtgctcaagacgatcgaggcgttcccgccgatcgtgttcgccggggaggcgcgccacctcgaggagcgcctcgccgacgccgccatgggccgcgccttcctcctccagggcggcgactgcgccgagagcttcaaggaattcaacagcaacaacatccgcgacaccttccgcgtcctcctccagatgtccgccgtcctcatgttcggcgcccaaatgcccgtcgtcaaggttggtaggatggccgggcaattcgcgaagccgagatcagacccgttcgaggtcagggacggggtgaagctgcccagctaccggggcgacaacatcaacggcgaggcgttcgatgagaagagccgcgtccccgacccgcagaggatgatcagggcatacgcccaatccgccgcgacgctcaacctgatccgtgcgttcgccaccggagggtacgccgccatgcagcgcgtcacgcagtggaacctcgatttcaccgaacacagcgagcagggcgacaggtaccgtgaattggcacatcgggttgatgaagcccttggcttcatgtctgcagctgggctaacagcggaccacccgttgatgaggaccactgaattctggacctcgcacgaatgcctcctcctaccctatgaacaagctctaacccgtcaggattctacctctggtcttttctatgactgctctgctcacatgctctgggttggtgagcgcactcgccagcttgatggtgcccatgttgagttcctaaggggcattgccaaccctcttggcatcaaggtgagtgacaaaatgaaccccggcgatttggtgaagctgattgagatattgaacccaacaaacaagcctgggagaattaccatcattacaaggatgggggcagagaacatgagggtcaagttacctcatcttattcgtgctgtccgccaagcaggactaattgtcacatggatcactgatcccatgcatggtaacaccatcaaggctccttgcggtctaaagactcgccccttcgactccattttggctgaggtacgggccttttttgatgtgcacgagcaagagggaagccacccaggaggtgttcaccttgagatgactgggcaaaacgtaactgaatgcattggtggatcacgcaccgtgacttttgatgacctgagcgaccgctaccacactcactgcgacccaaggttgaatgcatcccaatcgctagagctctcatttatcattgctgagaggctgaggaagaggaggatccggtcatcgtctggtctcaacaacatcttgcccttgccatcttttggtttctgaatgggtagacagagccagcaagagagatgtatgtattccatttgttggtagttgctcttggtaaaactatatgcctatgagctgtccgcactgcaggaacgatggatctgtttgattttttttaatattttgtgtgggtaaatactatgtaatgctacatatatgactgcactcgtcgacactaagttttctatttatacaggaccctgtatgagagaataatgatgaaatatagatgagttggcattagtaaagaaaaaaaaaaaaaaaaaaaaagtaactactagta

SEQ ID NO: 1410 - DNA, 2028 bp, Saccharum officinarum
ccgcgcccgccatacgcccgcaccgcctcctccgctacccgtctacgcgaaccctaacgttagattaaactgtcctcgccgctgcattccgttccgcaatggccctcgccaacaccgccgccgcggcagccgccatctccggcgggtccgcatccgcctcacagccccgccgcgcgccgccgtctctcctcccgctgaggcgccgctgcgccgtccgcgccgtgcacgccgcggagccgtcgaagaaccccggcgtcgtcgtcccggccgccgccaagacctcatcgccgacgacggtcgcgcccgagaacgacgcggccccggcccgtgccccgaaggcggcggcgaagtgggcggtggacagctggaggacgaagaaggcgctgcagctgccggagtacccgaacccgtcggagctggaggcggtgctcaagaccatcgaggcgttcccgcccatcgtcttcgccggggaggcgcgccacctggaggagcgcctcgccgacgccgccatgggccgcgccttcctcctccagggcggcgactgcgccgagagcttcaaggagttcaacagcaacaacatccgcgacaccttccgcgtcctcctgcagatgtccgccgtcctcatgttcggcgcccagatgcccgtcttcaaggttggtaggatggccggccaattcgcgaagccgaggtcggaggcgttcgaggtcagggacggcgtcaagctggccagctaccggggcgacaacatcaacggcgaggcgttcgacgagaagagccgcgtccccgatccacagaggatgatccgcgcgtacgcccagtccgccgccacgctcaacctgctccgcgccttcgccaccggaggctacgccgccatgcaacgcgtcacgcagtggaacctggatttcaccgaacacagcgagcagggcgacaggtaccgtgaattggcacatcgggttgatgaagccctcggcttcatgtctgcagctggcctaacaccggaccaccctttgacgacgacgactgagttctggacctcacatgagtgcctcctcctaccttacgagcaagctttaacccgtcaagactccacctctggtcttttctacgattgctctgcccacatgctctgggttggtgagcgaactcgccagcttgatggtgcccatgttgagttcctcaggggtattgccaaccctcttggcatcaaggtaagtgacaaaatgaaccccagcgacttggtgaagctgattgatatactgaacccaacaaacaagcccgggaggatcaccgttattacaaggatgggggcagagaacatgagggtcaagttacctcaccttatccgtgcagtccgccaggctggacaaattgtcacctggatcactgatccgatgcacgggaacaccatcaaggctccctgcggtctaaagactcgtccatttgacaacattctggctgaggtacgggccttctttgatgtgcacgagcaagagggaagccaccctggaggtgtccaccttgagatgactgggcaaaacgtaactgaatgcattggcgggtcacgcaccgtgaccttcgatgacctgagcgaccgctaccacacccactgtgaccccaggctgaacgcgtcccagtcgctggagctcgcgttcataatcgctgagaggctgaggaagaggaggatccggtcatcgtctgggctcaacaacatcttgcccttgccgccttttggtttctgaaatctgaatgggtaaacggggccggaaggagagatgtcagatgtgtgtgcatgtattccattcgttggtgtctgctcttggtaaaaatcatatgccctgagcttagtgcatgctggggaggagctgcttgaatttttatcgtttgccttggtaaatactagtactatgtaatgctatgactgcattcgtcggcactaagttttctatttatatcatgtatgtataagagaataatagtgccatgtagaggagttggctttgtgaataagttactgtcagagtgtcagtt

SEQ ID NO: 1411 - DNA, 2159 bp, Sorghum bicolor
ctccgacccaggagacaccgcgcccgccaccaccagacgcacgcaccgcctcctccgctacccgatcgatccaagtaaccctagcgctagattaaaccgtgtcctcgatcgccgccgctgcattccgtttccgcaatggcgctctccaccaacgccgccgccgccgccgccgccatctccggcgggtccgcgtccgcgtcgcagccggcccgtcgcacgccctcgtctctcctcccgctgacgcgccgccgccgcgccgtcgtccgcgccgtgcacgccgcggagccgtcgaagaaccccggcgtcgtcgtcccggccgccgccaaggcctcgtcgccgacgacggtcgcgcctgagaacgacgcggcccctgctccggccccggcccgtgcgccggcgaagtgggcggtggacagctggaggacgaagaaagcgctacagctgccggagtatccgaacccggcagagctagaggcggtgctcaagaccatcgaggcgttcccacccatcgtcttcgctggggaggcgcgccacctggaagagcgcctcgccgacgccgccatgggacgcgccttcctcctccagggcggcgactgcgctgagagcttcaaggagttcaacagcaacaacatccgcgacaccttccgcgtcctcctgcagatgtccgccgttctcatgttcggcgcccagatgcccgtcgtcaaggttggtaggatggccggccaattcgcgaagccaaggtcggatccgttcgaggttagagatggcgtcaagctgcccagctaccggggcgataacattaatggcgaggcattcgacgagaagagccgtgtccccgacccacagaggatgatccgcgcgtatgcgcagtctgccgcaacgctgaacttgctccgcgccttcgccaccggaggctacgctgccatgcagcgcgtcacgcagtggaacctcgatttcaccgaacacagcgagcagggcgacaggtaccgtgaattggcacatcgggttgatgaagcccttggcttcatgtctgcagctggcctaacaccggaccaccctttgacgacgaccactgagttctggacctcacatgagtgcctcctcctaccttacgagcaagctttaacccgtcaagactccacctctggtcttttctacgattgctctgcccacatgctctgggttggtgagcgcactcgccagcttgatggcgcccatgttgagttcctcaggggtattgccaaccctcttggcatcaaggtaagtgacaaaatgaaccccagcgacttggtgaagctgattgatatactgaacccaacaaacaagcccgggaggatcaccgttattacaaggatgggggcagagaacatgagggtgaagttacctcaccttatccgtgcggtccgccaggctggacaaattgtcacctggatcactgacccgatgcacggcaacaccatcaaggctccttgtggtctaaagactcgtccatttgacaatattctggctgaggtacgggccttctttgatgtgcacgagcaagaggggagccaccctggaggtgtccaccttgagatgactgggcaaaacgtaactgaatgcattggcgggtcacgcaccgtgaccttcgatgacctgagcgaccgctaccacacccactgtgaccccaggctgaacgcgtcccagtctctggagctcgcgttcattatcgccgagaggctgaggaagaggaggatccggtcatcgtccgggctcaacaacatcttgcccttgccgccttttggtttctgatgaatcggtagacggggccagaagaaggagagatgtgtgcatgtattccattcgttggtgttatgctcttggtaaaaaatcatatgccctgagcttagtagtgcacgctggggaggagctgcttgaatttttatcgtttgccttggtaaatactactgctatgtaatgctatgactgcattcgtcgacactaagttttctatatatttatatatcttgtatgtataagagaataatactgccatgtagaagagttggctttgtgaataagttactgtcagttgtttgcttccactcgccttcagccttccacttggtttgtccttttttcagaactgaaagggaaagggtgagctcaataagcatatc

SEQ ID NO: 1412 - DNA, 2357 bp, Sorghum bicolor
cggcagccatcccagaaaagaatcacccgcttctcctgcttcaccagcgggtcgcttcatccaactaccgcgcggcttctcatctcatctcacgtctccgctctcaccaactccggctccggccgcgtataagtaaccccgacccccgctgcgctccgacccaggagacaccgcgcccgccaccaccagacgcacgcaccgcctcctccgctacccgatcgatccaagtaaccctagcgctagattaaaccgtgtcctcgatcgccgccgctgcattccgtttccgcaatggcgctctccaccaacgccgccgccgccgccgccgccatctccggcgggtccgcgtccgcgtcgcagccggcccgtcgcacgccctcgtctctcctcccgctgacgcgccgccgccgcgccgtcgtccgcgccgtgcacgccgcggagccgtcgaagaaccccggcgtcgtcgtcccggccgccgccaaggcctcgtcgccgacgacggtcgcgcctgagaacgacgcggcccctgctccggccccggcccgtgcgccggcgaagtgggcggtggacagctggaggacgaagaaagcgctacagctgccggagtatccgaacccggcagagctagaggcggtgctcaagaccatcgaggcgttcccacccatcgtcttcgctggggaggcgcgccacctggaagagcgcctcgccgacgccgccatgggacgcgccttcctcctccagggcggcgactgcgctgagagcttcaaggagttcaacagcaacaacatccgcgacaccttccgcgtcctcctgcagatgtccgccgttctcatgttcggcgcccagatgcccgtcgtcaaggttggtaggatggccggccaattcgcgaagccaaggtcggatccgttcgaggttagagatggcgtcaagctgcccagctaccggggcgataacattaatggcgaggcattcgacgagaagagccgtgtccccgacccacagaggatgatccgcgcgtatgcgcagtctgccgcaacgctgaacttgctccgcgccttcgccaccggaggctacgctgccatgcagcgcgtcacgcagtggaacctcgatttcaccgaacacagcgagcagggcgacaggtaccgtgaattggcacatcgggttgatgaagcccttggcttcatgtctgcagctggcctaacaccggaccaccctttgacgacgaccactgagttctggacctcacatgagtgcctcctcctaccttacgagcaagctttaacccgtcaagactccacctctggtcttttctacgattgctctgcccacatgctctgggttggtgagcgcactcgccagcttgatggcgcccatgttgagttcctcaggggtattgccaaccctcttggcatcaaggtaagtgacaaaatgaaccccagcgacttggtgaagctgattgatatactgaacccaacaaacaagcccgggaggatcaccgttattacaaggatgggggcagagaacatgagggtgaagttacctcaccttatccgtgcggtccgccaggctggacaaattgtcacctggatcactgacccgatgcacggcaacaccatcaaggctccttgtggtctaaagactcgtccatttgacaatattctggctgaggtacgggccttctttgatgtgcacgagcaagaggggagccaccctggaggtgtccaccttgagatgactgggcaaaacgtaactgaatgcattggcgggtcacgcaccgtgaccttcgatgacctgagcgaccgctaccacacccactgtgaccccaggctgaacgcgtcccagtctctggagctcgcgttcattatcgccgagaggctgaggaagaggaggatccggtcatcgtccgggctcaacaacatcttgcccttgccgccttttggtttctgatgaatcggtagacggggccagaagaaggagagatgtgtgcatgtattccattcgttggtgttatgctcttggtaaaaaatcatatgccctgagcttagtagtgcacgctggggaggagctgcttgaatttttatcgtttgccttggtaaatactactgctatgtaatgctatgactgcattcgtcgacactaagttttctatatatttatatatcttgtatgtataagagaataatactgccatgtagaagagttggctttgtgaataagttactgtcagttgtttgcttccactcgccttcagccttccacttggtttgtccttttttcagaactgaaagggaaagggtgagctcaataagcatatcccgacttcccgagggaggtgaaagtactgcagaaattctataagg

SEQ ID NO: 1413 - DNA, 1875 bp, Setaria italica
ccgccgtccccgccgccgccgcctcctccaaggcctcgtcctttgcggtggcgacgccggagaagaagccggcggcgcaagggaagtggacggtagacagctggaagtcgaagaaggcgctgcagctccccgagtacccgagccaggaggagctggactccgtgctcaagacgatcgagacgttcccgccggtggtgttcgccggggaggcgcgccacctcgaggagcgcctcgccgaggccgccatgggccgcgccttcgtcctccagggtggagattgcgctgagagcttcaaggagttccacgccaacaacatccgtgacaccttccgcatcctgctccagatgggcgctgtcctcatgttcggcggtcaggtcccggtcgtcaaggtggggaggatggctggccagttcgccaagccaaggtccgaggcattcgaggagagggacggcgttaagctgccgagctacaggggcgacaacgtgaacggagacgatttcaccgagaagagccgcgtgccggacccgcagaggatgatccgcgcctacgcgcagtcggtggccacgctcaaccttctccgcgcgttcgcgactggaggctacgctgctatgcagcgcgtcacacagtggaatctcgatttcatggatcacagcgagcaaggtgataggtaccgtgaattggcccatagggtggatgaggctcttggattcatgactgcagcggggcttacagttgaccacccgataatgacgactactgacttctggacctcgcacgagtgccttctcttaccatacgagcaggctcttacccgtgaggactccaccagtggccttttctatgattgttcggcccacatgctgtgggttggggagcgcactcgccaacttgatggggctcatgttgaattcctcagaggtgttgccaaccctcttggcataaaggtgagtgacaaaatgaaccccagtgacttggtgaagctgattgagattttgaacccttcaaacaagcctggaagaatcaccataattacaaggatgggggcagagaacatgagagtgaagttgcctcatcttatccgtgctgtccgcaatgctggactgattgtcacatggattactgatcctatgcatggaaacacaatcaaggccccttgtggtttgaagactcgtccattcgactccattcttgctgaagtacgtgcattcttcgatgtgcatgaccaagaagggagccacccaggaggtatccacctggagatgactgggcagaacgtgactgagtgcattggtggatcacggaccgtgaccttcgatgacctgagcgaccgctaccacacccactgtgacccaaggctgaacgcctcccagtcccttgagcttgccttcatcattgccgagaggctcaggaagaggaggatgcggtcagggctcaacaacagcctgccgctgccactggctttctaaagtgccgaaaccaaacagagagggtagaatagttgcgacaacttgaaagcagtgaccgatgcctattcattcgttggtgcttggtatggtgggtgctcttggcacaagttacatgctcttgagctataggaggcacttgtggagctgtggaagacagtagctagcattatgtgttgtaatagtactatgtttttgtttgatgttttgggtgtgcgacttgccgacttagctgtttctggggttttgaccttggtaaggagaaaataaaagagataatgggattgcaatgcctagtgaactggtactcaataaattgatcccttgatggttctgtttggttatcttctgaggcgcctctctcagattcagtgatgtgaaatgtttgtttgtgtggttcctgctctttcgg

SEQ ID NO: 1414 - DNA, 1723 bp, Panicum virgatum
gcctccaaggcctcgacctcggcggtggcgacgccggagaagccggcgccgcaagggaagtgggcgatcgacagctggaagtcgaagaaggcgctgcagctccccgagtacccgaaccaggaggagctggacaccgtgctcaagacgatcgagacgttcccgccggtggtgttcgccggggaggctcgccacctcgaggagcgcctggcggaggccgccatgggccgcgccttcgtcctccagggcggagactgcgccgagagcttcaaggagttccacgccaacaacatccgtgacaccttccgtatcctgctccagatgggggccgtgctcatgttcggcggtcaggtgccggtcgttaaggtggggaggatggctggccagttcgccaagccaaggtccgagccattcgaggagagggacggcgttaagctgccgagctacaggggcgacaacgtgaacggagacgatttcaccgagaagagccgtgtgccggacccgcagaggatgatccgcgcctacgcgcagtcggtggccactctcaacctgctccgcgcgttcgcgactggagggtacgctgctatgcagcgcgtcacacagtggaatctcgacttcatggatcacagcgagcaaggtgataggtaccgtgaattggctcatagggtggatgaggctcttggattcatgactgcagcggggcttacagttgatcacccgataatgacgactactgacttctggacctcccacgagtgccttctcttaccatacgagcaggctcttacccgtgaggactccaccagcggccttttctatgattgttcagcccacatgttatgggttggtgagcgaactcgccaacttgatggtgctcatgttgaattcctcagaggtgttgccaaccctcttggcataaaggtgagcgacaaaatgaaccccagtgacttggtgaagctgattgagattttgaacccttcaaacaagcctggaaggataaccataattacaaggatgggggcagagaacatgagagtgaagctgcctcatctcatccgtgctgtccgcaatgctggcctgattgtcacatggattactgatcctatgcatggaaacacaatcaaggccccttgtggtttgaagacacgtccatttgactctattctggctgaagtgcgtgcattcttcgacgtgcatgaccaagaagggagccacccaggaggtatccacctggagatgacagggcagaacgtgaccgagtgcattggtggatcacggaccgtgaccttcgatgacttgagcgaccgctaccacacccactgtgacccaaggctgaatgcctcccagtccgtggagcttgccttcatcattgccgagaggctcaggaagaggaggatgcggtcaggactcaacaacagtctgccgctgccaccactggctctctaaatggctgatgctgaatagagagggtaggaatagttgcgacgacttgaaagcggtggccgatgcctatttattcgttggagggtgctcttagcgttaagttacatgctcgtgagctataggtgtaaaactatgtttttgtttgatgctttgggtgtgagacttgccgacttagctgtttctgttgttttgaccttggtaaggagaaaataaagagagaatgagattgcaacgcttgatgaactgtcctcaataaattgatcccgtggttctgtttggttct

SEQ ID NO: 1415 - DNA, 1822 bp, Saccharum officinarum
ccaagtcctccgcctcggcggtggccacgccggagaagaagcctgcggcgccggggaagtgggcggtcgacagctggaagtcgaagaaggcgctgcagctccccgagtacccgaaccaggaggagctggacacggtgctcaagaccatcgagacgttcccgccggtcgtgttcgccggtgaggcgcgccacctcgaggagcgcatggccgaggccgccatgggccgcgccttcgtcctccagggcggcgactgcgccgagagcttcaaggagttccacgccaacaacatccgtgacaccttccgtatcctgctccagatgggcgccgtgctcatgttcggtggtcaggtgccggtcgtcaaggtggggaggatggctggccagttcgctaagccaaggtccgaaccgttcgaggagagggacggcgttaagctgccgagctacaggggcgacaacgtcaacggcgacgacttcaccgagaagagccgcgtgccggaccctcagaggatgatccgcgcctacgcgcagtcggtggcgacgctcaacctgctccgcgcgttcgcgaccggagggtatgctgccatgcagcgcgtcacacagtggaacctcgatttcatggatcacagcgagcaaggtgataggtaccgtgaattggcccatagggtggatgaggctcttgggttcatgactgcagcaggacttaccgttgaccacccgataatgacgactactgacttctggacctcgcacgagtgccttctcttaccctacgagcaggctcttacccgtgaggactccaccagtggccttttctatgattgttcagcccacatgttgtgggttggtgagcgcactcgtcaacttgatggagctcatgttgaattcctccgtggtgtggccaaccctcttggcataaaggtgagtgacaaaatgaatcccagtgacttggtgaagctgattgagattctgaacccttcaaacaaacccggaaggatcaccataattacaaggatgggggcagagaacatgagagtgaagttgcctcatctaattcgtgctgtccgcaatgctggattgattgtcacatggattactgatcctatgcatggaaacaccataaaggccccttgtggcttgaagactcgtccttttgactccattctggctgaagtgcgcgcattcttcgacgtgcatgaccaagaaggaagtcacccaggaggcatccaccttgaaatgactggccagaacgtgaccgagtgcattggtggatcacggactgtgaccttcgatgacctgagcgaccgctaccacacccactgtgacccaaggctgaacgcctcccagtccctagagctcgccttcatcattgcagagaggctcaggaagaggaggatgcggtcggggctgaacaacagcctgccactgccaccactggctttctaaatagccggagccgaacagagagggtaggaatagttgcggcgactcgaaagaggcgatcgatgcctatttatttgttgatgcttggtgtggtggcctggtgggtgctcttggcacaagttacatgctggggagctataggaggtacttgtgttgtggaagacagtagctagcattatgtgttgtcgcaattgtatgccttcgtttcctgttttggatgcgtgacgtgccgacttagctggttctggtgttttcaccttggtaaggagagaataaagagatactgggaatgcaatgtttgctggtgctcaataaattgatcccctttgagggttctaccctgataacaaactctctaatgcaggcatccctcccctagttaa

SEQ ID NO: 1416 - DNA, 1908 bp, Brachypodium distachyon
cccgatcgccgccgccaccgccggcattccgtccgcaatggcactcgccaccaaccacgccgccgccgccatatcgtccggagccgccgcccctcagccccgccgcgccccttcgttcctcccgctgaagcgccgcacaatctgcgccgtccacgccgcggagccctcgaagagcgccgccgccgccccggccgcggcgaagacctcttcgccgtcggtggcgccggagaagtccgcgataccggacccgaaaccggaggcgcccgcggtgccagcaaagtggacggtggacagctggagggcgaagaaggctcttcagctgccggagtaccccaacgccgcggagctggagtcggccctcaagacgatcgaggcgttcccgccgatcgtcttcgccggggaggcgcggcacctggaggagcgcctcgccgacgccgccatgggccgggccttccttctccaaggaggcgactgcgccgagagcttcaaggagttcaacggcaacaatatccgcgataccttccgcgtcctgcttcagatgtctgccgtcctcacctttggcggtcaaatgcccgtcatcaaggttgggagaatggccggccaattcgcaaagccgaggtcggattcgttcgaggtaagggatggggtgaagctgccgagctaccgaggggacaacatcaacggtgatgctttcaacgaaaagagccgcatccccgatccccagaggatgatcagggcctacacccagtcggccgcgacactcaacctcctccgcgcgttcgccatgggagggtacgctgccatgcaacgggtcacccagtggaacctcgatttcactgaaaacagcgagcagggcgacaggtaccgagaattggcacacagggttgatgaagcccttggcttcatgtctgcagctgggctaacattggatcaccctgttatgtcgagtactgaattctggacctctcatgagtgcctactcctaccgtatgagcaagctttgacccgccaggactcgacctctggtcttttctatgactgttctgcccacatgctttgggtcggtgaacgcactcgccagctcgatggtgctcatgttgagttcctcaggggtgttgctaaccctcttggtatcaaggtgagtgacaaaatgaaccctgctgacttggtaaaactgattgacatattgaacccaacaaacaagcctgggagaattaccatcattacaagaatgggggcggagaacatgagggtcaagttacctcatcttatccgtgctgtccgccatgctggtcaaattgtcacctggatcactgatcccatgcatgggaacactatcaaggctccttgcggtctgaagacacgcccctttgactccattctggctgaggtcagggcgttcttcgatgttcatgagcaagaaggtagccacgcaggaggcgtccaccttgagatgactgggcagaatgtgacagagtgcattggtggatcccgaaccgtgaccttcgatgacctgggcgaccgctaccacacccactgtgacccgaggctgaatgcatcccagtctctggagctctccttcatcattgctgagaagctgaggaagaggaggatccgctcgtcgaagcttaacagcgtcttgccattgccaacctatggtttctgaaacacgtaaccagtgaggaatgaatgggttagatagttgcagcagctttcgacgcgtattccatttgttggcgtggtatcttgataaaagtcatatactgattgtaagctttctgtgcgccagggaggatctgtagttaaatttgtgatggtctattatagtacaattttatgtatggtttcgacactcttcctatttatttcatctataagagaataatgagattgaaagcattgtgaacg

SEQ ID NO: 1417 - DNA, 2228 bp, Brachypodium distachyon
accaggatatccctccctgctctttccttcctcctcccgtccgtcccgggtcgcttcgtccaactaccgcgccaccctcccctcccactcaccaaccccgcctccgactgaccggctccggccagctataaatagcgcgccccactccccgatagcttcaggagagaccgcgcccaccacgcaccccctcccctcacctcacctccactcgcgcattgcattaccgcaaaacccagattcgccaacccgatcgccgccgccaccgccggcattccgtccgcaatggcactcgccaccaaccacgccgccgccgccatatcgtccggagccgccgcccctcagccccgccgcgccccttcgttcctcccgctgaagcgccgcacaatctgcgccgtccacgccgcggagccctcgaagagcgccgccgccgccccggccgcggcgaagacctcttcgccgtcggtggcgccggagaagtccgcgataccggacccgaaaccggaggcgcccgcggtgccagcaaagtggacggtggacagctggagggcgaagaaggctcttcagctgccggagtaccccaacgccgcggagctggagtcggccctcaagacgatcgaggcgttcccgccgatcgtcttcgccggggaggcgcggcacctggaggagcgcctcgccgacgccgccatgggccgggccttccttctccaaggaggcgactgcgccgagagcttcaaggagttcaacggcaacaatatccgcgataccttccgcgtcctgcttcagatgtctgccgtcctcacctttggcggtcaaatgcccgtcatcaaggttgggagaatggccggccaattcgcaaagccgaggtcggattcgttcgaggtaagggatggggtgaagctgccgagctaccgaggggacaacatcaacggtgatgctttcaacgaaaagagccgcatccccgatccccagaggatgatcagggcctacacccagtcggccgcgacactcaacctcctccgcgcgttcgccatgggagggtacgctgccatgcaacgggtcacccagtggaacctcgatttcactgaaaacagcgagcagggcgacaggtaccgagaattggcacacagggttgatgaagcccttggcttcatgtctgcagctgggctaacattggatcaccctgttatgtcgagtactgaattctggacctctcatgagtgcctactcctaccgtatgagcaagctttgacccgccaggactcgacctctggtcttttctatgactgttctgcccacatgctttgggtcggtgaacgcactcgccagctcgatggtgctcatgttgagttcctcaggggtgttgctaaccctcttggtatcaaggtgagtgacaaaatgaaccctgctgacttggtaaaactgattgacatattgaacccaacaaacaagcctgggagaattaccatcattacaagaatgggggcggagaacatgagggtcaagttacctcatcttatccgtgctgtccgccatgctggtcaaattgtcacctggatcactgatcccatgcatgggaacactatcaaggctccttgcggtctgaagacacgcccctttgactccattctggctgaggtcagggcgttcttcgatgttcatgagcaagaaggtagccacgcaggaggcgtccaccttgagatgactgggcagaatgtgacagagtgcattggtggatcccgaaccgtgaccttcgatgacctgggcgaccgctaccacacccactgtgacccgaggctgaatgcatcccagtctctggagctctccttcatcattgctgagaagctgaggaagaggaggatccgctcgtcgaagcttaacagcgtcttgccattgccaacctatggtttctgaaacacgtaaccagtgaggaatgaatgggttagatagttgcagcagctttcgacgcgtattccatttgttggcgtggtatcttgataaaagtcatatactgattgtaagctttctgtgcgccagggaggatctgtagttaaatttgtgatggtctattatagtacaattttatgtatggtttcgacactcttcctatttatttcatctataagagaataatgagattgaaagcattgtgaacgaagtacttgtcaaatgctccctctttgttcaaatttgtcttccgccttgtgaatgagttgcaatgctgccctatg

SEQ ID NO: 1418 - DNA, 1425 bp, Triticum aestivum
gggagggctgtggaggaggtacgcgccgcacaacatgatgatcatggtgcagctgtgctacaccttcatgtacttcgtcaccgaggccgccttcaaccgcggcctcaacccctacgtctacgtcacctaccgccacctcctcgtcgccctcctcctctggcccttcgcctactaccacgagaagaagctgaggcccaagatgacctggatgctgttcctggagatcttcgtgctctcgcttctgggggtgagcttgaccctgaacatgtacttcgcgagcctcaagtacacgtccccgaccttcgtcacctccatggtcaacaccgtggcctccatcacattcgtcatcgccatcgcgctccggatggagatcgtggacctgcgcagcgcgcggggcctcgccaaggtggccggcacggcggtgtccttcgcgggggtcaccaccatgacgctgtacaagggcgcggcgatcgcgagcccctggagggcgccggtgcacatccccggcggcggcgacgccccgcacgacgcctggctcaaggggtccctcctcgccgtggccagctgcgtgtgctggtccgtctggtacatcatgcaggccacgtccgtgaagcggtacccggcggagctgtcgctgacggcgtggatggccaccgtgggcggggtccagtcggcggccttcacggtgctgctgcagcacgagaggcaggactggctcatcggcttcggcctcaagttctggtgcatcatctactccgggctcgcgtgcagcgggttcacggtgttcgcgcagctgtggtgcacggagaagaaggggcccgtgttcgtcaccatgttcaacccggtgtccaccatcatggtggccatcctcgcctacttcatcttcggcgagaacctatacgtcggaagcataatcggaggagtggtggtcatcctgggcctctacatgctgctctggggcaaggacaaggaccaggagtacaacgctgcaggagcggcgaccggcgaggagcagggcggctcgccggatctggactgcgagaagcagcagcggcaggggaagaagatggtcggcgtctccttggcgcgggatggctcagaagaacagaccaaggcgatgagataagaggagggctcagaattgcctgccaccagtgtgcgtgccgtccagaagaagcggcctgcatcaatggctctgcagttgttctacgtactagtacttctttgttcgaaagaaacacaattctgtagttgatcgtggcaaaattctttgacatggatccaccaacggggcatccatctgaacttttgttgcagcatcagtatgtgcactgtttaacccgcaaaaaaaagcatgtgctatgttttttggcgaaatgccgcgtatctccggcacaagcccaaatcatgtatgacaaaacagca

SEQ ID NO: 1419 - DNA, 1597 bp, Secale cereale
gggaaaacctgatcaagttgggcatggctggaggagctgcgatggggctggaagggctgtggaggaggtacgcgccgcacaacatgatgatcatggtgcagctctgctacaccttgatgtacttcgtcaccgaggccgccttcaaccgcggcctcaacccctacgtctacgtcacctaccgccacctcctcgtcgccgtcctcctctggcccttcgcctactaccacgaaaagaagttgaggcccaagatgacgtggatgctgttcctggagatcttcgtgctctcgcttctgggggtgagcttgaccctgaacatgtacttcgcgagcctcaagtacacgtccccgaccttcgtcacctccatggtcaacaccgtcgcctccatcaccttcgtcatcgccatcgcgctccggatggagatcgtcgacctgcggagcacaaggggcctcgccaaggtggccggcacggcggtctcgtttgccggggtcaccaccatgacgctgtacaagggcgcggcgctcgcgagcccctggaaggcgccggtgcacatccccggagccggcggcgacgccccgcacgacgcctggctcaaggggtccctcctcgccgtggccagctgcgtgtgttggtccgtctggtacatcatgcaggccacgtccgtgaagcggtacccggcggagctgtcgctgacggcgtggatggccaccgtgggcggtgtccagtcgctggccttcgcgctgctgctgcagcacgagaggcgggactggctcatcggcttcggcctcaacttctggtgcatcatctactccgggctcgcgtgcagcgggttcacggtgttcgcgcagctgtggtgcacggagaagaagggccccgtgttcgtcaccatgttcaacccggtgtccaccatcatggtggccatcctcgcctacttcatcttcggcgagaacctatacgtcggaagcataatcggaggagtggtggtcatactgggcctctacatgctgctctggggcaaggacaaggatcaagagtacaacgctgcaggagcggcggcgagcggcgaggagcaggccggcgagcccggtctggactgcgagaagcagcagcagcagcaggcgaagaagaccttggcgcaggatggctcggaacaagaggagaccaagacgacgaggtaggagcctaggaggagggggcagaattgcatgctgtccggtagaagcgccctgcttgaatccctcctgccacgactctgcagttgtcctactttttttgttcaaaaagaaaaaaaacacaattctgcagttgttcgtggcaaaattctttggcatgaatgatggatccaccaacggtagtctgtgcattacgttctttcagtttcaggaggagatgggtgtcctttggagggcggatgagcattttttatgcagttttgctagaactcatctatctgagttttagttatgtctcattcacttttatagccattggatatgatgctataagatacgtgtgtgctgacgtgggttgatgctcatttctatctgtttttttatatgatgtagtatatgaaattgccaaaataaaataagtgacagtc

SEQ ID NO: 1420 - DNA, 1887 bp, Pennisetum glaucum
caaagcggcctgccagagagagggagagcaaaagagagctcaagggggggcgggggcaaaaggagaattttttttttttatccagcttcctgcttgattctctctgatccccgagagcagcccgccagtccaactaatccttgctgttcgtaaggccgggctttgattgctctccagatctgagccacctgctcggtggattccaggaatccgagcacgaactcgacagggagttctcaggaggggggcaaaaaaggggaggaggaagaggccggccgagagggcggcggagataagagcggcgggctgggctgggccccttgagcatgccgtcaagaaaccgcgtggaggggagggcgatgagatgagggatgctggccgcggtgatggactacttcagctcctgctggggcccgcggtctcgggccgggggcaagggctccgatgccgccggccgccaggaaggtctcctctggtacaaggacgccggccagctcgccaccggggagttctccatggccgtggtgcaggccaaccagctgctcgaggaccagagccaggtggagtccggattactctccttggctgacccaggcccgcagggcaccttcgtcggcgtctatgatggccatggcggcccggagacgtcccgattcattaatgaccacctcttcaaccatctcaggaaatttgcaactgagcacaagtgcatctcagcagatgtgatcaggaaagctttccaagcaactgaggagggctttctttctctagtcagcagggaatgggctttgaagcctcagattgcatcagtaggctcctgttgcctagtgggtgtaatttgttctgggaccctctatgtcgcgaacctcggcgactcacgtgcagttcttggaaggcttgttaaggcaaccggggaggttctggccatgcagttatcatcagagcacaatgcgtgctacgaggaagtcagacaagagctgcagtcagcgcatcctgatgatccacaaattgtggttctaaaacacaacgtttggcgtgtgaagggtctcatccagatctcaagatctatcggagatgtatatctaaagagaccagagtttaacagagaacctcttcatagcaagtttcggcttcgagaaaccttccagaagccaattcttagttctgatcctcaaattactgaacacagaatacagcccaacgatcagtttgttatatttgcttctgatgggctatgggagcatctcagcaatcaggaagcagttgaccttgtccagaatagtccccgtaatggaatcgctcgaaagctagtgaaagtcgcgatgcaagaagcagccaagaagagggagatgagatattcagacctcaagaaaatcgagcgtggggtgaggcgacatttccatgacgatataaccgtaattgtggtattccttgactcaaatgccatgagcaaagctagctggagcaaatgcccctcggtctcttttcgagggggtggtgtcacccttcccgcaaaatccctcgctcctttctcagctccggctcagctgagcagcacctactgaagaagctatgctggaaagaaagagcacaatgcagatctgctgacccggagatgagagctgctgctgctgctgctgctgctgcaatcaagtgttgtagtgtaacacctgtcgtgttgcccatcgcaaaacctactgtctagactcccgcctggtaattagtgtactgatagcgaggtataaaaattagattatttcgtagcgacgcaaatcctcccttttcttcttccttctctttattcttatcccttttctcttcatcatccgtgagagaacaggtggctgtaaattgtccagaacacgttttcggtaatagtccatcata

SEQ ID NO: 1421 - DNA, 1852 bp, Panicum virgatum
gtcttcgggattagattgagcagagctgcctgccggaagagagtaaaagagagctcaaggggggcgaaaggagaattttttatccagcttcctgctcgattctctttgatcccggagagctgccgccagtccaaccaatccttgctgttcgtgtgcccgggctttgattgctctccagatctgaggcacctgctcggtggattccaggaatccgagcacgaactcgacagggagttctctgggaaaaggggaggaagagactgaaaggacgagctggtcccttgaagataacatcaagaaactgcgtggaggggagggcgatgagatgagggatgctggccgcggtgatggattacttcagctcctgctggggcccgcgatctcgggacgggcaccggggcaagggctccgacgcggctggccggcaggaaggtctcctctggtacaaggacgctggccagctcgccaccggggagttctccatggccgtggtgcaggccaaccagctgcttgaggaccagagtcaggtggaatccggatcgctctccttggctgagcccggtccgcagggcaccttcgtcggcgtctatgatggccatggcggcccggagacggcccggttcatcaatgaccacctcttcaaccatctcaggaaatttgcaactgagcacaagtgcatctcagtggatgtgatccggaaagctttccaagcaactgaggaaggctttctttctctagtcagcagggaatggtctttgaagcctcagattgcatcagtaggctcttgttgcctagtgggagtaatctgttctgggactctctatgtcgcgaacctcggtgactcgcgtgcagttcttggaagacttgttaaggccactggagaggttgtggccatgcagttgtcgtcggagcacaatgcgtgcaaagaggaagttagacaagagctacggttagcacatcccgatgatccacaaattgtggttctaaaacacaatgtttggcgtgtgaagggtctcatccagatctcaagatctattggagatgtatatttaaagagaccggagtataacaaagaacctcttcatagcagtttcggcttcgagaaaccttccagaggccaatcttagttctgatcctcaaattaatgaacaccgaatacagcccagtgatcagtttgctatatttgcttctgacgggctatgggagcacctcagcaatcaggaagcagttgaacttgtccaaaatagtccccgtaacggaatcgctcgaaggctagtgaaagttgcgatgcaagaagcagccaagaagagggagatgagatattcagacctcaagaaaatcaaccgtggggtgaggcgccatttccacgacgatataactgtcattgtggtattcctcgactcaaatgccatgagtaaagctagctggagcaaaagcccctcggtttctctccgagggggcggtgttacccttcctgcaaaatcccttgcgcctttctcagctccagcacagctgaacagcacctactgaagatgctatactggaaagaaagcagaatgcagatctgcaggagacgaaagcagctctgcaatcaagtgtagtgtaacacctgctgtggtgccctttgcgaaactactgtctagagtccccatggtaattagtgtactgatagcgaggtataaaaattagattatttcgtagcgacgcaaatccttcttttccttttcctttggccttctctttattcttatcccttttctcttcatcatccatgagagaacaggtggttgtaaattgtccagaacatgttttccgtaatagtccatcatatcccgcttttttcgtgttgata

SEQ ID NO: 1422 - DNA, 1951 bp, Saccharum officinarum
gtcttcttggattttgcgcttgtgctcacctgggcgcatactagtcccagcatcagagcggagagacctccgagctggggctcttcaacatatagattgggcagagctgcttgccgcctgccgggagagagtgaaagagagagagctcaaggggggcaaaaggagaattttttatccagcttcttagcttgattctctttgatccccgagagcagcccccggtccaactaatccttgctgttggcgtgccggggctttgattgctctccagatctgaggcacctgctcggtggattccaggaatccgagcacgaactcgacaggggagttctcagggaaaaggggaggaaggaagaggccgaaagggcggtggagataagactataagcgcgagctgggtcccttcccttgaggatgccgtcaagaaaccgcgtggaggggaggtcgatgagatgagggatgctggccgcggtgatggattacttcagctcctgctggggcccgcgatctcgtgccgggcaccggggcaagggctccgacgccgccggccggcaggacggtctcctctggtacaaggacgccggccagctcgtcactggggaattctccatggccgtggtgcaggccaaccagctgctcgaggaccagagccaagtggagtccggatcgctctccctcgctgaccccggcccgcagggtaccttcgtgggcgtctatgatggccatggcggcccggagacgtcccggttcatcaatgaccacctcttcaaccatctcaggaaatttgcaactgagcacaagtgtgtgtcagcggacgtgatccggaaagctttccaagcaactgaggagggctttgtttctctagtaagcaaggaatggtctatgaagcctcagattgcttcagtaggctcctgctgccttgttggtgtaatctgtgctgggacactctatgttgcaaacctgggcgactcacgtgcagttcttggaaggcttgttaaggcaactggagaggttatggccatgcagttgtcatcggagcacaatgcatgccgtgaggaagttagacaagagctgcaagcatcacatcctgatgatccacatattgtggttctcaaacacaatgtttggcgagtgaagggtctcatccagatctcaagatctattggagatgtatatctaaagaaaccagagtataacagagaacctcttcatagcaagtttcggcttcgagaaagcttccagaagccgattcttagttctgaacctcaaattactgaacatcgaatacagccaaacgaccagtttgttatatttgcttctgatggtctatgggagcacctcagcaatcaggaagcagttgaccttgtccaaagtagtccccgtaatggaatcgctcggagactagtgaaagccgcgatgcaagaagctgccaagaagagggagatgagatattcagacctcaagaagatcgaccgaggtgtgagaaggcatttccatgacgatacaaccgtggttgtggtgttcctggattcaaatgccatgagcaaagcaagctggagcaaaagcccctctgtttcgatccgagggggcggtgtcacccttccggcgaaatccctcgcacctttctcagctctggcacagttgaacagcacctactgaagttgctactactcttgaaaggaagagcacaatgcagatctgcaggagatgaaaggcagcgttacagttatacctgctgtgttgttgctctttgcaaaactactgtctagactccgcctggtaattagtgtactgatagcgaggtataaaaattagattatttgttagcgacgcaaatcctctctctttttcttctctctattcttatcccgtttctcttcatccttgagagaacaggtggttgtaaattgtccagaacatgttttccctaatagtccatcatatccccgct

SEQ ID NO: 1423 - DNA, 2065 bp, Zea mays
aaaaatgcgatgatgttaaggtagagacagcggcgtgcctcggagaaagcttgagtgcatactagtctctgcatcagagtagtggcctccgagctgctcttcaacacacagattcggcagagcctgccgagagagagtgaaaagagagggagcgcgctcaaggtgtggcgcaaggagatttttcttttatccagcttcttagcatgattctctttgatcccggagagcagccaccggtccaactagtccttgctgttggtctgccggaacttttgattgctctccagatctgaggcacctgctgggtggattccaggaacccgagcacgaagttgacaggggaggaaggaagaggctgaaagggcggtggagagagaaagactataagggcgagctgagtcccttgaggatgccgtcaagaaaccgcgtggagaggagggcgatgagatgagggatgctggccgcggtgatggactacttcagctcctgctggggcccgcgatcgggcgccgggcaccggggcaagggctccgacgccgccggccggcaggacggtctcctctggtacaaggacgccggccagctcgtcactggggagttctccatggccgtggtgcaggccaaccagctcctcgaggaccagagccaagtagagtccggatcgctctccctggctgacccgggcccacagggcaccttcgtcggcgtctatgatggccatggcggcccggagacgtcccggttcatcaatgaccacctcttcaaccatctcagaaggtttgcaactgagcacaagtttatgtcagcggacgtgatccggaaagctttccaagcaactgaggagggctttctttctctagtcagcaaggaatggtctttgaagcctcagattgcttcagtgggctcctgctgccttgttggtgtaatctgtgctgggactctctatgttgcaaacgtgggcgactcacgtgcagttcttggaaggcttgttaaggcaactggagaggttgtggccatgcagttgtcatcggagcacaatgcgtgctatgaggaagttagacaagaactgcagtcatcacatcctgacgatccacatattgtggttctcaaacacaatgtttggcgagtgaagggtctcatccagatctcaagatctattggagatgtatatctaaagaaaccagagtacaacagagaaccacttcacagcaagtttcggcttcgagaaaccttccagaggccgatccttagttctgaacctcaaattactgaacatcgaatacagccgaacgatcaatttgttatatttgcttctgatggtctatgggagcacctcagcaataaggaagcagttgaccttgtccaaagtagtccccgaaatggaatcgctcggaggctagtgaaagccgcgatgcaagaagctgccaagaagagggagatgagatactcagacctcaagaagatcgaccgtggtgtgagaaggcatttccacgacgatataactgtcgtcgtggtattcctcgattcggatgccatgagcaaagctagctggagcaaaagcccctcggtttctctccgagggggcggtgtcgccctccctgcgaagtccctcgcacctttctcagctccggcacggctgaacagcacctactgaagttgctaccactcttgaaaggaagaacacagtgcagatctgcagtggtgagagagagagaaaacagcaaccaagtgtagcgttacagttacacctgctgtgttgttgctctttgcaaaactactgtctagactccgcctggtaattagtgtactgatagcgaggtaaaaaagttagattatttgttagcgacacacatcctttcaccttctcttctctccctcgattcctatcccttttctcttcatccttgagagaacaggtggttgtaaattgttcagaacatgttttcccttatagtccatcatatcccgcttttttcgtgttgatatgaagggtggcagcatcaccgctcgagataatgtttgcggggcgcatgatttgaccagttccgatcaaagctattggtga

SEQ ID NO: 1424 - DNA, 2299 bp, Zea mays
ccactggtcagtggtcacacacaaatcaggattggtagagcccatctctgcgccctgccttgctggctctgacctctccctcccttccccttcctcgattgttcctcccccttcttttattagggttttttttgtctccttagatttgcgcctgttctcacctgtgcgcatactagtctctgcatcagagagtagagacctcggagccgatcttcaacacgcagattgggcagagctgcctgccggagggagagtggagagagagagagagagagagagagagagagctcaaggggggcaaaaggagtttttttttatccagcttgttagcttgattctctttgatccgggagagcagccgccagtccaactaatcctagctattggtgtgccggggctttgattgttctccagatccgagccacctgctgggtggactccaggaatccgagcacgaagttgacaggggagttctcagggaaaagttgcgcaggggaggaaggaagagcctgaaagggcggtgcggagagaaagactataagagcgacctgggtcccttgaggatgccgtcaagaaaccgcgtggagaggagggcgatgagatgagggatgctggccgcggtgatggactatttcagctcctgctggggcccgcgatcgggtgacgggcacagggggaagggccccgacgccgccggccggcaggacggtctcctctggtacaaggacgccggtcagctcgtcactggggagttctccatggccgtggtgcaggccaaccagctgcttgaggaccagagccaagtggagtccggatcgctctccctggctgacccgggcccgcagggcaccttcgtcggcgtctatgatggccatggcggtcctgagacgtcccggttcatcaatgaccacctcttcaaccatctcagaaggtttgcaactgagcacaagtttatgtcagcggacgtgatccggaaagctttccaagcaactgaggagggctttctttctctagtcagcaaggaatggtctttgaagcctcagattgcttcagtgggctcctgctgccttgttggtgtaatctgtgctgggactctctatgttgcaaacctgggtgactcacgtgcagttcttggaaggcttgttaaggcaactggagaggtcgtggccatgcagttgtcatcggagcacaatgcgtgctatgaggaagttagacaagaactgcagtcatcacatcctgacgatccacatattgtggttctcaaacacaatgtttggcgagtgaagggtctcatccagatctcaagatctattggagatgtatatctaaagaaaccagagtacaacagagaaccacttcacagcaagtttcggcttcgagaaaccttccagaggccgatccttagttctgaacctcaaattactgaacatcgaatacagccaaatgatcaatttgttatatttgcttctgatggtctatgggagcacctcagcaataaggaagcagttgaccttgtccaaagtagtccacacaatggaattgctcggagactagtgaaagcggcgatgcaagaagctgccaagaagagggagatgagatactcagacctcaagaagatcgaccgtggtgtgagaaggcatttccacgacgatataacggtcgtcgtggtattccttgatttgaatgccatgagcaaagctagctggagcaaaagcccctcggtttctctccgagggggcggtgtcaccgtccctgcgaagtccctcgcacctttctcagctccggcacggctgaacagcacctactgaagttgctaccactcttgaaaggaagaacacggtgcagatctgcagtggtgagagaaaaaaaaacagcaatcaagtgtagcgttacagttacacctgctgtgttgttgctctttgcaaaactactgtctagactccgcctggtaattagtgtactgatagcgaggtaaaaaaaagttagattatttgttagcagcggcagtgatttgacatctaaggaacaacaacacggtgcccaccgattctgctatcctgatggctcgcggcagcctggctggtcggcacacgacacgaagtgaagctgttttactggcggcatctggctttgttttctcatgggacagtgatccacaagagtaagggatcagctcaatccaaagtcaatagatgttccttataaaaaatagaggtacagatgttcccatcggctatgtgtatttggggaaaaaatcaatataaggggtgtttggtttttagggactaatttttagttc

SEQ ID NO: 1425 - DNA, 2867 bp, Sorghum bicolor
aagagaaagaaaagctgaggggataacaacaactctcctttttttggaatacaaccttggaatgcatctgattttctgcagtactacacaaaagctgggagtatttgttaaaagaggctatgaatccacaagttactcccagcatctgattttctgcagcatctgttaaaagagccgtgaatgtaggagtattattatggcagtgcagaaataatacactcccaagccagcaccatcaaaataagaagggcattaaaaaaaggtgcttttgttgcagtgggtgaatccaatgtggaaactgattttagggaccgaacaacgccaccaccagtactccacacacaaattaggattggtagagcccatccctgcgccctgccttgctggctctgacctctccctcccctcccctcccctcccctccctctcttgttgctccccccttcttttattgggttttttgtcttcttggatttgcgcttgtgctcacctgggtggtgcatactagtctctgcatcagagaggagagatctccgagctgggggctcttcaacatatagattgggcagagcttcctgccgcctgcggggagagagtgaaagagagagagctcaaggtgggggcaaaaggagaattttttatccagcttcttagcttgattctctttgatcccggagagcagccgccagtccaactaatccttgctgttggcgtgccggggctttgattgctctccagatctgaggcacctgctcggtggattccaggaatccgagcacgaactcgacaggggagttctcagggaaaaggtgagcccctttttcgtctccttgctcatccgcccaccattgccaaaccgtttatcccctgtccaccactggagtaatcgcgtagtcttagctccgattgttaagcttgagctgctgcctcttgatctgtttctgctgcctacactgggcgacgcttgatgcatacgagataatgagtcggccgcaagttttctttgatcccagcatacgatccaccagctcacgcgcgcacagaaatttttgactttttttttactcgctttgatttgattgcatctattgtttcggttgcgcaggctgcaggggattaaggaagaggctgaaagggcggtggagataataagactataagagcgagctgggccccttcccttgaggatgccgtcaagaaaccgcgtggaggggagcgcgatgagatgagggatgctggccgcggtgatggactacttcagctcctgctggggcccgcgatcgcgtgccgggcaccggggcaagggctccgacgcggccggccggcaggacggtctcctctggtacaaggacgctggccagctcgtcactggggagttctccatggccgtggtgcaggccaaccagctgcttgaggaccagagccaggtggaatccggaccgctctccctggctgaccccggcccgcagggcaccttcgtcggcgtccatgatggccatggcggcccagagacggcccggttcatcaatgaccacctcttcaaccatctcaggaaatttgcaactgagcacaagtgtgtgtcagcggatgtgatccggaaagctttccaagcaactgaggagggctggctttctcttgtaagcaaggaatggtctatgaagcctcagattgcttcagtaggctcctgctgccttgttggtgtaatctgtgctgggactctctatgttgcaaacctgggcgactcacgtgcagttcttggaaggcttgttaaggcaactggagaggctgtggccatgcagttgtcatcggagcacaatgcgtgccatgaggaagttagacaagagctgcagtcatcacatcctgatgatccacatattgtggttcttaaacacaatgtttggcgagtgaagggtctcatccagatctcaagatctatcggagatgtatatctaaagaaaccagagtataacagagaacctcttcatagcaagtttcggcttcgagaaaccttccagaggccgattcttagtgctgaccctcaaattactgaacatcgaatacagccaaacgatcagtttgttatatttgcttctgatggtctatgggagcacctcagcactcaggaagcagttgaccttgtccacagtagtccccgtaatggaatcgctcggagactagttaaagccgcgatgcaagaagctgccaagaagagggagatgagatattcagacctcaagaagatcgaccgaggtgtgagaaggcatttccacgacgatacaaccgtggttgtgctgttcctggattcaaatgccatgagcaaagcaagctggagcaaaagcccctctgtttctatccgagggggcggtgtaacccttcccgcgaaatccctcgcacctttctcagctctggcacagttgaacagcacctactgaagttgttactgctctggaaaggaagagcacaacgcagacctgcaggagagatgaaaagcagcaaagtgtagcgctatacttacacctgctgtgttgttgctcttttgcaaaactactgtctagactccgcctggtaattagtgtactgatagcgaggtataaaaattagattatttgttagcgacgcaaatcctttctccttttcttctcctcctctctctattcttatcccttttctcttcatccttgagagaacaggtggttgtaaattgtccggaacatgttttccctaatagtccatcatatcccgcttttttcgtgttgatatgaaggctgacagcatcactgctaaagataatgtttgggggcgcatgatttgaccagctccgatcaaaacttttgatgatgtgttgtagcagcacgttgctctcaaca

SEQ ID NO: 1426 - DNA, 3277 bp, Sorghum bicolor
aagagaaagaaaagctgaggggataacaacaactctcctttttttggaatacaaccttggaatgcatctgattttctgcagtactacacaaaagctgggagtatttgttaaaagaggctatgaatccacaagttactcccagcatctgattttctgcagcatctgttaaaagagccgtgaatgtaggagtattattatggcagtgcagaaataatacactcccaagccagcaccatcaaaataagaagggcattaaaaaaaggtgcttttgttgcagtgggtgaatccaatgtggaaactgattttagggaccgaacaacgccaccaccagtactccacacacaaattaggattggtagagcccatccctgcgccctgccttgctggctctgacctctccctcccctcccctcccctcccctccctctcttgttgctccccccttcttttattgggttttttgtcttcttggatttgcgcttgtgctcacctgggtggtgcatactagtctctgcatcagagaggagagatctccgagctgggggctcttcaacatatagattgggcagagcttcctgccgcctgcggggagagagtgaaagagagagagctcaaggtgggggcaaaaggagaattttttatccagcttcttagcttgattctctttgatcccggagagcagccgccagtccaactaatccttgctgttggcgtgccggggctttgattgctctccagatctgaggcacctgctcggtggattccaggaatccgagcacgaactcgacaggggagttctcagggaaaaggtgagcccctttttcgtctccttgctcatccgcccaccattgccaaaccgtttatcccctgtccaccactggagtaatcgcgtagtcttagctccgattgttaagcttgagctgctgcctcttgatctgtttctgctgcctacactgggcgacgcttgatgcatacgagataatgagtcggccgcaagttttctttgatcccagcatacgatccaccagctcacgcgcgcacagaaatttttgactttttttttactcgctttgatttgattgcatctattgtttcggttgcgcaggctgcaggggattaaggaagaggctgaaagggcggtggagataataagactataagagcgagctgggccccttcccttgaggatgccgtcaagaaaccgcgtggaggggagcgcgatgagatgagggatgctggccgcggtgatggactacttcagctcctgctggggcccgcgatcgcgtgccgggcaccggggcaagggctccgacgcggccggccggcaggacggtctcctctggtacaaggacgctggccagctcgtcactggggagttctccatggccgtggtgcaggccaaccagctgcttgaggaccagagccaggtggaatccggaccgctctccctggctgaccccggcccgcagggcaccttcgtcggcgtccatgatggccatggcggcccagagacggcccggttcatcaatgaccacctcttcaaccatctcaggaaatttgcaactgagcacaagtgtgtgtcagcggatgtgatccggaaagctttccaagcaactgaggagggctggctttctcttgtaagcaaggaatggtctatgaagcctcagattgcttcagtaggctcctgctgccttgttggtgtaatctgtgctgggactctctatgttgcaaacctgggcgactcacgtgcagttcttggaaggcttgttaaggcaactggagaggctgtggccatgcagttgtcatcggagcacaatgcgtgccatgaggaagttagacaagagctgcagtcatcacatcctgatgatccacatattgtggttcttaaacacaatgtttggcgagtgaagggtctcatccagatctcaagatctatcggagatgtatatctaaagaaaccagagtataacagagaacctcttcatagcaagtttcggcttcgagaaaccttccagaggccgattcttagtgctgaccctcaaattactgaacatcgaatacagccaaacgatcagtttgttatatttgcttctgatggtctatgggagcacctcagcactcaggaagcagttgaccttgtccacagtagtccccgtaatggaatcgctcggagactagttaaagccgcgatgcaagaagctgccaagaagagggagatgagatattcagacctcaagaagatcgaccgaggtgtgagaaggcatttccacgacgatacaaccgtggttgtgctgttcctggattcaaatgccatgagcaaagcaagctggagcaaaagcccctctgtttctatccgagggggcggtgtaacccttcccgcgaaatccctcgcacctttctcagctctggcacagttgaacagcacctactgaagttgttactgctctggaaaggaagagcacaacgcagacctgcaggagagatgaaaagcagcaaagtgtagcgctatacttacacctgctgtgttgttgctcttttgcaaaactactgtctagactccgcctggtaattagtgtactgatagcgaggtataaaaattagattatttgttagcgacgcaaatcctttctccttttcttctcctcctctctctattcttatcccttttctcttcatccttgagagaacaggtggttgtaaattgtccggaacatgttttccctaatagtccatcatatcccgcttttttcgtgttgatatgaaggctgacagcatcactgctaaagataatgtttgggggcgcatgatttgaccagctccgatcaaaacttttgatgatgtgttgtagcagcacgttgctctcaacaaggtaggtactgagatgcagggtttccctttttttttcttgagatttttttaatggaagatctggacgcgtggcttacccattcataggttgatccggttcgtgatttcgccgagaacaggtagcagcgtcagtgatttgacatttaagaaacaatcacacggtgcccaccgattttgtgaccctgatggctcgcggcagcctggcaggtcggcacacgacaccagtgtaaagggatagccataagtgaagctgtttagctgacggaatcgggctttgctatctcgagggacagtgatccactagattaggatcagctcagctcaagccaaagtcaatagatgttccttataaaaaaaaatagaggtaaagaggttccttgtacgctgtgtatatgtggaaaaaacaata

SEQ ID NO: 1427 - DNA, 2181 bp, Zea mays
acacaccaccaccacccacacaaattagaggattggtgccttgctccctcccccttcttgtcgttgctccaccctctcttcttttattattgggttctttttttctctctctccccttggatttgcgcttgtgctcgtctggccgcatactagtatccgcaccagagaggagacacctccgactccgacctgctcttgcatatagattgggcagagagtgagagagcgcgcgcgcgctcaaggggtgccaaaaggagattttttttttaatccagcttcttagcctcactgtctttgatcccggagagcagccgccagcccaactaatccttgctgctggcgcgccggggctccgattgcgctccagatctgaggcacctgctcggtggattccaggaatccgagcaccaactcgacaggggagttctcagggtaaaggaagaggctgagagcgcgttggagatttggactataagagcgagcgagcgagctgggtgccttgctgccttgaggacgccgtcaagaaaccgcgtggaggggagggcgatgagatgagggatgctggccgcggtgatggactacttcagcacctgctggggcccgcggtctcgtgcggggcaccggggcaagggctccgacgccgccggccggcaggacggcctcctctggtacaaggacgccgggcagctcgtcaccggggggttctccatggccgtggtgcaggccaaccagctgcttgaggaccagagccaggtggagtccggatcgctctccctggctgactacggcccgcagggcaccttcgtcggcgtctatgatggccatggcggcccggagacgtcccggttcatcaatgaccacctcttcaaccatctcaggagatttgcaactgagcacaagtccatgtcagcagacgtgatccggaaagctttccaagaaactgaggagggctttctttctctagtcatcaaggaatggtctttcaagcctcagattgcatcagttggctcctgttgccttgttggtgtaatctgtgctgggactctctatgttgcaaacctgggcgactcgcgtgcagttcttggaaggcttgtgaaagcaactggagaggttctggccactcagttgtcagcggagcacaatgcatgctatgaagaagttagacaagagctgcagtcatcacatcctgatgatccacgtattgtggttctcaaacataacgtttggcgagtgaagggtctcatccagatctcaagatctatcggagatgtatatctaaagaaaccggagtataacagagaacctcttcacagcaagtttcggcttcgagaaaccttccagaagccgattcttagttctgaacctcaaattactgaacaccgaatacagccaaacgatcagtttgttatatttgcttccgatggtctatgggagcacctcagcaatcaggaagctgttgaccttgtccaaagtagtccccgtaatggaatcgctcggagactagtgaaagccgcgatgcaagaagctgccaagaagagggagatgagatactcagacctcaagaagatcgaccgtggcgtgaggaggcatttccacgacgatataaccgtcgtcgtggtgttcctcgactcggatgccatgagcaaagctagctggagcaagagcccctcggtttctctccgagggggcggcgtcacccttcccgccaagtccctcgcacccttctcggctccggcacagttgaacggcacccactgaagctgctactgctcttgaaaagaagggcacagtgcagatctgctagagatgatgagagaagcagcaatcaagtgtagctgttgctcgtacacctgctgtgctgttgctgtttgcaaagctgccgtcttgactccgcctggtaattagtgtactgatagcgaggtatagaaattaggttatttgttagcgacgcaaatcctttctttttttttcttctccctctgttcttatctcttttctcttcatcatggaggaaacaggtggctgtaaatttgtccagaacatgttttccctaatagcccatcatatcccgctctttttcttgttgatatgaccaaggctggcagcatcgctgctcaagataatgtttggggcgcatgatttgaccagtccgaatcattacttttgatgatgtgttgtagc

SEQ ID NO: 1428 - DNA, 2240 bp, Oryza sativa
gaaggggatactactgattaaccctacaccggccaccaccagtcacacaacacaacaatttaggattggtagagcccatctctgagccctgccttgctggccctgagctctctcttgctgcttcttttaatgggttttttgtctccttggatttgtgcttgtgctcacctgggcgtggagttctctgcatgagagagagagagagagagagagagagagagagagagagagagagagagagaggacacctctgagctgtttcttcaacaagtcttcaagatttggcagagctactgagagagagcaaaggagaggagggctatagggaaaaaagtattttttttttgggggtacaaatttcttgcttgattctcttcgatcccggagagcagccaccagttgaggcacaatccttgctgttcgtgtgcctgggtttgatagctgtccagatctgcggcacttgcccgatagattccaagaatccgagcacaaactctcgtttgctgcgaaaagatagtaggtggaataagttgagcaatacggtggagataagagagatagcttgtgtctcgtgatgccatcaagaaactgcgtggaggaggaggagagtgtgagatgaaggatgctggccgcggtgatggactacttcaggtcctgctggggcccgcgatctccggccggtcaccgggtcaggggctccgacgtcgccggccggcaagacgggctcctgtggtataaggacgccggccagctggtcaccggggagttctccatggctgtggttcaggccaacaacctgctggaggaccagagccaggtggagtccggcgcgctctccatggccgagcccggccctcagggcaccttcatcggcgtctatgatggccacggcggcccggagacggcgcggttcatcaatgaccacatgttccaccatctcaggagatttgcaactgagcacaagtgcatgtcaaccgatgtgattcggaaagctttccaagcaactgaggagggcttcctttctctagtcagtaagcaatggtccttgaagcctcagattgcagcagtaggatcttgctgcctagttggtgttatttgctcagggactctctatgttgcgaaccttggagattcgcgtgctgttcttgggagatttgtcaagtccactggggaagttgtggcaacgcagctatcatcagaacacaacgcgtgctatgaggaagttagacaagaattgcaggcatcacatcctgatgatccacaaattgttgtcctaaaacacaatgtttggcgtgtcaagggcctcatccagatctcaagatctattggcgatgtatatctaaaaagaccagaatataacagagaacctcttcacagcaagtttcgacttcgggaaaccttcaaaaggccgattcttagttctgaacctgcaattgctgtacaccaaatacaaccaaatgatcattttgttatatttgcttctgatggtctatgggagcacctcagtaatcaggaagcagttgaccttgtccaaaataatcctcgtaatgggattgctcgaagactagttaaagtcgcaatgcaagaagcagccaagaagagggagatgagatactcagacctcaagaaaattgatcgtggcgtgaggcgtcatttccacgacgatataaccgtcattgtggtgtttcttgattcgaatgccataagcaaagcaaactggagccgaggtccttctgtttccctgagagggggtggtgtcaccctccctgcaaattcccttgcgcctttctcaactcccacggtgttaagcagcacctattgaaggagctatactgcaaagaacatgaacatctacagtaacacagatggaggtgaaagcagctgccgttatcaactgtactgtactccttctgtgttgctcttatgaaactgtttagaccccacctggtaattagtgtactgatagcgaggtataagattagattattccttagcaacgcaatcttttttttcttttctttttctttttccttctttattcttatcctttctcttacccacgagagaacaggtggttgtaaattgcccagaacacctttttcgtaatagtccatcatatccccttttttcgtgttgataatgaaggcattgctaaaagttttaatgttgggtacttggtgcttgacttcacttgttattgctaagatcaaaattataaaatgatctgttccaggttgctc

SEQ ID NO: 1429 - DNA, 2173 bp, Oryza sativa
gaaggggatactactgattaaccctacaccggccaccaccagtcacacaacacaacaatttaggattggtagagcccatctctgagccctgccttgctggccctgagctctctcttgctgcttcttttaatgggttttttgtctccttggatttgtgcttgtgctcacctgggcgtggagttctctgcatgagagagagagagagagagagagagagagagagagagagagagagagagagaggacacctctgagctgtttcttcaacaagtcttcaagatttggcagagctactgagagagagcaaaggagaggagggctatagggaaaaaagtattttttttttgggggtacaaatttcttgcttgattctcttcgatcccggagagcagccaccagttgaggcacaatccttgctgttcgtgtgcctgggtttgatagctgtccagatctgcggcacttgcccgatagattccaagaatccgagcacaaactctcgtttgctgcgaaaagatagtaggtggaataagttgagcaatacggtggagataagagagatagcttgtgtctcgtgatgccatcaagaaactgcgtggaggaggaggagagtgtgagatgaaggatgctggccgcggtgatggactacttcaggtcctgctggggcccgcgatctccggccggtcaccgggtcaggggctccgacgtcgccggccggcaagacgggctcctgtggtataaggacgccggccagctggtcaccggggagttctccatggctgtggttcaggccaacaacctgctggaggaccagagccaggtggagtccggcgcgctctccatggccgagcccggccctcagggcaccttcatcggcgtctatgatggccacggcggcccggagacggcgcggttcatcaatgaccacatgttccaccatctcaggagatttgcaactgagcacaagtgcatgtcaaccgatgtgattcggaaagctttccaagcaactgaggagggcttcctttctctagtcagtaagcaatggtccttgaagcctcagattgcagcagtaggatcttgctgcctagttggtgttatttgctcagggactctctatgttgcgaaccttggagattcgcgtgctgttcttgggagatttgtcaagtccactggggaagttgtggcaacgcagctatcatcagaacacaacgcgtgctatgaggaagttagacaagaattgcaggcatcacatcctgatgatccacaaattgttgtcctaaaacacaatgtttggcgtgtcaagggcctcatccagatctcaagatctattggcgatgtatatctaaaaagaccagaatataacagagaacctcttcacagcaagtttcgacttcgggaaaccttcaaaaggccgattcttagttctgaacctgcaattgctgtacaccaaatacaaccaaatgatcattttgttatatttgcttctgatggtctatgggagcacctcagtaatcaggaagcagttgaccttgtccaaaataatcctcgtaatgggattgctcgaagactagttaaagtcgcaatgcaagaagcagccaagaagagggagatgagatactcagacctcaagaaaattgatcgtggcgtgaggcgtcatttccacgacgatataaccgtcattgtggtgtttcttgattcgaatgccataagcaaagcaaactggagccgaggtccttctgtttccctgagagggggtggtgtcaccctccctgcaaattcccttgcgcctttctcaactcccacggtgttaagcagcacctattgaaggagctatactgcaaagaacatgaacatctacagtaacacagatggaggtgaaagcagctgccgttatcaactgtactgtactccttctgtgttgctcttatgaaactgtttagaccccacctggtaattagtgtactgatagcgaggtataagattagattattccttagcaacgcaatcttttttttcttttctttttctttttccttctttattcttatcctttctcttacccacgagagaacaggtggttgtaaattgcccagaacacctttttcgtaatagtccatcatatccccttttttcgtgttgataatgaaggcattgctaaaagttttaatgttgggta

SEQ ID NO: 1430 - DNA, 1580 bp, Triticum aestivum
ggatgccggcgaggagctgcggggggagggcgtgatggcggcggtgatggactacttcaggtcgtgctggggcgcgcggtcccgggccgggcggcggggcaagaagggctccgacgccgccggccgccaggacgggctgctgtggtacaaggacgccgggcaggcggccaccggcgacttctccatggcggtggtgcaggccaacaacctgctggaggaccagagccaggtcgagtccggctcgctctccatggccgaccccggcccgcagggcaccttcgtcggcgtctatgacggccacggcggcccggagacctcccgcttcatcaatgacaacatgttccaccatctcagaagatttgcaccgagcacaagtgcatgtcggccgatgtgatccggaaagccttccaagcaaccgaggacggcttcctttctgtagtcagcaaggaatggtctatgaagcctcagatcgcagcagtgggctcttgctgcctggtcggcgtaatttgctccgggactctctacatcgcaaacgcgggcgactcgcgtgctgttctcggaaggctcgtcaaggcgaccggtcaggttgtggccatgcagttatcggcggagcacaacgcgtgctacgaggaagttaggcaggagctacagtcatcacaccctcatgatccacaaattgtggttctgaaacacaacgtttggcgtgtgaagggcctcatccagatatcaagatctatcggagatgtatatctgaaaagaccagagtataacagatcacctctacatagcaagtttcggctccgggaaaccttcaagaagccaattcttagttctgaacctgcgattgctgttcaccaaatacaaccgagtgatcagtttgttatatttgcttctgacgggctatgggagcacctcagcaatcaggaagcagttgaccttgtccaaagtaaccctcgtaatgggattgcgcggaagctagtgaaggccgcgatgcaagaggcggcaaagaagagggagatgaggtactcggacctgaagaagatcgagcgcggggtgcggcggcatttccacgacgacataacggtggtcgtggtgttcctggacgccacgagcgccgtgagcagggcggggtggagcaagagcccgtcggtgtcggtgcgagggggcggcgtgagcgtccccgccaactccctcgcgcctttctcggcccccgccatggtcagcagcacctactgaaggagaagccgccgcgccgatgaagagaaactctatgatgggagcatctgcagagagagtgcttcctgctgctgtgaagctgctcaggctccacccggtaattaaattagcgtactgatagcaaggtataaggttagatcaccgccattccgtggcgacgcaaacctacccccctccccctcctcccctttgttcttttatctatccctgttctcttctccaatgagggaggagggcatggtggctgtaaatttgtccggaacatcgccgtctcttttcgcaatagtccgtgttcttccatctcttgttttcgccgtcgaaaaccgggtgcctggcttgactga

SEQ ID NO: 1431 - DNA, 2118 bp, Secale cereale
ctccccctctccccctcttcttttaatggcttctctgtcccctcggtttcctgcctcgcctgggtgctagtgctagtagaagtaggccggggttgggtgtggcttcacaagagagagaccactctgcctctgagctgttccttccttccacttccagcgagtgttccagagattgggcgcatataggaggtagctagccacctacggcgaggagaggaggggggagaatttctcttcctttttctcaagctccttgcttgcttgcttccttggttgattctcttcgattgatcctcgaccgcggccgccggtccagtccacccaatcctcgctgttcgcgcgcccaacctcgtgcccgcccgcgccagatctgagcagattccaagaatcccagcacccacccgccggggagttcttgggcttggacagagagagacggggaaaaaggcgcggacggcggcggcggaggccggggatgccgtcgaggagctgcggggggagggcgtgatggcggcggtgatggactacttcaggtcgtgctggggcgcgcggtcccgggccgggcggcggggcaagaagggctcggacgccgccggccgccaggacgggctgctgtggtacaaggacgccggccaggcggccaccggcgacttctccatggcagtggtgcaggccaacaacctgctggaggaccagagccaggtggagtccggctcgctctccatggccgaccccggcccgcagggcaccttcgtcggcgtctacgacggccatggcggcccggagacctcccgcttcatcaatgacaacatgttccaccatctcagaagatttgctaccgagcacaagtgcatgtcggccgatgtgatccggaaagccttccaggcaaccgaggacggcttcttatctgtggtcagcaaggaatggtctatgaagcctcagatcgcagcagtgggctcttgttgcctggtcggcgtaatttgctccgggactctctacatcgcaaacgccggcgactcgcgcgcagtcctcggaaggctcgtcaaggcgaccggtcaggttgtggccatgcagttatcggccgagcacaacgcgtgctacgaggaagttaggcaggagctacagtcatcacaccctcatgatccacaaattgtggttctaaaacacaacgtctggcgtgtgaagggcctcatccagatctcaagatccatcggagatgtatatctgaaaagaccagagtataacagatcacctctacatagcaagtttcggctccgggaaaccttcaagaagccaattcttagttctgaacctgcaattgctgtacaccaaatacaaccgagtgatcagtttgttatatttgcttctgacgggctatgggagcacctcagcaatcaggaagcagttgaccttgtccaaagtaaccctcgtaatgggatcgctcgaaagctagtgaaggccgcgatgcaagaggcggccaagaagagggagatgaggtactcggacctgaagaagatcgagcgcggggtgcggcggcatttccacgacgacataacggtggtcgtggtgttcctggacgcgagcgcggggagcagggcggggtggagcaagagcccgtcggtgtcggtgcgagggggcggcgtgagcgtccccgccaactccctcgcgcctttctcggcccccgccatggtgagcagcacctactgaaggagaagaaggagaagccgccgcgctgataagagaaactcgatgatgagagcatctgcagagagggtgctttcctgctgctgtgaaactgctcaggctccacccgggtaattaaattagcgtactgatagcaaggtataaggttagatcaccaccatcccatcccctagcgactcaacccccctcgttgttcttttatctatcccttcttctcttctccaatgagggaggaggacaaggtggctgtaaatttgtccggaacatcgccgtctcttttcgcaatggtccgtcttcttccgtctcttgtttcggccgtcgaaaaccgggcgcctggcttgactggtgactctgtgaggtcaagacaaggggtgcctccaattatttttgcagcagattcattatgaaatggga

SEQ ID NO: 1432 - DNA, 1568 bp, Triticum aestivum
atgccggcgaggagctgcggggagagggcgtgatggcggcggtgatggactacttcaggtcgtgctggggcgcgcggtcccgggccgggcggcggggcaagaagggctccgacgccgccggccgccaggacgggctgctgtggtacaaggacgccgggcaggcggccaccggcgacttctccatggcggtggtgcaggccaacaacctgctggaggaccagagccaggtggagtccggctcgctctccatggccgaccccggcccgcagggcaccttcgtcggcgtctatgacggccatggcggcccggagacctcccgcttcatcaatgacaacatgttccaccatctcagaagatttgcaaccgagcacaagtgcatgtcggccgatgtgatccggaaagccttccaagcaaccgaggacggcttcctttctgtagtcagcaaggaatggtctatgaagcctcagatcgcagcagtgggctcttgctgcctggtcggcgtaatttgctccgggactctctacatcgcaaacgccggcgactcgcgtgcggttctcggaaggcttgtcaaggcgaccggtcaggttgtggccatgcagttatcggcagagcacaacgcgtgctacgaggaagttaggcaggagctacagtcatcacaccctcatgatccacaaattgtggttctgaaacacaacgtttggcgtgtgaagggcctcatccagatctcaagatctatcggagatgtatatctgaaaagaccagagtataacagatcacctctacatagcaagtttcggctccgggaaaccttcaagaagccaattcttagttctgaacctgcgattgctgttcaccaaatacaaccgagtgatcagtttgttatatttgcttctgacgggctatgggagcacctcagcaatcaggaagcagttgaccttgtccaaagtaaccctcgtaatgggatcgctcgaaagctagtgaaagccgcgatgcaagaggcggccaagaagagggagatgaggtactcggacctgaagaagatcgagcgcggggtgcggcggcatttccacgacgacataacggtggtcgtggtgttcctggacgcgagcgccgtgagcagggcggggtggagcaagagcccgtcggtgtcggtgcgagggggcggcgtgagcgtccccgccaactccctcgcgcctttctcggcccccgccatggtgagcagcacctactgaaggagaagaagaagccgccgcgccgatgaagagaaactctatgatgggagcatctgcagagagagtgcttcctgctgctgtgaaactgctcaggctccacccgggtaattaaattagcgtactgatagcaaggtataaggttagatcaccgccattccgtggcgacgcaacctcctcccctttgttcttttatctatcccttttctcttctccaatgagggaggaggacaaggtggctgtaaatttgtccggaacatcgccgtctcttttcgcaatagtccgtcttcttccatctcttgttttcgccgtcgaaaaccgggtgcctggcttgactga

SEQ ID NO: 1433 - DNA, 1598 bp, Hordeum vulgare
gacgattctgtttggttgcaggcgcggagggcggcggtgggcatgccgtcgaggagctgcggggagagggcgtgatggcggcggtgatggactacttcaggtcgtgctggggcgcgcggtcccggtccggacggcggggcaagaagggctcggacgccgccggccggcaggacgggctgctgtggtacaaggacgccgggcaggcggccacaggcgagttctccatggcggtggtgcaggccaacaacctgctggaggaccagagccaggtggagtccggctcgctctccatggccgaccccggcccgcagggcaccttcgtcggcgtctatgatggccatggcggcccggagacctcccgcttcatcaatgacaacatgttccaccatctcagaagatttgcaaccgagcacaagtgcatgtcggccgatgtgatccggaaagccttccaagcaaccgaggacggcttcctttccgtagtcagcaaggaatggtctgtgaagcctcagatcgcagcagtgggctcgtgttgcctggtcggtgtaatttgctccgggactctctacatcgcaaacgccggcgactcgcgtgcggttctcggacggctcgtcaaggcgaccggtcaggttgtggccatgcagttatcggcggagcacaatgcgtgctacgaggaagttaggcaggagctacagtcatcacaccctcatgatccacaaattgtggttctaaaacacaacgtttggcgtgtgaagggcctcatccagatctcaagatctatcggagatgtatatctgaaaagaccagagtacaacagaacacctctacatagcaagtttcggctccgggaaaccttcaagaagccaattcttagttctgagcctgcaatcgctgtacaccaaatacaaccgagtgatcagtttgttatatttgcttctgacgggctatgggagcacctcagcaatcaggaagcggttgaccttgtccaaactaaccctcgtaatgggatcgctcggaagctagtgaaagccgcgatgcaagaagcggccaagaagagggagatgagatactcggacctgaagaagatcgagcgcggggtgaggcggcatttccacgacgacataacggtggtcgtggtgttcctggacgcgagcgccgtgagcagggcggggtggagcaagagcccgtcggtgtcggtgcgagggggcggcgtgagcgtccccgccaactccctcgcgcctttctcggcccccaccatggtgagcagcacctactgaaagagaatccggcgtgcccgccgagaggagaaactttatgagcagagagtgttcctgctgctgtgaaactgctcacccgggtaattaaactagcgtactgatagcaaggtataaggttagatcaccaccgttccttagcgacgcttttcgccccccctcctcccctttgttcttttatctaccctttttcttttctccaatgagagaggagaacaaggtggctgtaaatttgtccagaacatcgtcgtcgtctcttttcgcaatagtccatctcctttttccgccgtcgaaaaccgggtgcttggtggcttgaccctgttaggt

SEQ ID NO: 1434 - DNA, 2159 bp, Hordeum vulgare
gagtagcagtccacaccaccacaaccagtcagtcacacaagaatcaggattggtaggagcccatcctctgccttgctggccctgacctccctcccgtcccgtccccccctccccgctcttcttttaatggcttctttgtcccctcgccttcctgcctccgctcgctcacctgggtctcggcagtagtcgtagcaatagcagtagcagtaggctgggccgctggggttgggtgcggcttccaccactgcctctgagctgttccttcttccagcgagtgttcaaagattgggggcgtagctagctagctagccaccgggagaaaagtaaagtaaagtaaagtaaagtaaagcagcaggcctgcggcgaggaggccggcgagggaatttctctttttgtcaagctccttccttgctcggttggttggctggctggctgattctctttgatcccggaccgcggccgccagtccagtccagccagtcctcgctgttcgtgcgacggagctcgtgcccgtccgcgccagatctgagagtcacctcgccggtggtagattccaagaatccgagcacgaactcggcggcgagttcttggacggagagagagagagggggggaaaaggcgcggagggcggcggtggggatgccgtcgaggagctgcggggagagggcgtgatggcggcggtgatggactacttcaggtcgtgctggggcgcgcggtcccggtccggacggcggagcaagaagggctcggacgccgccggtcggcaggacgggctgctgtggtacaaggacgccgggcaggcggccaccggcgagttctccatggcggtggtgcaggccaacaacctgctggaggaccagagccaggtggagtccggctcgctctccatggccgaccccggcccgcagggcaccttcgtcggcgtctatgatggccatggcggcccggagacctcccgcttcatcaatgacaacatgttccaccatctcagaagatttgcaaccgagcacaagtgcatgtcggccgatgtgatccggaaagccttccaagcaaccgaggacggcttcctttccgtagtcagcaaggaatggtctgtgaagcctcagatcgcagcagtgggctcgtgttgcctggtcggtgtaatttgctccgggactctctacatcgcaaacgccggcgactcgcgtgcggttctcggacggctcgtcaaggcgaccggtcaggttgtggccatgcagttatcggcggagcacaatgcgtgctacgaggaagttaggcaggagctacagtcatcacaccctcatgatccacaaattgtggttctaaaacacaacgtttggcgtgtgaagggcctcatccagatctcaagatctatcggagatgtatatctgaaaagaccagagtacaacagaacacctctacatagcaagtttcggctccgggaaaccttcaagaagccaattcttagttctgagcctgcaatcgctgtacaccaaatacaaccgagtgatcagtttgttatatttgcttctgacgggctatgggagcacctcagcaatcaggaagcggttgaccttgtccaaactaaccctcgtaatgggatcgctcggaagctagtgaaagccgcgatgcaagaagcggccaagaagagggagatgagatactcggacctgaagaagatcgagcgcggggtgaggcggcatttccacgacgacataacggtggtcgtggtgttcctggacgcgagcgccgtgagcagggcggggtggagcaagagcccgtcggtgtcggtgcgagggggcggcgtgagcgtccccgccaactccctcgcgcctttctcggcccccaccatggtgagcagcacctactgaaagagaatccggcgtgcccgccgagaggagaaactttatgagcagagagtgttcctgctgctgtgaaactgctcacccgggtaattaaactagcgtactgatagcaaggtataaggttagatcaccaccgttccttagcgacgcttttcgccccccctcctcccctttgttcttttatctaccctttttcttttctccaatgagagaggagaacaaggtggctgtaaatttgtccagaacatcgtcgtcgtctcttttcgcaatagtccatctcctttttccgccttc

SEQ ID NO: 1435 - DNA, 2104 bp, Triticum aestivum
attggtaggagcccatctctgccttgctggccctggcctcctctcccccctcttgctcttcttttaatggcttctctgccccctcggtttcctgcccccgctcgctcccctgggtctgggtactagtactagtagcagtaggctggggttggcttgggtgtggcttcacaactcacaagagaggaggagagaccactctgcctctgagctgttccttccacttccagcgagtgctcaatcaccgggagaaaagcaaagcagcaggcctgcggcgaggctgccggggaggggattttttcctttctgtcaagctccttgcttgcttgcttgattctcttctctttgatcctggagcgcggccgccggtccgtccagtccacccaaccctcgctgttcgtgcgcccgagctcgtgcccgcccgcgccagatctgagtagattccaagaatcccagcacgaatccggcggggagttcttgggcttggacggagagaggggggaaaaggcggcggggacacggaggccggggatgccggcgaggagctgcggggagagggcgtgatggcggcggtgatggactacttcaggtcgtgctggggcgcgcggtcccgggccgggcggcggggcaagaagggctcggacgccgccggccgccaggacgggctgctgtggtacaaggacgccggccaggcggccaccggcgacttctccatggcggtggtgcaggccaacaacctgctggaggaccagagccaggtggagtccggctcgctctccatggccgaccccggcccgcagggcaccttcgtcggcgtctatgacggccatggcggcccggagacctcccgcttcatcaatgacaacatgttccaccatctcagaagatttgcaaccgagcacaagtgcatgtcggccgatgtgatccggaaagccttccaagcaaccgaggacggcttcctttccgtagtcagcaaggaatggtctatgaagcctcagatcgcagcagtgggctcttgctgcctggtcggcgtgatttgctccggaactctctacatcgcaaacgccggtgactcgcgtgcggttctcggaaggcttgtcaaggcgaccggtcaggttgtggccatgcagttatcggcagagcacaacgcgtgctatgaggaagttaggcaggagctacagtcatcacaccctcatgatccacaaatcgtggttctgaaacacaacgtttggcgtgtgaagggcctcatccagatctcaagatctatcggagatgtatatctgaaaagaccagagtataacagatcacctctacatagcaagtttcggctccgggaaaccttcaagaagccaattcttagttctgaacctgcgattgctgttcaccaaatacaaccgagtgatcagtttgttatatttgcttctgacgggctatgggagcacctcagcaatcaggaagcagttgaccttgtccaaagtaaccctcgtaatgggatcgctcgaaagctagtgaaagccgcgatgcaagaggcggccaagaagagggagatgagatactcggacctgaagaagatcgagcgtggggtgcggcggcatttccatgacgacataacggtggtcgtggtgttcctggacgcgagcgcggtgagcagggcggggtggagcaagagcccgccggtgtcggtgcgagggggcggcgtgagcgtccctgccaactccctcgcgcctttctcggcccccaccatggtgagcagcacctactgaagaaggggaagaagccgccgcgccgagaagagaaactctatgacgagagcatctgcagagagagtgcttcctgctgctgtgaaactgctcaggctccacccgggtaattaaattagcgtactgatagcaaggtataatgttagatcaccaccattagcgatgcttttcgccccctccgcctcctcccctttgttcttttacctatcccttttctcctctccaatgagagaggagaacaaggtggctgtaaatttgtccggaacatcggcgtctcttttcgcaatagtccgtcttcttccatctcttgttttcgccgtcgaaaaccgggtgcctggcttgactga

SEQ ID NO: 1436 - DNA, 1984 bp, Brachypodium distachyon
gttgtgcttgtgctcacctgggtgtggagttctctgcatgagaggagagacccctctgagctgttccttcaagtcttcaagactgggcacagccagccactgagaggaaagtaaagcagacctactacacatacagagaggaggagaatttttctttttgtcaagctccttgcttgattctctttgatcctggaaagcagccaccaccagtccaactaatctgttgctgttcgtgtgcgccggagattgtagctacctatcccccagatctgagtcacttgctccgtagattccaagaatccgagcacgaattcgacagggaggtattgcttggagagaaagagaaatatagggaaaaaaagtcgcagcagacaggacggttaaggcgattaagacgttggagataagagtccccgggatggtgtcaagaaactgcggggaggagagggtgagatgaaggaggatggccgcggtgatggactacttcaggtcctgctggggcgcgcggtcccgggccgggcaccggggcaagaagggctcggacaccgccgggcggcaggacgggctgctgtggtacaaggacgccggccaggtagccaccggggagttctccatggcggtggtgcaggccaataacctgctggaggaccagagccaggtggagtccggcccgctctccatggcggagcccggccctcacggcaccttcgtcggcgtctatgatgggcatggcggcccggagacgtcccggttcatcactgacaacatgttccaccatctcaagagatttgcaaccgagcacaagtgcatgtcagcagatgtgatccggaaagctttccaagcaactgaggatgggttcctttctgtagtcagcaaagaatggtctatcaagcctcagattgcagcagtaggctcttgttgcctagtcggtgtaatttgctctgggactctctatattgcaaatgctggtgactcgcgtgcggtccttggaaggcttgtcaaggcaactggtgagattgtggccatgcagttatcggcagagcacaatgtgtgctatgaggaagttaggcaggagctacagtcatcacatcctgatgatccacaaattgtggttctaaaacacaacgtttggcgtgtgaagggtctcattcagatctcaagatctatcggagatgtatatctgaaaagaccagagtataacagaacacctcttcatagcaagttccgactccgggaaaccttcaagaagccaattcttaggtctgaacctgcaattgctgaacaccaaatacaaccgagtgatcagtttgttatatttgcttctgatgggctatgggaacacctcagcaatcaggaagcagttgatcttgtccaaagtaatcctcgtaatgggattgctcgaagactagttaaagccgcgatgcaagaagcagccaagaagagggagatgagatattcagatctcaagaagatcgaacgtggggtgaggcgccatttccacgacgatataaccgttgtcgtggtatttctcgatgcaaatgctgcaagcaaagcaggttggagcaaaagcccttcagtctcggtccgagggggcggcgtcagcgtccgagcaaattccctcgcaccattcttggcccccaccatgctaagcagcacctactgaagaaacctcaacatggtcatctacggagcacaatgcaagacagacaggggtgaaatcagctggtaggatctagtgtgtgttcttgctacgttgctcctgtgaaagtaaaaactgcttttaggctccacccgggtaattagtgtactgatagcaaggtataagattagattattccttagcaatgtcgatcctcttttctttttcttccctccctttttattcttatacctttctcatcacccatgagagaacaggtggctgtaaatttgtccagaacatccttttcgtaatggtccatcacatctctttcaatttttcatg

SEQ ID NO: 1437 - DNA, 2011 bp, Brachypodium distachyon
ggttttgttgtgcttgtgctcacctgggtgtggagttctctgcatgagaggagagacccctctgagctgttccttcaagtcttcaagactgggcacagccagccactgagaggaaagtaaagcagacctactacacatacagagaggaggagaatttttctttttgtcaagctccttgcttgattctctttgatcctggaaagcagccaccaccagtccaactaatctgttgctgttcgtgtgcgccggagattgtagctacctatcccccagatctgagtcacttgctccgtagattccaagaatccgagcacgaattcgacagggaggtattgcttggagagaaagagaaatatagggaaaaaaagtcgcagcagacaggacggttaaggcgattaagacgttggagataagagtccccgggatggtgtcaagaaactgcggggaggagagggtgagatgaaggaggatggccgcggtgatggactacttcaggtcctgctggggcgcgcggtcccgggccgggcaccggggcaagaagggctcggacaccgccgggcggcaggacgggctgctgtggtacaaggacgccggccaggtagccaccggggagttctccatggcggtggtgcaggccaataacctgctggaggaccagagccaggtggagtccggcccgctctccatggcggagcccggccctcacggcaccttcgtcggcgtctatgatgggcatggcggcccggagacgtcccggttcatcactgacaacatgttccaccatctcaagagatttgcaaccgagcacaagtgcatgtcagcagatgtgatccggaaagctttccaagcaactgaggatgggttcctttctgtagtcagcaaagaatggtctatcaagcctcagattgcagcagtaggctcttgttgcctagtcggtgtaatttgctctgggactctctatattgcaaatgctggtgactcgcgtgcggtccttggaaggcttgtcaaggcaactggtgagattgtggccatgcagttatcggcagagcacaatgtgtgctatgaggaagttaggcaggagctacagtcatcacatcctgatgatccacaaattgtggttctaaaacacaacgtttggcgtgtgaagggtctcattcagatctcaagatctatcggagatgtatatctgaaaagaccagagtataacagaacacctcttcatagcaagttccgactccgggaaaccttcaagaagccaattcttaggtctgaacctgcaattgctgaacaccaaatacaaccgagtgatcagtttgttatatttgcttctgatgggctatgggaacacctcagcaatcaggaagcagttgatcttgtccaaagtaatcctcgtaatgggattgctcgaagactagttaaagccgcgatgcaagaagcagccaagaagagggagatgagatattcagatctcaagaagatcgaacgtggggtgaggcgccatttccacgacgatataaccgttgtcgtggtatttctcgatgcaaatgctgcaagcaaagcaggttggagcaaaagcccttcagtctcggtccgagggggcggcgtcagcgtccgagcaaattccctcgcaccattcttggcccccaccatgctaagcagcacctactgaagaaacctcaacatggtcatctacggagcacaatgcaagacagacaggggtgaaatcagctggtaggatctagtgtgtgttcttgctacgttgctcctgtgaaagtaaaaactgcttttaggctccacccgggtaattagtgtactgatagcaaggtataagattagattattccttagcaatgtcgatcctcttttctttttcttccctccctttttattcttatacctttctcatcacccatgagagaacaggtggctgtaaatttgtccagaacatccttttcgtaatggtccatcacatctctttcaatttttcatgtcgataaggaggcaactatat

SEQ ID NO: 1438 - DNA, 1896 bp, Secale cereale
tagaagtaggcggggttgggtgtggcttcagaagagagaccactctgcctctgagctgttcctgccttccacttccagcgagtgttccagagattgggcgcatataggagtagctagccacctacggcgaggagaggaggggggagaatttttcttcctatttctcaagctccttgcttgcttgcttccttggttgattctcttcgattgatcctcgaccgcggccgccggtccagtccacccaatcctcgctgttcgtgtgcccaacctcgcgccagatctgagtagattccaagaatcccagcacccacccgccgggaagttcttgggcttggacagagagagcggggaaaaaggcgcggacggcggcggcggaggccggggatgccgtcgaggagctgcggggcgagggcgtgatggcggcggtgatggactacttcaggtcgtgctggggcgcgcggtcccgggccgggcggcggggcaagaagggctcggacgccgccggccgccaggacgggctgctgtggtacaaggacgccggcaggcggccaccggcgacttctccatggcggtggtgcaggccaacaacctgctggaggaccagagccaggtggagtccggctcgctctccatggccgaccccggcccgcagggcaccttcgtcggcgtctacgacggccacggtcggcccggagacctccccgccttcatcaatagacaacatgttccacccatctcagaagatttgctaccgagcacaagtgcatgtcggccgatgtgatccggaaagccttccaggcaaccgaggacggcttcttatctgtggtcagcaaggaatggtctatgaagcctcagatcgcagcagtgggctcttgttgcctggtcggcgtaatttgctccgggactctctacatcgcaaacgccggcgactcgcgcgcagtcctcggaaggctcgtcaaggcgaccggtcaggttgtggccatgcagttatcggccgagcacaatgcgtgctacgaggaagttaggcaggagctacagtcatcacaccctcatgatccacaaattgtggttctaaaacacaacgtctggcgtgtgaagggcctcatccagatctcaagatctatcggagatgtatatctgaaaagaccagagtataacagatcacctctacatagcaagtttcggctccgggaaaccttcaagaagccaattcttagttctgaacctgcaattgctgtacaccaaatacaaccgagtgatcagtttgttatatttgcttccgacgggctatgggagcacctcagcaatcaggaagctgttgaccttgtcgaaagtaaccctcgtaatgggatcgctcggaagctagtgaaggccgcgatgcaagaggcggccaagaagagggagatgaggtactcggacctgaagaagatcgagcgcggggtgcggcggcatttccacgacgacataacggtggtcgtggtgttcctggacgcgagcgcggtgagcagggcggggtggagcaagagcccgtcggtgtcggtgcgagggggtggcgtgagcgtccccgccaactccctcgcgcctttctcggcccccgccatggtgagcagcacctactgaaggagaagaaggagaagccgccgcgctgataagagaaactcgatgatgagagcatctgcagagagggtgctttcctgctgctgtgaaactggtcaggctccacccgggtaattaaattagcgtactgatagcaaggtataaggttagatcaccaccatcccctagcgactcagcccccctcgttgttcttttatctatcccttcttctcttctccaatgagggaagaggacaaggtggctgtaaatttgtccggaacatcgcctctcttttcgcaa

SEQ ID NO: 1439 - DNA, 2113 bp, Zea mays
ctcacctgagcgcatactagtctctgcatcagctgcatcagagagtagagacctccgagctgctcttcaacacgcagattgggcagagccgcaaggtgcctgccgggagagagtgaaaagtgagagagcgcgcgctcaagggggccaaaaggaatttttttttatccagcttcttagcttgattctatctgatccgggagagcagccgccagtccaactaatccttgctgttggtgtgccggggctttgattgctctccagatctgaggcacctgctgggtggattccaggaatcctagcacgaagttgacagtggagttctcaggtaaaagggaggaaggaagaggctgaaagggcggcggagagagaaaggctataagagcgagctgggtccctcgaggatgccatcaagaaaccgcgtggaggggagggcgatgagatgagggatgctggccgcggtgatggactactttagctcctgctggggcccgcgatcgggtgccgggcaccgggaaaagggctccgacgccgctggccggcaggacggtctcctctggtacaaggacgtcgggcagctcgtcactggggagttctccatggccgtggtgcaggccaaccagctgctcgaggaccagagccaagtggagtccggatcgctctccctggctgacacgggcccgcagggcaccttcgtcggcgtctatgatggccatggcggcccggagacgtcccggttcatcaatgaccacctcttcaaccatctcagaaggtttgcaactgagcacaagtttatgtcagcggacgtgatccggaaagctttccaagcaactgaggagggctttctttctctagtcagcaaggaatggtctttgaagcctcagattgcttcagtgggctcctgctgccttgttggtgtaatctgtgctgggactctctatgttgcaaacctgggcgactcacgtgcagttcttggaaggcttgttaaggcaactggagaggttttggccattcagttgtcatcggagcacaatgcgtgctatgaggaagttagacaagagctgcagtcatcacatcctgatgatccacatattgttgttctcaaacacaatgtttggcgtgtgaagggtatcatccagatctcaagatctattggagatgtatatctaaagaaaccagagtataatagagaaccgcttcacagcaagtttcggcttcgagaaaccttccagaggccgatccttagttctgaacctcaaattactgaacatcgaatacagccaaacgatcaatttgttatatttgcttctgatggtctatgggagcacctcagcaataaggaagcagttgaccttgtccaaagtagtccccgaaatggaatcgctcggagactagtgaaagccgcgatgcaagaagctgccaagaagagggagatgagatattcagacctcaagaagatcgaccgtggtgtgagaaggcatttccacgacgatataactgtcgtcgtggtgttcatgccatgagcaaagctagctggagcaaaagcccctcggtttctcttcgagggggcggtgtcacccttcctgcggagtccctcgcacctttctcagctccggcatggttgaagagcaccaactgaagctgctgctactcttgaaaggaagagcacagtgcaggtctgcaggagagatgaaaaaagaacagcaatcaagtgtagcgttacacttgcacctgctgtgttgttgctcttcgcgaaactactgtcttgactctagactacgcctggtaattagtgcactgatagcgacgcaaatcctttcacattcttttctctccctcgacatgagatgagaattgagatactccattcatccaggaaaataggaccgattatggagaaaagacaaaatttaaccaacaattactcaatgtatgtgtaagtttaggatacaacttatattagtagatttattatattcaattgactccgagattatattactaatttcttttagaaattgaaaacactccattcgttccaaaatagtagtaattttagagaattagtaggttcatataattcttgatgcatgtgttttatatgtgtctagattta

SEQ ID NO: 1440 - DNA, 1448 bp, Hordeum vulgare
ggggcaagaagggctcggacgccgccggccggcaggacgggctgctgtggtacaaggacgccgggcaggcggccacaggcgagttctccatggcggtggtgcaggccaacaacctgctggaggaccagagccaggtggagtccggctcgctctccatggccgaccccggcccgcagggcaccttcgtcggcgtctatgatggccatggcggcccggagacctcccgcttcatcaatgacaacatgttccaccatctcagaagatttgcaaccgagcacaagtgcatgtcggccgatgtgatccggaaagccttccaagcaaccgaggacggcttcctttccgtagtcagcaaggaatggtctgtgaagcctcagatcgcagcagtgggctcgtgttgcctggtcggtgtaatttgctccgggactctctacatcgcaaacgccggcgactcgcgtgcggttctcggacggctcgtcaaggcgaccggtcaggttgtggccatgcagttatcggcggagcacaatgcgtgctacgaggaagttaggcaggagctacagtcatcacaccctcatgatccacaaattgtggttctaaaacacaacgtttggcgtgtgaagggcctcatccagatctcaagatctatcggagatgtatatctgaaaagaccagagtacaacagaacacctctacatagcaagtttcggctccgggaaaccttcaagaagccaattcttagttctgagcctgcaatcgctgtacaccaaatacaaccgagtgatcagtttgttatatttgcttctgacgggctatgggagcacctcagcaatcaggaagcggttgaccttgtccaaactaaccctcgtaatgggatcgctcggaagctagtgaaagccgcgatgcaagaagcggccaagaagagggagatgagatactcggacctgaagaagatcgagcgcggggtgaggcggcatttccacgacgacataacggtggtcgtggtgttcctggacgcgagcgccgtgagcagggcggggtggagcaagagcccgtcggtgtcggtgcgagggggcggcgtgagcgtccccgccaactccctcgcgcctttctcggcccccaccatggtgagcagcacctactgaaagagaatccggcgtgcccgccgagaggagaaactttatgagcagagagtgttcctgctgctgtgaaactgctcacccgggtaattaaactagcgtactgatagcaaggtataaggttagatcaccaccgttccttagcgacgcttttcgccccccctcctcccctttgttcttttatctaccctttttcttttctccaatgagagaggagaacaaggtggctgtaaatttgtccagaacatcgtcgtcgtctcttttcgcaatagtccatctcctttttccgccttcgaaaaccgggtgcttggtggc

SEQ ID NO: 1441 - DNA, 2430 bp, Panicum virgatum
aatcatctcatcatcgtcaccgcctgtcctccacccgggtcccgtcccggcccctcctctccacccggcccggcgcgcggcggcgaccaggctccgccactgccgccccccccgcgtggccgcgtacctcccgcggctgactccgccccgtcaatcagtccgcgcggcgcccgcggtatataaaatatttgaagaagggccatagtacttgatgaaatgaagtcaacagtgttttctgcagttgtcgtttcaattggttatgcattacttggatgggattttgcagcattgtttgaggctaaccgtcatatggaaaaggaatttgaattggagaatggacattctattgacggtataaccatatctgtatcagcatttggggctattgtgataacaatattctctggatcactattagattggcttggaagacgtgccatactggtccattcatctctgctattattttttggtggtctcctgatgctgtggtctcctaacatctatattctacttctagctaggttatttgttggatcagcaagtggtttggttttcacctgtgtccctatttatatatccgaaacatctcctccaaatataaggggattactagtaactatgccacattttatgttcttcataggaactatcttttcctattgctttatattatggttaacactaatgtcttcacctaagtggagaattatgattggtgcaatctttgctccttccatcatctacttggctttgttagtgtactacttgccagagtcacctaggtggcttgcaaatgatggaaagcttagtgaggccagagtttccctgcagtggcttagagggaagaagcatgatatttcaggagaaatagaaactattgtggaaagtgtggactttatctcggacacagccactgagactgaacagggtcaaagtttagccggactcatttctagccatatttggccccagaatactttgtattcgaacctttcagatccactagttggtcttcttggaagcattcatgagactatgtcagaagcaacaggaagcagaaggaatattttcttcccagtcttcaacagtttttcttttctggaacatgaacatatgaatgagaacagggatgatagcaatgatcaacaacctagggaggtttattctgctggagaagctaataatggagatggtttgcggacttctctgctttctcagacagcaagtgttgaagttaatgatacaaatacatcttttacttctgaggggagctcttcatatttaagaaggcatggtacttcagcatttacacaagagtttatgtcatctttacatgatcatgacattgaagaagaagatgaagaaaccagtgggatggcattgcctcaccagcctgcgtatcggtatatggaaaactcaaggagacatccatacagatatcgaatcatccggctatctgaaacagctgatatgaagtctaaatggcgcatgcttcttcagccgggaatcaggtatgccttgtgctatggcatgttacttcaagctcttcagcagtcagcagggatcagtatgcttctccgctacactcctgaaatacttaaacaggttggagtggttagtttgttttcagacattggactttctcctcattcaacatcaattctcataagtgcccttaatgctttgctgatgctcccttgtataactgctgcaatgctgctgatggatgtctgcgggagaagggctcttatactgggaaccactccaatcctgatattatcattgagtgttatgtctttgtccaccctggtggatatgggatcattggagcgtgccatcctcttccacctcgcattaaccatttgcttctgctcctacgtcatcggtttggggccgatacccaatgttctctgctccgagatgttcccaaccaaagcccgtgcaacctgcttgagcttttgttctctttccttctggttcggagggctgctttcagcctactgcttccctgtgatgctgagtaccatcgggctcggtggagcatgtgggatctatgcacttatgtgctgcatagctctttgtctcatctactatagaataccggagatgactgcgtttaacttggagttcatcgccgagctcttccaaaattcaaggcagtcgcggtatatataggttaggttactcaggactgaaggtagctcaggctgggtgctgatggatgatgtgtgtacatataacaaagtggagtttgtacgttgaaacttttgtgctagttttaggaggattggtgatagtgtatctggtgcttaattcttttttttcttttcagattggtagcaatgtttgtagtgttcacagcaagaaattattcactgcatgtatcctttctgagatcgaaataatatttctggggttatacagatt

SEQ ID NO: 1442 - DNA, 2554 bp, Sorghum bicolor
gggaagtggtacagtgctgcatgatactgtcaagcatcgatgagcatgatacactgcaaattgaatgtccaagctgaggatctgatgggtggtgccactggagctcaaggagatgtacagtggtgtaatggtggcaagttagaggaggtggcagtgctgggttgtgcccacaggataatggcagctgaggtttcaaccgtgcaccaggaagtttgcaaaatgtatttctggtttgcaggagcagcaatagcaagcaggttgattgactgtgaggcatacctgaggactgagttctcaggttttataattgtttgcaaaagggctatagtacttgatgagatgaagtcaacagtgttttcggcagttgttgtttctattgggtatgcaatgcttggatgggattttgcagcattattagaagctaatcatcatatgaaaaaagaatttgaattgttgaatggaccttctattgaaggtataactttagctgcctcaacatttggggctattgtgataacaatattctctggagcactattagattggcttggaagacgtgccatactggtttactcgtctctggtattattttcgggaggtgtgctgatgctgtggtctcctaacatctacattgtacttctagctaggttaatcgttggatcaggaagtgggttggttttcacctgtgtccctatttatatatctgaaacatctcctccaaatatgaggggattacttggaactatgccacagtttatgttcttcataggaactatcttttcatattgcctgatattctggttaacactaatgtcttcacctaactggagaatcatgattggtgcaatctttgctccttccattgtctactttgctttgttggtttactacttgccagagtcacctaggtggcttgcaagtgatggaaagattagtgaggccagagtttctctgcaacggcttagagggaagaaacatgatgtttcaggagagatagctgttattgttgatggtgtggacatcatatcggactccgctgttggcactgctcgagctcaaagtttctctggaaccagtgctagccgcacttggccccgtagtactttttattggcagctttcggatccactagttgatcttctcggaagcattcatgagaatatgtcagaaggaggaagtagacggaatagtttcttcccagtcttcaacagtttttcttttccagaacatgaacatatgaatgagcacagggatggtaacagtgatcaacagactagggaggcttattctgctggagaagttaacaatggagatggtttgcgggcttctctgctttctcaggcagcaagtgttgaagtaaatgatgcaaatacctcttttacttctgaagggagctcttcatatttaagaaggcatggaacatcagtacttgcgcaagagtttatggcatctatacatgatcatgacattgaagaagaagaagaaatccatggttttgtattgcctcaccagtctgcacctcgtgatatggaaagcagagggcgacatcaagtagtccggctatctgaaacagctgatatgaagtttaaatggcgggtgcttcttcaaccaggaatcaggcatgccttgtgttatggcatgttaattcaagcccttcagcagtctacaggaatcagtggtcttctccgctgtgctcctgaaatacttgaacaggttggagttagcttgttttcagacattggactttctccgcattcaacatcaattctcataagtaccctccaagctttgctgatactcccttgtataactgccgcaatgctgctgatggatgtctgtggaagaagggttcttgtgctggccactactcctatccttatattatcattgagcgttatgtctatgtccatcctgttcaatatgggaccgtttgaccgtgccatcgtcttccacttcgcattaacagtttgcttctgctcctatgtcattggtttgggaccaatacccaacattctctgctcagagatatttccaactaaggcccgtgcgacctgtgcaagtttctgttcgctttccttctggtttgggggcctgctttcagcgtactgcttgcctgtgatgatgagcaccattgggcttggcggagcatgcgggatctatgcacttgtgtgctgcgctccactttttctgttctactatcggataccagagacgaagatgctcaacttggagctcatcgcagagctattcaagctttcaaggcaggagtatgtacagtagactgtccaggactcaaggtagcccaggctgagtgttgatggatgatgtgtgtacatatgacaaatgtagctttgattgttgattttttttttgctagttaggaggattggtgatagtttatgaagtggtttacccttttattgtacatagatttgtagcagtgtttgtagtgttttgttttattgccttcagatgtacaacaagaaatccttgagaacaagattcatttctaagagcgaaataatattgctgcggacttactcattatgttacc

SEQ ID NO: 1443 - DNA, 2509 bp, Sorghum bicolor
atcgatgagcatgatacactgcaaattgaatgtccaagctgaggatctgatgggtggtgccactggagctcaaggagatgtacagtggtgtaatggtggcaagttagaggaggtggcagtgctgggttgtgcccacaggataatggcagctgaggagcagtatgtgagggtggttctgctcttgtacctgtataggatagcgccaagtgaagattttaggttttcatttttcaaattaaaggtttcatattttgtaggttttataattgtttgcaaaagggctatagtacttgatgagatgaagtcaacagtgttttcggcagttgttgtttctattgggtatgcaatgcttggatgggattttgcagcattattagaagctaatcatcatatgaaaaaagaatttgaattgttgaatggaccttctattgaaggtataactttagctgcctcaacatttggggctattgtgataacaatattctctggagcactattagattggcttggaagacgtgccatactggtttactcgtctctggtattattttcgggaggtgtgctgatgctgtggtctcctaacatctacattgtacttctagctaggttaatcgttggatcaggaagtgggttggttttcacctgtgtccctatttatatatctgaaacatctcctccaaatatgaggggattacttggaactatgccacagtttatgttcttcataggaactatcttttcatattgcctgatattctggttaacactaatgtcttcacctaactggagaatcatgattggtgcaatctttgctccttccattgtctactttgctttgttggtttactacttgccagagtcacctaggtggcttgcaagtgatggaaagattagtgaggccagagtttctctgcaacggcttagagggaagaaacatgatgtttcaggagagatagctgttattgttgatggtgtggacatcatatcggactccgctgttggcactgctcgagctcaaagtttctctggaaccagtgctagccgcacttggccccgtagtactttttattggcagctttcggatccactagttgatcttctcggaagcattcatgagaatatgtcagaaggaggaagtagacggaatagtttcttcccagtcttcaacagtttttcttttccagaacatgaacatatgaatgagcacagggatggtaacagtgatcaacagactagggaggcttattctgctggagaagttaacaatggagatggtttgcgggcttctctgctttctcaggcagcaagtgttgaagtaaatgatgcaaatacctcttttacttctgaagggagctcttcatatttaagaaggcatggaacatcagtacttgcgcaagagtttatggcatctatacatgatcatgacattgaagaagaagaagaaatccatggttttgtattgcctcaccagtctgcacctcgtgatatggaaagcagagggcgacatcaagtagtccggctatctgaaacagctgatatgaagtttaaatggcgggtgcttcttcaaccaggaatcaggcatgccttgtgttatggcatgttaattcaagcccttcagcagtctacaggaatcagtggtcttctccgctgtgctcctgaaatacttgaacaggttggagttagcttgttttcagacattggactttctccgcattcaacatcaattctcataagtaccctccaagctttgctgatactcccttgtataactgccgcaatgctgctgatggatgtctgtggaagaagggttcttgtgctggccactactcctatccttatattatcattgagcgttatgtctatgtccatcctgttcaatatgggaccgtttgaccgtgccatcgtcttccacttcgcattaacagtttgcttctgctcctatgtcattggtttgggaccaatacccaacattctctgctcagagatatttccaactaaggcccgtgcgacctgtgcaagtttctgttcgctttccttctggtttgggggcctgctttcagcgtactgcttgcctgtgatgatgagcaccattgggcttggcggagcatgcgggatctatgcacttgtgtgctgcgctccactttttctgttctactatcggataccagagacgaagatgctcaacttggagctcatcgcagagctattcaagctttcaaggcaggagtatgtacagtagactgtccaggactcaaggtagcccaggctgagtgttgatggatgatgtgtgtacatatgacaaatgtagctttgattgttgattttttttttgctagttaggaggattggtgatagtttatgaagtggtttacccttttattgtacatagatttgtagcagtgtttgtagtgttttgttttattgccttcagatgtacaacaagaaatccttgagaacaagattcatttctaagagcgaaataatattgctgcggacttactcattatgt

SEQ ID NO: 1444 - DNA, 2004 bp, Saccharum officinarum
attgggtatgcattgcttggatgggattttgcagcattattagaagctaatcatcatatggaaaaagaatttgaattgttgaatggaccttctattgaaggtataactttagcagcctcaacatttggggctattgtgataacaatattctctggagcactattagattggcttggaaggcgtgccatactggtttactcatctctggtattattttcgggtggtgtcctgatgctgtggtctcctaacatctacattgtacttctagctaggttaattgttggatcaggaagtgggttggttttcacctgtgtccctatttatatatcggaaacatctcctccaaatatgaggggattacttggaactatgccacagtttatgttcttcctaggaactatcttttcatattgcctaatattctggttaacactaatgtcttcacctaactggagaatcatgattggtgcaatctctgctccttccattgtctactttgctttgttggtttactacttgccagagtcacctaggtggcttgcaagtgatggaaagattagtgaagccagagtttctctgcagtggcttagagggaagaaacatgatgtttcaggagagatcgctgttattgtggaaggtgtggacatcatatcggactctgctgttggcactgctcgtgctcaaagtttctctggaaccagtgctagccacacctggccccgtagtactttttactggcagctttcggacccactagttgatcttctcggaagcattcatgggaatatgtcagaaggaggaagtagacggaataagttcttcccagtcttcaacagtttttcttttccagaacatgaacatatgaatgagctcagggatggtaacagtgatcaacagactagggaggcttattctgctggagaagttaacaatggagatggtttgcgggcttctctgctttctcaggcagcaagtgttgaagtaaatgatacaaatacctcttttacatctgaagggagctcttcatatttaagaaggcatggaacatcagtacttgcgcaagagtttatggcgtctatacatgattatgacattgaagaagaagaagaaattcatgggttcgtatcgccccaccagtctgcacctcgtgatatggaaagcacagggcgacatccattcagacatcaaatagtccggctatctgaaacagctgatatgagtttaaatggcggggcttcttcaaccaggaatcaggcatgccttgtggtatggcatggtaattaaagcccttcagcagtctacaggaatcagtggtcttctccgctgtgctcctgaaatacttgaacaggttggagttagctggttttcagacattggactttctccacattcaacatcaattctcatatgtacccttcatgctttgctgatactcccttgtataactgccgcaatgctgctgatggatgtctgcggaagaagggttcttgtgctggccactactcctatccttatattatcattgagcgttatgtctatgtccaccctgttgaatatgggattgttcgagcgtgccatcgtcttccacttcgcattaaccatttgcttctgctcctatgtcgttggtttgggaccaatacctaacattctctgctctgagatattcccaaccaaggcccgcgcgacctgtgcaagtttctgttcgctttccttctggtttgggggtcttctttcagcgtactgcttcccggtgatgctgagcaccatcgggcttggcggagcatgcgggatctatgcacttgtgtgctgcgctccactctttctgttctactatcgaataccagagacgaagatgcttaacttggagctcattgcagagctgttcaaactttcaaggcaggagtatgttcagtagattgtccaggactcaaggtagcccaggctgaacgctgatggatgatgtgtgtacatatgacaaatgtaactttggatgttgaaattttg

SEQ ID NO: 1445 - DNA, 924 bp, Pennisetum glaucum
tctccacccaccagtcttcccctctctcctcccctctccaaatctcgggggaggccatcaaatcgcaggggcgccgggagccggagcgcgggagggtgggagaggaatggagccagcggagcgaatcgagtccaggaaggcactgggtaagcgcccgaggagcagggttcttccccggacggccagcatggtgacggtgccgtcggcggccaagcagggccgccaggagcggggcgccggcgtgacgtcgtccacttccctcccagctggtggcgcgatgatgggagccggaggatccggcgccgcgccgagggcgtactactccggcggctacctcgccggcgcggagacgacggcggcgttcttgaaggcgtgcggcctctgcaaccgccgcctcggacccggccatgacaccttcatctacaggggcgaggtggcattctgcagccaggagtgccgggagaagcagatcgagtacgacgagcgcatggagcagacctgctccctgacctccatcaaggaggccccgtccgtctccggcgccagcggctccgaccagtccggcagcggcggggagaccgtcgccgccgcctagtagcgtagccgccccaacggcggcaaagcggtgcatgttgccccgcttggcgccctgcggataggagcagcggcaccagatggagtcgagatcagtcgtccgtcccttgttagtttccccgggctagtgctatagcgtctgtgtatactggcttttagcgctagaagtcgtcgtcgtcgctcatgaaccgtagcgggcagcgggagaggatcctcagcagaggaatgcgtcggtgattaaatttagccgtcactgacgcgtgtatctctggaatctttgccttgactgtcggaacgaagaagaaaaaaacttgttgcaatgtttgatcc

SEQ ID NO: 1446 - DNA, 804 bp, Saccharum officinarum
ctccccacctctccaaatctcgcgacgagaaatcccatctcgaaccacagggcgcgccagccgccggcagcgggagcgcgggagggagggataggagaggaggatatggagccggctgagcgaatcgagtccgggacggcgctggggaagcggccgaggagcagggtgctgccgcggacggccagcttggtgacgctgccatcggcggcgaagcaggggcgccaggagcgggtgggcaccggcgtgccgtcgtcgtcctcagtgcccgctggcggcgtcgggatgggagccggagccggcggcggcggcgccgtgccgggttactactacggcggctcattctccgcggtggagacggcggccttcctgaaggcgtgcggcctctgcaaccgccgcctcggacccggccacgacaccttcatctacaggggcgaggtggcattctgcagccaggagtgccgggagaagcagatcgagtacgacgagcgcatggagcagacctgctccctcacctccatcaaggaggccccgtccgtgtccggcgctagcagctccgaccagtctggcagcggcggggagaccgtggctgccgcctagtccgcgtggcgcaaggggtggtgtatgttgttgcgccttgagcagcaggaggagcgacgccagatcgatcgatcggcccgttgttttcgccatgctagagcgttctgtgcagagtacagctttagctctagattccggcagtgatgaatgcgtcaatgatttattagtaggtgattgatgtatgtaactctggaaacatggcgttct

SEQ ID NO: 1447 - DNA, 995 bp, Zea mays
ctccctctctcccagtccccagtccccacccaccaccagtcttcctcgctctccaaatctcgcgacgagaaagcccatctaggaccacaggggcgcgccagccggcaggaacgacgggagaggagggcatggagccggctgagcggatcgagtcggccgggacggcgctggggaagcgtccgaggagcagggtgctgccgcgcacggccagcatggtgacggtgccgtcggcggcgaagcaggggcgccaggagcggggcgccggcgtgccgtcgtcctgctcactgccggctgcctgcgccgggatggtggccgtgccggggggttactactactgtggcacctcgttcgcggcggtggagacggcggccttcctgaaggcgtgcggcctctgcaaacgccacctcgggcccggccacgacaccttcatctacaggggcgaggtggcattctgcagccaggagtgccgggagaagcagatcgagtacgacgacctcgacgagcgcatggagcagacctgctccgtgacctccatgaaggaggccccgtccgtgtccggcgccagcggctccgaccagtccggcagcggcggggagaccgtggccgccgcctaggagccccccgggggagtggcgcaagggggcgggcggggtgtgtgttgttgcgccctggtggagcgggagcagcgacgccggccgatcggtcggcccggcccggtagattccgccatgctatagagcgcctgtgcatacagcttttagctctggagtctggattccggcagtgatgcatgcgtcagtgatttattattatagtttgttgatgcatgtgactctggaaacatagcccctcttgtctgtcgaaacaaacaaacaaagagagagagagagaaaaaaggcaggtacccgggttgcaacaagccaacaacaacagactctcgtccgccatggcatctgtctgtcctggtttcccacatgttgtgctgtcaagcggac

SEQ ID NO: 1448 - DNA, 807 bp, Setaria italica
ccattaccaagttatacacttcttccaccctccacctcccgagcctcctctgctcactccaccgagctggctagcgacaagtccgatgtcatcgtcggcgatgccggcctgtgcctcgacgacggcaaggcggcggccgtgagcagcaaggcggtggtggaggagctgtaccgtgctctggagcgcggcgacgtggacgccgtgcgccggctgctgaacccggacgtggactggaggttccacggcccgcgcgcgcaccagcacctggtgctcatgcgcctgctcaccggcggcgctggcgccggcggcctcccgttcaagatccggtccctggacgcgttcggacccaccgtgctggcggagggcaccgacgcgacgggcgcgctgtactgggtgcacgcgtggaccgtgggtcccggcggccgcgtcaccgaggtgcgcgagtactgcaacaccgcgctcgtcgtgacgaggctcggtggtgacggcgacgccgccgcggcggctgcgtcggagacggcgaaggcggcgtgctcgcagtctcagtcgaagcaggtgtggcagagccggctgcccgaccgggctcgcaggaacctccctggcctcgtgcttgccatctgatctgaatatctggtcagatgcgaatcatcgtgccatatatgcttccgattctgaactggctgtctggcttctaccgtgtggacaggagccctgcatgtttccaatgtggttacagggacatgaatgaatcaaataccttaaaaaaagtaaaagaattcaagtgatacttgtgtgatgtgattcctg

SEQ ID NO: 1449 - DNA, 861 bp, Setaria italica
atcatgctcgcctgacaagccaagccagcgagcgactaccccaagttgctctataaaaggacctgccgaccagctctgcagctctggcacactccattaccaagttatacacttcttccaccctccacctcccgagcctcctctgctcactccaccgagctggctagcgacaagtccgatgtcatcgtcggcgatgccggcctgtgcctcgacgacggcaaggcggcggccgtgagcagcaaggcggtggtggaggagctgtaccgtgctctggagcgcggcgacgtggacgccgtgcgccggctgctgaacccggacgtggactggaggttccacggcccgcgcgcgcaccagcacctggtgctcatgcgcctgctcaccggcggcgctggcgccggcggcctcccgttcaaaatccggtccctggacgcgttcggacccaccgtgctggcggagggcaccgacgcgacgggcgcgctgtactgggtgcacgcgtggaccgtgggttccggcggccgcgtcaccgaggtgcgcgagtactgcaacaccgcgctcgtcgtgacgaggctcggtggtgacggcgacgccgccgcggcggctgcgtcggagacggcgaaggcggcgtgctcgcagtctcagtcgaagcaggtgtggcagagccggctgcccgaccgggctcgcaggaacctccctggcctcgtgcttgccatctgatctgaatatctggtcagatgcgaatcatcgtgccatatatgcttccgattctgaactggctgtctggcttctaccgtgtggacaggaaccctgcatgtttccaatgtggttacagggacatgaatgaatcaaataccttaaaaaaaa

SEQ ID NO: 1450 - DNA, 611 bp, Saccharum officinarum
agcgcggcgacgtggacgccgtgcgccgcctgctgaacccggacgtggactggtggttccacggcccgcgcgcgcatcagcacctggtgctcatgcgcctgctcaccggcgccggcggcggcctcccgttcaagatccggtccctggacgccttcgggccgaccgtgctggccgagggcaccgacgcgacgggtgcgctctactgggtgcacgcgtggaccgtgggccccggtggccgcgtcaccgaggtgcgcgagtactgcaataccgcgctcgtcgtgacgaggcttggcggcggtggtggcgccgacgccgctgcggcggcggcggaggaggaggccaaggcgacgttctcgcggtccccgtcaaaacaggtgtggcagagccggctgctccccgaccgggctcgcaggaacctccctggcctcgtgcttgccatctgatcggatcagatgcgaatcatgccatatatgcttctaaactggcgtgtggcttattatgctttctagagactagagatgggctatgcatgtcttcaaaatgtggttacaattggacgtgaatgaatcaaatgcgtcacattaaaaaattgaaattagtcgaagcaaatc

SEQ ID NO: 1451 - DNA, 687 bp, Setaria italica
ttggaatcatgctcgcctgacaagccaagccagcgagcgactaccccaagttgctctataaaaggacctgccgaccagctctgcagctctggcacactccattaccaagttatacacttcttccaccctccacctcccgagcctcctctgctcactccaccgagctggctagcgacaagtccgatgtcatcgtcggcgatgccggcctgtgcctcgacgacggcaaggcggcggccgtgagcagcaaggcggtggtggaggagctgtaccgtgctctggagcgcggcgacgtggacgccgtgcgccggctgctgaggacgtggactggaggttccacggcccgcgcgcgcaccagcacctggtgctcatgcgcctgctcaccggcggcgctggcgccggcggcctcccgttcaaaatccggtccctggacgcgttcggacccaccgtgctggcggagggcaccgacgcgacgggcgcgctgtactgggtgcacgcgtggaccgtgggttccggcggccgcgtcaccgaggtgcgcgagtactgcaacaccgcgctcgtcgtgacgaggctcggacggcgaaggcggcgtgctcgcagtctcagtcgaagcaggtgtggcagagccggctgcccgaccgggctcgcaggaacctccctggcctcgtgcttgccatctgatctgaatat

SEQ ID NO: 1452 - DNA, 1564 bp, Sorghum bicolor
actgacagtcatatgcatgccgtcaccatcacattctggtagagataacggtatgcaggcaatcgggacgcccgcgatatgcaacgtgtggcgcaggcaggtgatccacgattcgctgccttatcctcgcgagctactgccgcaccagcctgcgagcctccattgagagcgctcaaccagccattgagagcgtcagaggtcagtagagaaatggcgggagcgagcttcctctcgaccgcgccgctcgttgcccgcggcgtcgctgcctgctcttccatttcgactccgacgcggaggcacccgcacattcgagtttgctgccgggctgacgctgagggctcggaggctgctgctcatgaagagcgtctgcgattccgccggagagatttcattggcacctgcgtcgggagcgccattggtttggaattgatcgacggttctacaagattctctggagtggctactgcagctgatctcattgagcgtagacaacggtcggagttccagtcaaaaatcaaagatacgctctacgtagccataaaggctaagccagagctcgttccatcattgttgaccttggcactgaatgatgccatgacatatgacaaggccacaaaaactggaggagcaaatgggtctatcaggctagaaacaagcagacctgaaaacagtgggctctctgctgcattggatttgctgactgaagccaaaaaggagatagattccttttccaagggaggtcccatttcatttgcagatctgatccagtttgcagcacaatcagcactgaagagatcatttcttgacgcggccattgccaaatgtggtggaaatgaagagaagggaagaaccctatactctgcatatggttcaaatgggcagtggggtctgttcgatagaacattcgggagagcagatgcacaggaagcagatccagagggaagagtgcctgagtggagcaaagcttctgtgcaggagatgaaggataggttcgtcgctgttgggctgggtcctcgccagcttgctgttatgtcagcattccttggacctgaccaggctgctaccgaggaacgactgatagctgatccagattgccgtccatgggtggagaagtaccagcggagccgcgagactgtctcccggactgactacgaagttgacctgattaccacactcacaaagctgagctccttcggccagaacataaactatgaagcctacacataccctaagcaaaagattgacctgggcaaattgaaactgtaaagatatttgccaggcacctgcatcggccatacccaggattcaggagctcataatatggtaggctctggctgctaaagagtgatttgattcggcactgacgttcatgtattggctactcatcagctgtcagacattcttccccggcaattaggatggtccctgtacatggtgaatttggttctccgattttgttttgtgtgagccaaacgcttgtgagaaatgtggtgttgtgtaaattcctttacgtacgtgagactattgaagaattaatagaaacaaagtgcaagttatatgactg

SEQ ID NO: 1453 - DNA, 1523 bp, Sorghum bicolor
ccgcgatatgcaacgtgtggcgcaggcaggtgatccacgattcgctgccttatcctcgcgagctactgccgcaccagcctgcgagcctccattgagagcgctcaaccagccattgagagcgtcagaggtcagtagagaaatggcgggagcgagcttcctctcgaccgcgccgctcgttgcccgcggcgtcgctgcctgctcttccatttcgactccgacgcggaggcacccgcacattcgagtttgctgccgggctgacgctgagggctcggaggctgctgctcatgaagagcgtctgcgattccgccggagagatttcattggcacctgcgtcgggagcgccattggtttggaattgatcgacggttctacaagattctctggagtggctactgcagctgatctcattgagcgtagacaacggtcggagttccagtcaaaaatcaaagatacgctctacgtagccataaaggctaagccagagctcgttccatcattgttgaccttggcactgaatgatgccatgacatatgacaaggccacaaaaactggaggagcaaatgggtctatcaggctagaaacaagcagacctgaaaacagtgggctctctgctgcattggatttgctgactgaagccaaaaaggagatagattccttttccaagggaggtcccatttcatttgcagatctgatccagtttgcagcacaatcagcactgaagagatcatttcttgacgcggccattgccaaatgtggtggaaatgaagagaagggaagaaccctatactctgcatatggttcaaatgggcagtggggtctgttcgatagaacattcgggagagcagatgcacaggaagcagatccagagggaagagtgcctgagtggagcaaagcttctgtgcaggagatgaaggataggttcgtcgctgttgggctgggtcctcgccagcttgctgttatgtcagcattccttggacctgaccaggctgctaccgaggaacgactgatagctgatccagattgccgtccatgggtggagaagtaccagcggagccgcgagactgtctcccggactgactacgaagttgacctgattaccacactcacaaagctgagctccttcggccagaacataaactatgaagcctacacataccctaagcaaaagattgacctgggcaaattgaaactgtaaagatatttgccaggcacctgcatcggccatacccaggattcaggagctcataatatggtaggctctggctgctaaagagtgatttgattcggcactgacgttcatgtattggctactcatcagctgtcagacattcttccccggcaattaggatggtccctgtacatggtgaatttggttctccgattttgttttgtgtgagccaaacgcttgtgagaaatgtggtgttgtgtaaattcctttacgtacgtgagactattgaagaattaatagaaacaaagtgcaagttatatgactgaattcatgtttctgatcagaagcaggacag

SEQ ID NO: 1454 - DNA, 1605 bp, Setaria italica
atatgcaacgtgtggcgcagacaggtaacctacgatttcgccgccttatcctcgcgcgccactccggcaccgccacgccagccagcagcctgaagcactgaagcagccaagcgtcatcatctctgcatcagccgcgcgcgaagtggcgagcagctgaaaatggcgggggcggccttcctctccaccgcgctgctcggcgcccgcggcgtcgctgcctcctcgtcctcttccgtctcgtctccggcacggaggcacgcgcacattcaagtctgctgcaagggcaatgttgagggcctcgaggctgctggtcatgacgagcgtctgcgattccgtaggagggatttcatcggcagctgcgtcgggaccgccattggtctggaaatgattgagggctcttccaaattcacgggagaggcaactgcagctgatctcattgagcgtagacaacgctctgagttccaatcaagcatcaaggataccctctatacagccataaaggctaagccagagctcgttccatctttgttgaccttggcactgaatgatgccatcacatatgacaaggccacaaaaactggaggtgcaaatggatctatcaggctagaaataagcagacctgaaaacagtgggctctctgctgccttggatctgctgactgaagccaaaaaggagatagattccaattccaagggaggtccaatttcatttgcagacctgatccagtttgcagcacaatcagcactgaagagatcatttcttgatgcggccattgccaaatgtggtggaaatgaagataagggaagaaccctatactctgcatatggttcaaacgggcagtggggcctgttcgacagaacatttgggagaacagatgcacaagatgctgacccagagggaagggtacctgattggagcaaagcttctgtgcaggagatgaaggataggttcgttgctgttgggttgggtcctcgccagcttgctgtgatgtcagccttcctcggacctgaccaagccgctaccgaggaacgactgattgctgatccagattgccgcccatgggtcgagaagtaccaaaggagtcgtgaaacagtatcccggacagactatgaagttgacctgataaccgcactcacaaagctgggctccctaggccagaagataaattatgaagcctacacgtaccctaagcaaaagattgacctgggcaaattgaaactgtgagagagatgcttgccgggtatctgcattggccagactcttctcatgatctggtggttccgtctgctcaagagtgactcattcggcggtggttctggttcatgtattggcggttcatcagctgtctgacttcattttcggacatttctccattgcaattaggacggtccgtctactagatggttagatttcgaatttcattgtctggtttcgttttccgtggacttgaaagtgccagccatgattgggagaagcgaggtgttgtgtaaattctcttcttgtgcagtatacatacatgtgactctgagtatgtgacgactgaagaatcaagaacaataaaaatgtaagatatatctgaagccccctgaactaccgattctgatcaga

SEQ ID NO: 1455 - DNA, 1085 bp, Setaria italica
ctgaaaatggcgggggcggccttcctctccaccgcgctgctcggcgcccgcggcgtcgctgcctcctcgtcctcttccgtctcgtctccggcacggaggcacgcgcacattcaagtctgctgcaagggcaatgttgagggcctcgaggctgctggtcatgacgagcgtctgcgattccgtaggagggatttcatcggcagctgcgtcgggaccgccattggtctggaaatgattgagggctcttccaaattcacgggagaggcaactgcagctgatctcattgagcgtagacaacgctctgagttccaatcaagcatcaaggataccctctatacagccataaaggctaagccagagctcgttccatctttgttgaccttggcactgaatgatgccatcacatatgacaaggccacaaaaactggaggtgcaaatggatctatcaggctagaaataagcagacctgaaaacagtgggctctctgctgccttggatctgctgactgaagccaaaaaggagatagattccaattccaagggaggtccaatttcatttgcagacctgatccagtttgcagcacaatcagcactgaagagatcatttcttgatgcggccattgccaaatgtggtggaaatgaagataagggaagaaccctatactctgcatatggttcaaacgggcagtggggcctgttcgacagaacatttgggagaacagatgcacaagatgctgacccagagggaagggtacctgattggagcaaagcttctgtgcaggagatgaaggataggttcgttgctgttgggttgggtcctcgccagcttgctgtgatgtcagccttcctcggacctgaccaagccgctaccgaggaacgactgattgctgatccagattgccgcccatgggtcgagaagtaccaaaggagtcgtgaaacagtatcccggacagactatgaagttgacctgataaccgcactcacaaagctgggctccctaggccagaagataaattatgaagcctacacgtaccctaagcaaaagattgacctgggcaaattgaaactgtgagagagatgcttgccggg

SEQ ID NO: 1456 - DNA, 1411 bp, Panicum virgatum
ccgcgagcagctgaaaaaatggcgggggcggccttcctctcgaccgcgcaggctcccgcgctgctcggcgcccgcggcgtcgctgcctcgccgtccgtctcgactccggcgcggaggcacctgcacattcaagtctactgcaagggcaatgttgagggcattgaggccgctgatcatgaagagggtctgcgattccggagaagggacttcatcagcggctgcgtcgggacggccattggtctggaatttattgagggctccaccaaattcacaggagtggctactgcagctgatctcatcgagcgtaggcaacgctctgagttccaatcaagcatcaaggataccctctatacagctataaaggctaagccagagctcgttccatctttgttgaccttggccctgaatgatgccatcacatatgataaggccacaaaaactggaggtgcaaatggatctatcaggctagaaataagcagacctgaaaacagtgggctctctgctgcgttggatctgctgactgaagccaaaaaggagatagattccaaatccaagggaggtccaatttcatttgcagatctgatccagtttgcagcacaatcagcactgaagagatcatttctggatgcggccattgccaaatgtggtggaaatgaagagaagggaagaaccctatactccgcatatggttcaaacgggcagtggggtctgttcgacaaaacattcgggagaacagatgcacaagaagctgacccagagggaagggtacctgattggagcaaagcttctgttcaggagatgaaggataggttcgttgctgttgggttgggtcctcgccagcttgctgtgatgtcagccttccttggacctgaccaggctgctacggaggaacaactgattgctgatgcagattgccgtccatgggtcgagaagtaccagcggagtcgtgagacagtctcccggacagactatgaagttgacctgataaccacactcacaaagctgagctcccttggccagaagataaattacgaagcctacacataccctaagccaaagattgacctgggcaaattgaaactgtgagagatgctgccgggcatctacatcggccatgttcaggaaccagaagctcgtgtactagtgggctccggctgctcaggagtgatttgattcggtgacgttcatgtaatggctgctcatcggctgtcagacttttttttttccatggcaattaggatggtacgtatagatattagatttcattgtctggtttcgtttttcctgaacttgaaagtgccagacatgattggaagaggcgaggtgttctgtaaattctcttcttgtgcactctacttgtgattatgtgaccaccgaatcacaaattgaaataaagtgcaaggtatatctg

SEQ ID NO: 1457 - DNA, 1548 bp, Pennisetum glaucum
ccagcagcccgaagcactgaaagcagccaagcatcatcatctctgcaatctgcatcagccacgcgcgaagaggcgagcagctgaaaaaatggcgggggcgtcgttcctctccaccgtgcaggctcccgcgctcctcggcgcccgcggcgtcgctgcctcctcgtcctctcccgtctcgtctccggcacggaggcacgcgcacattcaagtctgctgcaagggcaatgctgacggcgctcatgacgagcgtctgcgattccggaggagggatctcatcggcggctgcgttggaaccgccattggtctgaaaatgattgagggctcttccaaactcacgggagtggcaactgcagctgatctaattgagcgtagacagcgctctgagttccagtcaagcatcatggataccctctatacagccataaaggctaagccagagctcgttccatctctgttgaccttagcactgaatgatgccatcacatatgacaaggccacaaaaactggaggtgcaaatggatctatcaggctagaaataagcagacctgaaaacagtgggctctctgctgcgttggatctgctgactgaagccaaaaaggagatagattccaattccaagggaggtccaattacatttgcagacctgatccagttcgcagcacaatcagcactgaagagatcatttcttgatgcggccattgccaaatgtggtggaaatgaagagaagggaagaaccctatactcagcatatggttcaaatgggcagtggggcctgttcgacagaacatttgggagaacagatgcacaagaagctgacccagagggaagggtacctgattggagcaaagcttctgtgcaagagatgaaggataagttcattgcagtcgggttgggtcctcgccagcttgctgtgatgtcagcattcctcgggcctgaccaagccgctaccgaggaacgactgattgctgatccagattgccgcccatgggtcgagaagtaccaaaggagtcgtgaaaccgtatcccggacagactatgaagttgacctgataaccacactcacaaagctgagctccctaggccagaagataaattatgaagcctacacataccctaagcaaaagattgacctgggcaaactgaaactgtgagagagatgcttgtcgggtatctgcattggccagactctttcaggatcggtggttccgtctgctctagagtgactcgtttggcggaggttctggttcatgtattggcagtgcatcagcttcctgacttcagtttcggacatttctcctttgcaattaggatggtctgtctattagatggttagattttcattgtctggtttcttttccgtgaacttgaaagtgccagccatgattgggagaagcaaggtgttgtgtaaattttcttattgtgcagcacactacacgtacatgttactcttgagactcctttgcaattagggcgactgaagaatcaaaatgcaagataactaacaaaaaaaaaaaaaaaaaaaaaaagtaactaactagacgttagataa

SEQ ID NO: 1458 - DNA, 1328 bp, Sorghum bicolor
atttctacgcgcaccacccgttcgtcgccggtgactcgtctcggctcgcgctacttctacttcggaatcgcccaccggtctcgcccaatcatacaccagcgcctcggaccatcatcaactgtcgcaggagctcgcgggggcggtccgatcggtggtgcagcgcgcgatggcggcggcgcctacggtgcggggctacgggccgtcgtcgtcagtggcactgcctcggccgcgatcgcgggtgcctgcgtcgctcgtgcccgtggcgaggcggcgggcgccgtcgtcggtgcgcctgcgcgccgcggtcgcggacgcgccccgcggcggcctgcagctccagcggcgggaggaggatgagaaggaggggttgtcggggaccgtgttcggcagaggagaggaggatgaggtgttggagaaggtcggggaggagaaggtggaggggtggatgcgggagtcgatcgccgagatcgtgcggcacatcggggaggccccgttcctggtgcacctgttcagcaacgacgacggcgagggcgaacgcgtgaccgtgcggcgggagcccgcggcgcccgagagctgggctgacgtgcggcgccggtgggggcctggcgggcagcggaagcccgacgggatcatcctcgtcgagcaggtggccgcggacggcggcgcctccgcctcggaggcggcgcggcaggtgtggggcctggtggtgcaggcgcgcggcatggagtgcgcgtcgtgctacgtgctcgacacctgccgtgtccgctcgccggccgggttctgcacgcacttctgcctcgcgcgggtgcagtgcttcggcgaccccgtcgagctccagctccgcaatgcctggctcaaccgcctcgccggccgccgatagccgcccgttggtcgctgctgctactactgattctactactaatagtattcgattcgatgcgtcaaggaccaaatgcaacgatgatgcctcctcttcgctggcaagaacgaggaagagaagcatgcagattggaagcagggaaggcgaacagaatccatcaaatcttttcgttcagttcggtttctccctgaattggatatcaaatattttcgttcagttcggcttctccctgaattggatgtcaattgtacagattattggttgtaattcttgcttattcaatcaagaagcgattcatcgaggcaaattgcagttcattgggtatttgctaatccgaaattctccgagaacctgataacctcttgctctcgttgcacggcaagtgacgacatggttacgattccgccgtaaagttacgcgatgacgcctctttgttttggtttttttt

SEQ ID NO: 1459 - DNA, 1348 bp, Sorghum bicolor
gcgtccacgtaggccgccacggcgcgcagcagagccgttccaggaagcaacagggcggttgcgcgtcggagacctctgccgtgccggctcccccaatccgcatcgctcccccccgcccaacctatttctacgcgcaccacccgttcgtcgccggtgactcgtctcggctcgcgctacttctacttcggaatcgcccaccggtctcgcccaatcatacaccagcgcctcggaccatcatcaactgtcgcaggagctcgcgggggcggtccgatcggtggtgcagcgcgcgatggcggcggcgcctacggtgcggggctacgggccgtcgtcgtcagtggcactgcctcggccgcgatcgcgggtgcctgcgtcgctcgtgcccgtggcgaggcggcgggcgccgtcgtcggtgcgcctgcgcgccgcggtcgcggacgcgccccgcggcggcctgcagctccagcggcgggaggaggatgagaaggaggggttgtcggggaccgtgttcggcagaggagaggaggatgaggtgttggagaaggtcggggaggagaaggtggaggggtggatgcgggagtcgatcgccgagatcgtgcggcacatcggggaggccccgttcctggtgcacctgttcagcaacgacgacggcgagggcgaacgcgtgaccgtgcggcgggagcccgcggcgcccgagagctgggctgacgtgcggcgccggtgggggcctggcgggcagcggaagcccgacgggatcatcctcgtcgagcaggtggccgcggacggcggcgcctccgcctcggaggcggcgcggcaggtgtggggcctggtggtgcaggcgcgcggcatggagtgcgcgtcgtgctacgtgctcgacacctgccgtgtccgctcgccggccgggttctgcacgcacttctgcctcgcgcgggtgcagtgcttcggcgaccccgtcgagctccagctccgcaatgcctggctcaaccgcctcgccggccgccgatagccgcccgttggtcgctgctgctactactgattctactactaatagtattcgattcgatgcgtcaaggaccaaatgcaacgatgatgcctcctcttcgctggcaagaacgaggaagagaagcatgcagattggaagcagggaaggcgaacagaatccatcaaatcttttcgttcagttcggtttctccctgaattggatatcaaatattttcgttcagttcggcttctccctgaattggatgtcaattgtacagattattggttgtaattcttgcttattcaatcaagaagcgattcatcgaggcaaattgcagttcattgggtatttgctaatccgaaattctcc

SEQ ID NO: 1460 - DNA, 1156 bp, Zea mays
atttctacgcgcaccacccgttcgtcgccggtgactcgtctcggctcgtgctacttctacttcggattgccaccggtctcgccaccactcccggcgcctcgaaccatcaacctgtcgcaagaggtcgcgggcggtccgatcggtggtgccgtgcgcgatggcggcgccgcctaccgtgcggggctacgggccagcgtcgccgtcgtcgtcggtggcgctgcctcgggcgcgatcgcgggtgcctgcgtcgctcgtgcccgtgccgacgcggcgggcgccatcggtgcgcctgcgtgcggcggtcgcggacgtgccccgcggcggcctgcagctccagcggcgggaggtggaggtactgtcggggaccgtgttcggcagagaagaggatgaggtgttggagaaggtcggggaggagaaggtggacgggtggatacgggagtcgatcgcggagatcgtgcggcacataggcgaggcgccgttcctggtgcacctgttcagcagcggcgacggcgacggcgagcacgtgacggtgcggcgggagaccgcggcgccggagagctggccggacgtgcggcgccggtgggggatgggcgggcagcggaggccggacggggtcatcctggtcgagcaggtggcggccgtggccgcggacggcggcgcctcggcgtcggaggcggcgcggcaggtgtgggggctggtggtgcaggcgcgcggcatggagcacgcctcgtgttacgtgctcgacacctgccgcgtgcgctcgtcggccgggttctgcacgcacttctgcctcgcgcgggccaagtgcttcggcgaccccgtcgagctccagctccgcaacgcctggctcaaccgcctcgccggccgccgatagccgccgcccgtggcctcggctaccactggactgatagtattagatgcgccaaggaccaaacgcaatgacgatgggtcctcttcgctggcaagaacgaggaagagaagcacgcgaaatcagaatccatcaaatcttttcgttcagttctgtttctccctgaattggagttggagatcatgtgtacagattattggctgtaattcttactggcgttcttcgcttattcaatcaagaagcgattcttcgaggcaaattacagttaattcattgcctactccgaaa

SEQ ID NO: 1461 - DNA, 3111 bp, Sorghum bicolor
ggtagagatagagaggcccaggatgagagtggcggtggtgggcgccggcgtgagcgggctggcggcggcgcacgagctggcgaggagcggcggcggcggcggcgcgaccgtgaccgtgtacgagaaggaggactacctcggtgggcacgccaggaccgtggccgtcgaggacgacgacgccgacggcggcggcaccgtgcagctcgacctcggcttcatggtcttcaaccgggttacatacccaaacatgctggaatggtttgaagggctcggagtggagatggagatatccgacatgtccttctcagtgagcacacaattggggaccagcgccagcagatgcgagtggggcagccgcaatggtatctcaggcctcttggcacagaaaagcaatgcactgagccctagtttttggcgcatgattcgtgagatactcaagttcaagaacgatgctctcaagtacttggaggaccatgaaaacaaccctgatatggaccggaatgagacccttgggcaattcattcagtctcatggatattctcagttcttccaagaggcttaccttatcccaatctgtgcgtgtatatggtcatgtccatcgcaaggagtgttcggattctctgctttctttgtgctctcattctgccgtaaccatcatcttcttcagttgttcggtcgcccccagtggctcacagtgaaaggtcgttcgcactcctatgtgcacaaggtaagggaggagttggaaagtatgggttgccaaattaaaacaagctgcgaaatcaaatctgtttcaagttctgagggaggtttcagggttacagtgtttgatggttcagaggagacatatgacagagtcatatttggtgtccacgcacctgatgctctaaagattctaggagctgaagcaacacacgaagaattgagaatcctaggagcttttcagtatgtctacagtgatatatacctccattccgataaaagcttgatgccacggagttcgtctgcttggagttcctggaacttcctgggcacgacaagcaagggggtttgtgtaacctactggctaaatctgcttcagaacatagaatctacaggcaggccttttctggtgacactgaatcctcctcatgtcccagatcatgtcttgcttaaatggtacactagccaccctgtcccgtctgtggctgccgcaaaggcttctcttgagcttcatcacattcaaggaaacagaggaatttggttctgcggggcataccaaggttatggcttccatgaagatggactcaaggctgggaaagctgcagctcaaaatttgcttggtaaggagagtggccttttggtgaacccaaaacagatgatcccatcgtggtctgagactggggcacgtcttctggtagcaagatttcttggtcaatatgtatccgtcggcaacttggtcttgcttgaagaaggaggcactatgttcagttttggtgaagtgggcaaacaatgccatgtgaaatctgtcctgcgagtacatgaccccatgttttactggaaggttgcaactgaagcagaccttggcttggcagatgcctacattaacggttatttctcatttgtagacaagagagaaggtcttctaaatcttttcctgattctcattgcaaacagggacgcaaacaagactagtagcagtgctgcaagtaaaaggggttggtggacacccctgctattgacagctggggttgcctccgctaaatacttcctgcgtcacatatcaaggaaaaattctgtcacacaaacacgtcaaaacatctctcaacactatgatctgagtaatgaattcttctcgcttttcctggatccatcaatgacttactcttgcgccatcttcaagacggaggatgaaagcttagaggcagcccagctacggaaagtttgcctcctaatccacaaggctaaagtggagcgagatcaccacgttcttgagattggttgtggctggggcagcttagcaatccaattggtgaagcaaactggttgcaaatacactgggatcacattatcagtggagcaactgaaatatgcacagagaaaagtgaaagaagctggcttagaggaccacataagcttcatgttgtgtgattaccgtcaaataccaacacaccgcaaatacgacaggatcatctcttgcgagatgatcgaaggtgttgggcacgaatacatggacgatttcttcggctgctgcgagacccttttggctcaagatggcatatttgtcctgcagttcatctcaatcccagaagaacggtacgaggaatacaggcgcagctcagacttcatcaaagaatacatcttccccgggggctgcatcccttcgttggcccggatcacgtctgccatgtctgcagcatcaaggctctgcatcgagcaccttgagaacattgggtaccattactacccaacgctgatacagtggagggacaacttcatggtcaataaggatgcaattttggccctgggcttcgatgagaaattcatccgtatatgggaatactacttcatatactgcgccgctggtttcaagtcacggacacttgggaattaccagattgtgttttctcgccctggcaacgacaaactgagcaacaacggcgatccttacgcaagctttccggcagctaatcaagctagctagctagctaacgagtctacgcccgattttttttggaagggatgtgattcatccgcactacagcagccatcgttattcattccgttaattcaattccgggcacatgcttccatgaatgtgtgaactcaatgcaacaatgcaaggatttatacgaatggatagatatatattttggtggtagctgaatcagtcggagcctacactacacttcaacgtgagcccttgaattcgtgatccaattgaacacgcagtactgtactactatgtgtgtcactaactgattgtacttgcaaccgcggatcagtccattgcttcgatccatcttgacgctccatcactttcagttcgcccatccaatgacgactggcacatggccaagctgggacgcaggagactcgagcattcactttcactggagatatcgttgtgttgtg

SEQ ID NO: 1462 - DNA, 3501 bp, Sorghum bicolor
cgcggtgcgcgcgcgcgtgattcccagtcccactgggccggcctccttgcgcccacagcggccagcggcaaggcaaccccacaaaaccaaccaacccatcacacacgggcaagcctaaaagtggagggcgcgcgccaggactgagaccgagagagtggctgctgctggcgaatccaatcctggacgagattaggtacggtagagatagagaggcccaggatgagagtggcggtggtgggcgccggcgtgagcgggctggcggcggcgcacgagctggcgaggagcggcggcggcggcggcgcgaccgtgaccgtgtacgagaaggaggactacctcggtgggcacgccaggaccgtggccgtcgaggacgacgacgccgacggcggcggcaccgtgcagctcgacctcggcttcatggtcttcaaccgggttacatacccaaacatgctggaatggtttgaagggctcggagtggagatggagatatccgacatgtccttctcagtgagcacacaattggggaccagcgccagcagatgcgagtggggcagccgcaatggtatctcaggcctcttggcacagaaaagcaatgcactgagccctagtttttggcgcatgattcgtgagatactcaagttcaagaacgatgctctcaagtacttggaggaccatgaaaacaaccctgatatggaccggaatgagacccttgggcaattcattcagtctcatggatattctcagttcttccaagaggcttaccttatcccaatctgtgcgtgtatatggtcatgtccatcgcaaggagtgttcggattctctgctttctttgtgctctcattctgccgtaaccatcatcttcttcagttgttcggtcgcccccagtggctcacagtgaaaggtcgttcgcactcctatgtgcacaaggtaagggaggagttggaaagtatgggttgccaaattaaaacaagctgcgaaatcaaatctgtttcaagttctgagggaggtttcagggttacagtgtttgatggttcagaggagacatatgacagagtcatatttggtgtccacgcacctgatgctctaaagattctaggagctgaagcaacacacgaagaattgagaatcctaggagcttttcagtatgtctacagtgatatatacctccattccgataaaagcttgatgccacggagttcgtctgcttggagttcctggaacttcctgggcacgacaagcaagggggtttgtgtaacctactggctaaatctgcttcagaacatagaatctacaggcaggccttttctggtgacactgaatcctcctcatgtcccagatcatgtcttgcttaaatggtacactagccaccctgtcccgtctgtggctgccgcaaaggcttctcttgagcttcatcacattcaaggaaacagaggaatttggttctgcggggcataccaaggttatggcttccatgaagatggactcaaggctgggaaagctgcagctcaaaatttgcttggtaaggagagtggccttttggtgaacccaaaacagatgatcccatcgtggtctgagactggggcacgtcttctggtagcaagatttcttggtcaatatgtatccgtcggcaacttggtcttgcttgaagaaggaggcactatgttcagttttggtgaagtgggcaaacaatgccatgtgaaatctgtcctgcgagtacatgaccccatgttttactggaaggttgcaactgaagcagaccttggcttggcagatgcctacattaacggttatttctcatttgtagacaagagagaaggtcttctaaatcttttcctgattctcattgcaaacagggacgcaaacaagactagtagcagtgctgcaagtaaaaggggttggtggacacccctgctattgacagctggggttgcctccgctaaatacttcctgcgtcacatatcaaggaaaaattctgtcacacaaacacgtcaaaacatctctcaacactatgatctgagtaatgaattcttctcgcttttcctggatccatcaatgacttactcttgcgccatcttcaagacggaggatgaaagcttagaggcagcccagctacggaaagtttgcctcctaatccacaaggctaaagtggagcgagatcaccacgttcttgagattggttgtggctggggcagcttagcaatccaattggtgaagcaaactggttgcaaatacactgggatcacattatcagtggagcaactgaaatatgcacagagaaaagtgaaagaagctggcttagaggaccacataagcttcatgttgtgtgattaccgtcaaataccaacacaccgcaaatacgacaggatcatctcttgcgagatgatcgaaggtgttgggcacgaatacatggacgatttcttcggctgctgcgagacccttttggctcaagatggcatatttgtcctgcagttcatctcaatcccagaagaacggtacgaggaatacaggcgcagctcagacttcatcaaagaatacatcttccccgggggctgcatcccttcgttggcccggatcacgtctgccatgtctgcagcatcaaggctctgcatcgagcaccttgagaacattgggtaccattactacccaacgctgatacagtggagggacaacttcatggtcaataaggatgcaattttggccctgggcttcgatgagaaattcatccgtatatgggaatactacttcatatactgcgccgctggtttcaagtcacggacacttgggaattaccagattgtgttttctcgccctggcaacgacaaactgagcaacaacggcgatccttacgcaagctttccggcagctaatcaagctagctagctagctaacgagtctacgcccgattttttttggaagggatgtgattcatccgcactacagcagccatcgttattcattccgttaattcaattccgggcacatgcttccatgaatgtgtgaactcaatgcaacaatgcaaggatttatacgaatggatagatatatattttggtggtagctgaatcagtcggagcctacactacacttcaacgtgagcccttgaattcgtgatccaattgaacacgcagtactgtactactatgtgtgtcactaactgattgtacttgcaaccgcggatcagtccattgcttcgatccatcttgacgctccatcactttcagttcgcccatccaatgacgactggcacatggccaagctgggacgcaggagactcgagcattcactttcactggagatatcgttgtgttgtgtgcagctagcgctgtactgatggagcccaagaaacgtaacgtctaacgtgtgttgcatcaatctagtgttcacggtgcagtaattccgtgtgcagcacgtacaagtagtgcaacgacgtgcacatgcaattcattgagccagcaccagtagtcgtaccactcgtctcttataggacgcggggggcacgtgtac

SEQ ID NO: 1463 - DNA, 2800 bp, Setaria italica
ggcgtcaggatgagagtagcggtggtgggcgccggcgtgagcggcctggcggcggcgcacgagctggcgcggagcggcgccggcgcgcgcgtgacggtgtacgagaaggaggactgcctcggcgggcacgcccgtactgtggccgtcgaggacgccgccgccggtaccgtccacctcgacctcggcttcatggtcttcaaccgggtaacatacccgaacatgctcgaatggtttgaaggactcggggtggagatggagatatccgacatgtccttctcagtgagcacacaattggggaccggcggcagcagatgcgagtggggtagccgaaatggcatctcaggcctcttggcgcagaaaagcaatgcaatcagccctagtttctggtgcatgatccgtgagatactcaagttcaaggacgatgctctcaagtacttggaggaccgtgaaaacaaccctgacatggaccggaatgagactctggggcaatttattcagtctcatggatattcccagttcttccaagaggcttacctcatcccgatctgtgcgtgtatatggtcatgtccatctcaaggggttctgggattctctgctttctttgtgctctcattctgccgcaaccaccaccttcttcagctgtttggtcgcccccagtggctcactgtcaagggtcgttcgcatacctatgtgcagaaggtaagggaggagttggaaagcttgggttgcctaattaaaaccagctgcgagattaagtctgtttcaagttccgatggaggtctcagggtgacaacagttgatggttcagaggagacgtatgacagagtcatatttggtgtccatgcgcctgatgctctaaagctgctaggagctgaagcaacgcacgaggaattgagaatcctaggtgcttttcagtatgtctacagtgatatatacctccattgcgataaaagtatgatgccacggagttcgtcagcttggagttcctggaacttcctggggacgacaagcaagggggtttgtgtaacctactggttaaatctgcttcagaacatagaatctacagacaggccttttctggtgacactgaaccctcctcatgtcccggatcatgtcttgctcaaatggtacactagccaccctgtcccatctgtggctgccgcaaaggcttctcttgagcttcatcacattcaaggaaacagaggaatttggttctgcggtgcataccaaggttatggtttccatgaagatggactcaaggctgggaaatctgcagctcaagatttgctcggtaataagaagggccttctggagaacccaaaacagatgatcccatcgtggactgaggctggagcacgtcttctggtagcaagatttcttggccaatacatatccgtcggtaacttggttttgcttgaagaaggaggcactatgttcagtttcggtgaagcaggcaaaaaatgccatgcgaaatctgtcctgcgtgtccatgatcccatgttttactggaaggttgcaacagaagcagaccttggcttggcagatgcctatattaacggttatttctcttttgttgacaagagagaaggtcttctgaatcttttcctgattctcattgcaaacagggatgcaaacaagagtactagcagtgggaccagtaaaaggggttggtggacacccctgcttttgacagctggggtcgcctctgctaaatactttctccgccacatttcaaggaagaattctgtcacacaaacacgtcaaaacatctctcaacattatgatttgagtaatgaattcttctcactttttctggatccatcgatgacttactcttgtgccatcttcaagacggaggatgaaagcttagaggcagcccagcgacgtaaaattggccttctaatagacaaggctaaagtcgagcgggatcaccatgttcttgagattggttgcggctggggcagcttagcgatccaattggtgaagcaaactggctgcaaatacactgggatcacattatctgtggagcaactacaatatgcgcagaaaaaagtgaaagaagctggcttagaggaccacataagcttcatgctgtgtgactatcgtcaaataccaactcgccgcaaatacgacaggatcatatcttgtgaaatgatcgagggtgttgggcacgagtacatggacgatttcttcggctgctgcgagtcccttttggctcaagacggcctgtttgtcctgcagttcatctcgatcccagaagaacggtacgaggagtacaggcggagctcggacttcatcaaagagtacatcttccccgggggctgcctcccttcgttggcccggatcacgtctgccatgtccgcagcatcaaggctctgcatcgagcaccttgagaacatcgggtaccattactacccgacgctgatacgctggagggacaacttcatggccaacaaggatgcgatttcggccctgggctttgatgataaattcatccgtatctgggagtattacttcatatactgcgccgccggtttcaagtcgcggacacttgggaattaccagattgtgttttcccgccctggcaacgacaagctgggcgacaacgacccttacgcaagcttcccggcagccaatcaagatagctcatgaatcgtctacagtggcacgtacaatgcctgcgcgatttttttttttttggaaggggtacgtgtgcgattgattcagcagcagcacgccactgttcattcggttaattcttcaattccaatctcacatggatgtatgcgaattcaatgca

SEQ ID NO: 1464 - DNA, 3181 bp, Avena sativa
cctatatctccgctcctcctggcctagtagacggccgccaatgccgctgccactccttccttgactgatccgcttccacgccagaaacagagcagaggacccggggaggatatacatacatatggaggaggaggggatgcgggtggccgtggtgggcgccggcgtgagcggcctggcggcggcgcacgagctggccaaggcaggcggcggcggcagggcgcgggtgacggtgtacgaggcggaggagaccctgggcggccacgccaggaccgccgacgtcgacggcgtccacctcgacctcggcttcatggtcttcaacagggtgacatacccaaacatgctggagtggttcgaagagctcggcgtggagatggagacgtcggacatgtcgctctcggtgagcacgcagctctccggtggcggcaggtgcgagtggggcagccggaacggcctctcgggcctcctggcgcagaagagcaacgcgctccgccccggcttctggcacatgatccgagagatactcaagttcaaggaggatgctctcaggtacctggaggaccatgagagcaaccctgacctggacagggacgagaccctggggcatttcatccagacgcatggatactcccagctcttccaggagtcctacttgatcccaatctgcgcttgcatatggtcttgcccgtcgcagggagtcctcggcttctctgctttcttcgtgctctcgttctgccgcaaccaccaccttcttcagatcttcggccggccacaatggctcaccgtcaagggtcgctcccatacatatgtaaataaggtaagggaagaactggagagcatgggttgtcagattaagaccagctgccaagtgaaatctgtctcaagttctgaaggaggttacagagtcgtagaggtcagcggttccgaggagacgtacgacaagatcatatttggtgcgcatgcgcctgatgctctcagaatgctaggagatgaagcaacacacgaggaactcagaattctgggcgctttccagtatgtctacagtgatatataccttcattgcgacaaaactttgatgccgcagaacccgtcggcatggagcgcctggaacttcctggggacaacgagcagcggtgtctctgtcacctactggctgaacctgctccagaacatcgaatctaccggcaggccattcctggtgacactgaatccaccgcatgtccctgatcatatcctgctcaaatggaacaccagccatcctgttccgtctgtcgctgctgcaaaggcttccctggagcttcagcagatccagggaaacagaggaatatggttctgcggggcatatcaaggttatggcttccacgaagatggtcttaaggctggaaaatcagcggctcaaggtttgcttgggcagaagagcagccttcttctgaacccaaaacagatggtcccatcatggacagaagctggggctcgtcttatggtaacaaggtttctcaaccaatacgtaaccatcggcaacatgatcattcttgaagaaggtggcaccatgttcagttttggtgaagtagacaaaaaatgccttgtcaaatctgtcctgcgagttcatgaccctctcttctactggaaggtcgcaactgaagcggaccttggtttggcagatgcgtacattaacggatatttttcctttgtcgataagagagaaggacttctgaatctttttctgattctcattgctaacagagacgcgcagaagagtagtaacagcgctgccagtaacaggggttggtggacacccatgctattaacagctgggatcgcatccgcaaaatatttcctgcgccacatctcacggaaaaatactgtcacacaaactcgccggaacatctcccagcactatgatctgagtaacgatttcttctcgctttttctggatccatcgatgacttactcctgcgcagtattcaaggtggaagatgaaagcttagaagtagccagcctacgtaaagtcaacctcctaatcaagaaggctaaagtggagagaaatcatcatattcttgaaatcggtagcggctggggcagcttagcgatgcaagtggtgaagcaaactggatgcaaatacacagggattacactgtcggaggagcaacttaaatatgctcaagtgaaagtgaaggaagctggtttagaggatcgcataactttcctgctgtgtgactaccgtcaaataccaactcgttgtaagtacgacaggatcatatcttgcgagatgattgaaggggttggtcatgaattcatggacgatttctttggctgctgcgagtctctcttggctaaggatggcctatttgtcctccagttcatatcaataccagaagaacggtacgaagaatacaggagaagctcagacttcataaaagaatacatctttcccgggggttgcctgccttccttggccaggatcacgtctgccatgtccagtgcatcgaggctctgcatcgagcaggtcgagaacattgggtaccattactacccaacgctgatacgctggagggataacttcatggcaaacaaagatgcgattttggctctgggatttgacgacaagttcatccgtgtatgggagtactatttcatatactgtgctgctggttttaagtcacgaacgcttggaacataccagattgtgttttcaagacctggcaacgacaagctggccaacgctgataacccctacgcaagttttccggcggcctagcccgctcatagaacaagtccatgatcattattcatactcatacatctatacatatatatagcttgcatttaatcatcggcaaattaagtttcataaactgtaattcatagagggagtgtgagtgtcaaccagtgtatgaactactacgactacacgatgattcattgattgattcatgtaaggtctggctcatcgatgacaactgatctgacatttgtgtgccagttcaaggtgaaggttttctgacgatgtatggtcatttcagtgaaatcgagagaaaaccttcgcaaaagaaaaactacctagctgaactagatccaaacaacagagaagctacttacctgaactggtcgtaacaagggttgagacgccacctgcattatggctccctcaactgtcttgtcttgaccttgcttttcccaggca

SEQ ID NO: 1465 - DNA, 3031 bp, Avena sativa
cctatatctccgctcctcctggcctagtagacggccgccaatgccgctgccactccttccttgactgatccgcttccacgccagaaacagagcagaggacccggggaggatatacatacatatggaggaggaggggatgcgggtggccgtggtgggcgccggcgtgagcggcctggcggcggcgcacgagctggtatgcagggccggcggcggcggcggcagggcgcgggtgacggtgtacgaggcggaggagaccctgggcggccacgccaggaccgccgacgtcgacggcgtccacctcgacctcggcttcatggtcttcaacagggtgacatacccaaacatgctggagtggttcgaagagctcggcgtggagatggagacgtcggacatgtcgctctcggtgagcacgcagctctccggtggcggcaggtgcgagtggggcagccggaacggcctctcgggcctcctggcgcagaagagcaacgcgctccgccccggcttctggcacatgatccgagagatactcaagttcaaggaggatgctctcaggtacctggaggaccatgagagcaaccctgacctggacagggacgagaccctggggcatttcatccagacgcatggatactcccagctcttccaggagtcctacttgatcccaatctgcgcttgcatatggtcttgcccgtcccagggagtcctcggcttctctgctttcttcgtgctctcgttctgccgcaaccaccaccttcttcagatcttcggccggccacaatggctcaccgtcaagggtcgctcccatacatatgtaaataaggtaagggaagaactggagagcatgggttgtcagattaagaccagctgccaagtgaaatctgtctcaagttctgaaggaggttacagagtcgtagaggtcagcggttccgaggagacgtacgacaagatcatatttggtgcgcatgcgcctgatgctctcagaatgctaggagatgaagcaacacacgaggaactcagaattctgggcgctttccagtatgtctacagtgatatataccttcattgcgacaaaactttgatgccgcagaacccgtcggcatggagcgcctggaacttcctggggacaacgagcagcggtgtctctgtcacctactggctgaacctgctccagaacatcgaatctaccggcaggccattcctggtgacactgaatccaccgcatgtccctgatcatatcctgctcaaatggaacaccagccatcctgttccgtctgtcgctgctgcaaaggcttccctggagcttcagcagatccagggaaacagaggaatatggttctgcggggcatatcaaggttatggcttccacgaagatggtcttaaggctggaaaatcagcggctcaaggtttgcttgggcagaagagcagccttcttctgaacccaaaacagatggtcccatcatggacagaagctggggctcgtcttatggtaacaaggtttctcaaccaatacgtaaccatcggcaacatgatcattcttgaagaaggtggcaccatgttcagttttggtgaagtagacaaaaaatgccttgtcaaatctgtcctgcgagttcatgaccctctcttctactggaaggtcgcaactgaagcggaccttggtttggcagatgcgtacattaacggatatttttcctttgtcgataagagagaaggacttctgaatctttttctgattctcattgctaacagagacgcgcagaagagtagtaacagcgctgccagtaacaggggttggtggacacccatgctattaacagctgggatcgcatccgcaaaatatttcctgcgccacatctcacggaaaaatactgtcacacaaactcgccggaacatctcccagcactatgatctgagtaacgatttcttctcgctttttctggatccatcgatgacttactcctgcgcagtattcaaggtggaagatgaaagcttagaagtagccagcctacgtaaagtcaacctcctaatcaagaaggctaaagtggagagaaatcatcatattcttgaaatcggtagcggctggggcagcttagcgatgcaagtggtgaagcaaactggatgcaaatacacagggattacactgtcggaggagcaacttaaatatgctcaagtgaaagtgaaggaagctggtttagaggatcgcataactttcctgctgtgtgactaccgtcaaataccaactcgttgtaagtacgacaggatcatatcttgcgagatgattgaaggggttggtcatgaattcatggacgatttctttggctgctgcgagtctctcttggctaaggatggcctatttgtcctccagttcatatcaataccagaagaacggtacgaagaatacaggagaagctcagacttcataaaagaatacatctttcccgggggttgcctgccttccttggccaggatcacgtctgccatgtccagtgcatcgaggctctgcatcgagcaggtcgagaacattgggtaccattactacccaacgctgatacgctggagggataacttcatggcaaacaaagatgcgattttggctctgggatttgacgacaagttcatccgtgtatgggagtactatttcatatactgtgctgctggttttaagtcacgaacgcttggaacataccagattgtgttttcaagacctggcaacgacaagctggccaacgccgataacccctacgcaagttttccggcggcctagcccgctcatagaacaagtccatgatcattattcatactcatacatctatacatatatatagcttgcatttaatcatcggcaaattaagtttcataaactgtaattcatagagggagtgtgagtgtcaaccagtgtatgaactactacgactacacgatgattcattgattgattcatgtaaggtctggctcatcgatgacaactgatctgacatttgtgtgccagttcaaggtgaaggttttctgacgatgtatggtcatttcagtgaaa

SEQ ID NO: 1466 - DNA, 3235 bp, Brachypodium distachyon
cgcggctgtggtgcggggccggctcctatatctcagctggcctccctcccggccgccaatgccaccgtcgccttcgcccatttctctccatccattggcgcacacacgcttggattgaggagtaaatcaaagaggaggggccgcgggatggagaaggagatcacgagagtggccgttgtgggcgccggggtgagcgggctggcggcggcgcacgagctgtgcagggccggcggcaacggggtgcgcgtcacggtgtacgaggcggaggagcggctcggcggccacgcccgcaccgccgacgtcgacggcgtccaactcgacctcggcttcatggtcttcaaccgggtgacatacccaaacatgctagaatggtttgaagggctcggcgtggagatggagacatcggacatgtccctatcggtgagcacacagctctctggtggcggcaggtgtgagtggggcagccggaatggcctctctggcctcctggcacagaagagcaacgctctccgccctggattctggcacatgatacgtgagatactcaagttcaaggaggatgtactcagctacctcagtaaccatgagaacaaccctgacctggaccggaacgagaccctgggggaattcatcaagatgcatggatactcccagctcttccaagaggcttacctgatcccaatatgtgcgtgcatatggtcatgcccgtcgcagggagtcctgggcttctctgctttctttgtgctctcgttctgtcgcaaccatcaccttcttcagatcttcggtcgcccccagtggctcaccataaagggccgttctcattcgtatgtaaataaggtaagggaagaactggaaagcatgggctgtaggattaagactaactgccaagtcaaatctgtttcaagttttgaaggaggtcatagagtcttggaggtggatggctcagaggaggtgtacgacaagatcatattcggtgcacatgcacctgatgctctaagaatgctacgagatgaagcaacacacgaggaattgagaattctaggtgctttccagtatgtctacagcgatatatacctccatcgcgacaaaagtttgatgccacgtaactcatcggcatggagcgcctggaactttctggggacgactagcagtggcgtctctgttacctattggctaaatttgcttcagaacatcgaatctaagggcaggcctttcctggtgacattaaatccacctcatgtcccggatcacgtcctgctcaaatggaacactagccatcctgttccctccgttgctgctgcgaaggcctctctggagcttaatcaaatccagggaaaaagaggaatatggttctgcggggcatatcaaggctatggcttccatgaagacggttctaaggctgggaaatctgcagctcaaggtttgctcggtaagaagattgaccttcttctgaacccaaaacagatggttccatcatggaccgaagctggggctcgtcttttagtaacaagatttctcaaccaatacataaccatcggcaacctgaccattcttgaacaaggtggcactatgttcagtttcggtgaagtagacaaaaagtgccttgtcaaatctgtcttgcgagttcatgaccctctcttctactggaaggtcgcaactgaagcagaccttggcttggcagatgcatatgttaacgggtatttctcttttgttgataagagagaagggcttctgaatcttttcctgattctcattgctaacagagatacacagaagagcagtagcagcgcagccagtaaaaggggttggtggacgcccttgcttttaacagctgggattgcatctgctaaatatttcctgcgccacgtctcgaggaagaatactgtcacacaaactcgccaaaacatatctcagcactatgatctgagtaacgatttcttctcgctttttctggatccatcaatgacttactcttgtgccatcttcaaggtggaggatgaaagcttagaagtagcccagctacgtaaagttaacctcctaatagacaaggctaaggtggagcgggatcatcatgttcttgagattggtagtggttggggctgcttagcaatgcaagtggtgaagcaaactggctgcaaatacacagggattacattgtctgaggagcaacttaaatacgcacaaatgaaagtgaaggaagctggtttagaggaccgcataactttcctgctttgtgactaccgtcaaataccaattctccgtaagtatgacaggatcatatcttgcgagatgattgaaggggttggccatgaattcatggacgatttcttcggctgctgcgagtctctcttggctcaagatggcttacttgtcctacagttcatatcgattccagaagaacgatatgaggaatacaggagaagttcagactttataaaagaatacatctttccaggggggtgcttgccttccttggcccggatcacatctgccatgtccgctgcatccagactctgcatcgagcaggttgagaacatcggataccattactatccgacactggtacgctggagggataacttctttgccaacaaatatgcgatttcagcccttggattcgacgacaagttcatccgcatatgggagtactatttcatgtattgtgctgctggtttcaagtcacggacgcttgggaactatcagattgtgttttctagaccaggcaacgacaagctggcctacgccgataatccctacgcaagccttccggcagcatagcttcaacaacacaacgaccattcacatacgtatatatatgcgtatacataggttgcatttaattcatcaatattaaggttcagaaattgttgtaattctatagagggagtatggaactgcacatggatttattcattgattcgattgagcacatgtatggcctgcctcgtcgatgaacattcgacctgaaactttatcgacgtcaaggttttgtaagttggatacctttgattttcagaaagaaaaaagtgcttgtgcaatttttagcccatatgattcaggaaagtaagactacaagacttggtacaagaggaaataccggttcctgaataactataggtgatcttacgtctatgtaactgagttcatatgttgctaattatgtaaaaatgataagtttatgttgaagatgatttggggcacgatcattcccaagggaaatatttccctcctaaaa

SEQ ID NO: 1467 - DNA, 3126 bp, Triticum aestivum
cttcggcctcgcacccctcgccgccaatgccactgccactgccacttgttgactgattcacccccacgccatttcgcacaccagagactggtagaggaccagagttccatggaggaggggatgcgggtggcggtggtgggcgccggcgtgagcggcctggcggcggcgcacgagctggccagggccggcggggcggcgcgcgtgacggtgtacgaggcggaggagagcctcggcggccacgccaggaccgccgacgtcgacggcgtccagctcgacctcggcttcatggtcttcaaccgggtgacatacccaaacatgctggaatggtttgaagagctcggggtagagatggagatatcagacatgtcgctgtcagtgagcacacagctctccggtggcggcaggtgcgagtggggcagccggaacggcctctcgggcctcctagcgcagaagagcaatgccctccgccctgccttctggcacatgatccgcgagatactcaagttcaaggaggatgccctcaagtacctggaggaccatgagagcaaccctgacctgaaccggcacgagactctggggcagttcatccagacgcatggatactcccagctcttccaggaggcatacctgatcccaatctgtgcgagcatatggtcatgcccgtcgcagggggtgctcggcttctctgctttcttcgttctctccttctgccgcaaccatcacctccttcagatcttcggtcggccccaatggctcaccgtcaaaggtcgctcgcatacatatgtaaacaaggtaagggaagaactggaaagcatgggttgtcagattaagaccagctgccaagtcaaatctgtttcaagcgttgaaggaggatacaaagtcttggaggtcggtggctcggaggaggtgtacgacaagatcatatttggtgctcatgcacctgatgttctgagaatgctaggagatgaagcaacacacgaggagttgagaattctgggtgctttccaatatgtccacagtgacatatacctccatcgcgacgacactttgatgccacagaacccgtcggcgtggagcgcctggaacttcttggggacaacaagcagcggcgtctctgttacctactggctaaatctcctccagaacatcgaatctaccggcaagcctttcctggtgacactgaatccacctcatgtcccggatcatgtcgtgctcaaatggaacaccggccatcctgttccatctgtcgcggctgcaaaggcttcgttggagcttcagcagatccaaggaaacaggggaatatggttctgtggggcatatcaaggttatggcttccatgaagatggccttaaggctgggaagtctgcggctcaaagtttgcttgggcagaagagcagccttcttctgaacccaaaacagatggtgccgtcatggacggaaactggggctcgccttctggtaacaaggtttctcaaccaatatgtcaccatcggtaacatgaccattcttgaagaaggtggcactatgttcagtttcggtgaagtcgacaaaaaatgtcttgtcaaaactgtcttgcgagttcatgacccactcttctactggaaggtcgcaaccgaagcggatcttggtatggctgatgcatatattaatggttatttttcttttgttgataaaagagaagggctcctgaatcttttcctgattctcattgcaaacagggatgctcagaagagtagtagtagtgctgccagtaaaaggggttggtggacacccatgcttttgacagctgggatagcatctgcaaaatattttctgcgccacatctcaaggaagaatactgtcacacaaactcgccgaaacatctctcagcactatgatctgagtaatgatttcttctcgattttcctggatccatcgatgacttactcttgtgcagtattcaaggtggaagatgaaagcttggaagtagcccagcaacgcaaagttaacctcctaatcaagaaggctaaagtggagcggaatcatcatgttcttgaaatcggtagcggttggggcagcttggcgatggaagtggtgaagcaaacgggatgcaaatacacagggattacactgtctgaggagcaacttaaatatgctcaaatgaaagtaaaggaagctggtttggaggatcgcataactttcctgctgtgtgactaccgtcaaataccaagtcggtgtaagtacgacaggatcatatcatgcgagatgattgaaggggttggtcatgaattcatggacgatttctttggctgttgtgagtctctattggctccagatggcctatttgtcctccagttcatatcgattccagaagaacggtatgaggaatacaggagaagttcagacttcataaaagaatacatctttccagggggttgccttccttccttggcccggatcacgtctgccatgtccaccgcgtccaggctctgcatcgagcaggttgagaacatcgggtaccattactacccgacgctgatacgctggagggataacttcatggccaacaaagatgcgattttggctcttggatttgacgacaagtttatccgtgtatgggagtactatttcatatactgtgctgccggtttcaagtcacggacgcttggaacttaccagattgtgttttctcgacctggcaacgacaagctggcctacgccgacaacccctatgcaagtcttccggcagcctagcaagctcactgaacaagtgcacgaccattcaaactcatacctatacatagtaggttgcatttaattatccataaattaaggtcgagaaattgtaatttccataggagtgtgtgaagtgtcgattatagtgctaccacagggtgattcattgattggttcatgtaaggcgtggttcaccatgggtgaacatatataccatgagacatttgtccgcctgctggcccaagggcgtggttttcttcctcctctcagcattttccttccaagccgcgtagccatctccttatcagccggcactcatcacccgcttactgcgtggcttttgtctcttgaggaaaaatctgatgatgtttgcttgatttttatacttggaagaaaatttgagccttcggt

SEQ ID NO: 1468 - DNA, 2848 bp, Secale cereale
tgcgggtggccgtggtgggcgccggcgtgagcggcctggcggcggcgcacgagctggcccgggccgccggcggggcgacgcgcgtgacggtttacgaggcggaggggagcctcggcggccacgccaggaccgccgacgtcgacggcgtccacctcgacctcggcttcatggtcttcaaccgggtgacatacccaaacatgctggaatggttcgaagagcttggtgtggagatggagatatccgacatgtcgctctcagtgagcacgcagctctcgagcggcggcaggtgcgagtggggcagccggaacggtctctcgggcctccttgcacagaagagcaatgccctccgccccgccttctggcacatgatccgagagatactcaagttcaaggaggatgccctcaagtacctggaggaccatgagagcaacgctgacctggaccggcacgagactctggggcagttcatccaggcgcatggatactcccagctcttccaggaggcttacctgatccctatctgtgcgagcatatggtcatgcccgtcgcagggggttctcggcttctctgctttcttcgtcctctccttctgccgcaaccatcacctccttcagatcttcggtcggccccaatggctcaccatcaaaggtcgttcgcatacatatgtaaacaaggtaagggaagaactagaaagcatgggttgtcagattaagaccagctgccaagtcaagtctgtttcaagctttcaaggaggatacaaagtcttggaggtcggtggctcggaggaggtgtacgacaagatcatatttggtgctcatgcacctgatgttctgagaatgctaggcgatgaagcaacgcacgaggagttgagaattctgggtgctttccaatatgtccacagtgacatatacctacaccgtgacgacactttgatgccacagaaccagtcggcatggagcgcctggaacttcttggggacaacaagcagcggcatctctgttacctactggctaaatctcctccagaacatcgaatctaccggcaagcctttcctggtgacgctgaatccacctgatgttccggatcatgtcctgctcaaatggaacaccggtcatcctgttccatccgtcgctgctgcaaaggcttctctggagcttcagcagatccaaggaaacagaggaatatggttctgtggggcatatcaaggttatggcttccatgaagatggccttaaggctgggaagtctgcagctcaaagtttgcttgggcagaagagcaaccttcttctgaacccgaaacagatggttccgtcatggacggaaactggggctcgtcttctggtaacaaggtttctcaaccaatatgtcaccatcggtaacatgaccattcttgaagaaggtggcactatgttcagttttggtgaagttgacaaaaaatgtctcgtcaaaactgtcttgcgagttcatgaccctctcttctactggaaggtcgcaaccgaagcggatcttggtatggcagatgcatatattaatggttattttacttttgttgacaaaagagaagggctcctgaatcttttcctgattctcattgctaacagggatgctcagaagagtagcaataccgctgccagtaaaaggggttggtggacacccatgcttttgacagctgggattgcgtcggcaaaatatttcctgcgccacatctcaaggaagaatactgtcacgcaaactcgccgaaacatctctcagcactatgatctgagtaatgacttcttctcgcttttcctggatccatcgatgacttactcttgtgcagtattcaaggttgaagatgaaagcttagcagtagcccagcaaagtaaagttaatctactaatcaagaaggctaaagtggagcgaaaccatcatgttcttgaaatcggtagtggttggggcagcttggcaatggaagtcgtgaagcaaactggatgcaaatatacagggattacactatctgaggaacaacttaaatacgctcaaatgaaagtgaaggaagctggtttggaggatcgcataaccttcctgctgtgtgactaccgtcaaataccaagtcggtgtaagtacgacaggatcatatcatgcgagatgattgaaggggttggtcatgaattcatggacgatttctttggctgttgcgagtctctattggctccagatggtctttttgtcctccagttcatatcgattccagaagaacggtatgaggaatacaggagaagttcagacttcataaaggaatacatctttccagggggttgccttccttccttagcccggatcacgtctgccatgtctgccgcttcaaggctctgcatcgagcaggttgagaacatcgggtaccattactacccgacactgatacgctggagggataacttcatggccaacaaagatgcgattttggctcttggatttgacgacaagttcatccgtgtatgggaatattatttcatatactgtgctgctggtttcaagtcacggacgcttggaacttaccagattgtgttttctcgacctggcaacgacaagttggcctgcgccgacaacccctacgcaagtcttccggcagcctagccagctcactgaacaagtgcacaaccattcaaactcatacctatacatactaggttgcatttaattatccataaattaaggtcgataaattgtaatttccataggagtgtgtgaagtgtcgatcatagtgctaccacagggtgattcattgattggttcctgtaaaggcgtggttcaccatggatgaacatatatatgttgagacatttgtccgccggctggtccaagggcgt

SEQ ID NO: 1469 - DNA, 2962 bp, Brachypodium distachyon
atggagaaggagatcacgagagtggccgttgtgggcgccggggtgagcgggctggcggcggcgcacgagctgtgcagggccggcggcaacggggtgcgcgtcacggtgtacgaggcggaggagcggctcggcggccacgcccgcaccgccgacgtcgacggcgtccaactcgacctcggcttcatggtcttcaaccggttaattaatatacagctgatcatgcatgaaactgaaatcacgtgccaggtgacatacccaaacatgctagaatggtttgaagggctcggcgtggagatggagacatcggacatgtccctatcggtgagcacacagctctctggtggcggcaggtgtgagtggggcagccggaatggcctctctggcctcctggcacagaagagcaacgctctccgccctggattctggcacatgatacgtgagatactcaagttcaaggaggatgtactcagctacctcagtaaccatgagaacaaccctgacctggaccggaacgagaccctgggggaattcatcaagatgcatggatactcccagctcttccaagaggcttacctgatcccaatatgtgcgtgcatatggtcatgcccgtcgcagggagtcctgggcttctctgctttctttgtgctctcgttctgtcgcaaccatcaccttcttcagatcttcggtcgcccccagtggctcaccataaagggccgttctcattcgtatgtaaataaggtaagggaagaactggaaagcatgggctgtaggattaagactaactgccaagtcaaatctgtttcaagttttgaaggaggtcatagagtcttggaggtggatggctcagaggaggtgtacgacaagatcatattcggtgcacatgcacctgatgctctaagaatgctacgagatgaagcaacacacgaggaattgagaattctaggtgctttccagtatgtctacagcgatatatacctccatcgcgacaaaagtttgatgccacgtaactcatcggcatggagcgcctggaactttctggggacgactagcagtggcgtctctgttacctattggctaaatttgcttcagaacatcgaatctaagggcaggcctttcctggtgacattaaatccacctcatgtcccggatcacgtcctgctcaaatggaacactagccatcctgttccctccgttgctgctgcgaaggcctctctggagcttaatcaaatccagggaaaaagaggaatatggttctgcggggcatatcaaggctatggcttccatgaagacggttctaaggctgggaaatctgcagctcaaggtttgctcggtaagaagattgaccttcttctgaacccaaaacagatggttccatcatggaccgaagctggggctcgtcttttagtaacaagatttctcaaccaatacataaccatcggcaacctgaccattcttgaacaaggtggcactatgttcagtttcggtgaagtagacaaaaagtgccttgtcaaatctgtcttgcgagttcatgaccctctcttctactggaaggtcgcaactgaagcagaccttggcttggcagatgcatatgttaacgggtatttctcttttgttgataagagagaagggcttctgaatcttttcctgattctcattgctaacagagatacacagaagagcagtagcagcgcagccagtaaaaggggttggtggacgcccttgcttttaacagctgggattgcatctgctaaatatttcctgcgccacgtctcgaggaagaatactgtcacacaaactcgccaaaacatatctcagcactatgatctgagtaacgatttcttctcgctttttctggatccatcaatgacttactcttgtgccatcttcaaggtggaggatgaaagcttagaagtagcccagctacgtaaagttaacctcctaatagacaaggctaaggtggagcgggatcatcatgttcttgagattggtagtggttggggctgcttagcaatgcaagtggtgaagcaaactggctgcaaatacacagggattacattgtctgaggagcaacttaaatacgcacaaatgaaagtgaaggaagctggtttagaggaccgcataactttcctgctttgtgactaccgtcaaataccaattctccgtaagtatgacaggatcatatcttgcgagatgattgaaggggttggccatgaattcatggacgatttcttcggctgctgcgagtctctcttggctcaagatggcttacttgtcctacagttcatatcgattccagaagaacgatatgaggaatacaggagaagttcagactttataaaagaatacatctttccaggggggtgcttgccttccttggcccggatcacatctgccatgtccgctgcatccagactctgcatcgagcaggttgagaacatcggataccattactatccgacactggtacgctggagggataacttctttgccaacaaatatgcgatttcagcccttggattcgacgacaagttcatccgcatatgggagtactatttcatgtattgtgctgctggtttcaagtcacggacgcttgggaactatcagattgtgttttctagaccaggcaacgacaagctggcctacgccgataatccctacgcaagccttccggcagcatagcttcaacaacacaacgaccattcacatacgtatatatatgcgtatacataggttgcatttaattcatcaatattaaggttcagaaattgttgtaattctatagagggagtatggaactgcacatggatttattcattgattcgattgagcacatgtatggcctgcctcgtcgatgaacattcgacctgaaactttatcgacgtcaaggttttgtaagttggatacctttgattttcagaaagaaaaaagtgcttgtgcaatttttagcccatatgattcagga

SEQ ID NO: 1470 - DNA, 1409 bp, Sorghum bicolor
gagatcccagaaatcttcagccccgggtcagattcgagttggcttactcgaggtagttgtcgttgtagaggtcctccccctcctcgtcctcgtcgggggccactgcggcggcggggtcgtcgtcattggcggagcacagcagtggcgccgcggctggtggtggtgttgggcgggcggcagcctgtcggtgctgaacccgggggaccccagcgtcgagggtgcgttgttctccgactcatcctgcacgatgagaacgccgcgcaaacgtagcaagaggagatcagatgttgcagcgccgcaggcgcgggaggaggacgaggccgggggctcgtgcgcttaccattccgccggcgaaggagaagctctgggcggctcagaggaggctggggtggggcgggcgcggctagagttcagggagcgcagggcagagcggagcgcccggggtttgggggtagaaaaagagccccttgactgccaaaagacgtcagaaaagcccaaaccccaggcgtggcccgtattctctcttcccccacaaggcgcgatgccccctagatcggatcacgccggcggcagcgccgccgccgcggcggccacgcatgccgacttcgactccatcgatcccctcttccacgtcctccgcgtgctccccttctccttcctccggccgccgcgcacccgcctgaggctgccgtcgaacctggcgctcccgtcgcccatgaccgtcttctccctcatcctactcacctacttcgccgtcgtctccggcctcgtctacgacgtcatcgtcgagccccccggcatcggcagcgcccaggaccccggcaccggcgccgtccgccccgtcgtcttcctcccgggccgcgtcaacggtcagtacatcatcgaggggctctcctccgggttcatgttcctccttggcggcgtcggcatcatcctcctcgacctcgccgtcgaccgcaccaggccccgcagcctccgcgtctcgtttggaagcgccggcgcggtcgccgtcgtcatcgcctacgccatggccatgctctttctccgcatcaagatccccggctacctttggtgaggctgataaaatcttgcctgttaattaactagaccagatccgctgcaagatctcgctacatctaaatagatctgcgtgctgtggagtgtggactagcggactcctcttttaattttgtcaattgatgttgcatcgcacaatgttgtatgatatcaactcagaattgcttggtgaggattctcattttgcagtggtactattatcaacctgttccatggaatgcgtgcaatcccactatttatatcaacctgttgtagttgattgagtcagtataatttgttattgtttactaagagcctatttggatacacatggctagttactcgttggggct

SEQ ID NO: 1471 - DNA, 2666 bp, Sorghum bicolor
agagaaacgctcggccaccggcgtgcgcgcggccagcgggcttgcggcgagggcgcggggcgcagccaccggcggccaccagagatggagaggagcgggcaccggcgcggccgctcgctcacacagatcgagaggagagacaaacgggagcaggagaaggaatggcgagcaggaagggaagaaggatagaaggaatatctgtttccatatgagacgcgcgggtcgcgttcgcaagtgggaggaggcaggacgaaaacaattgctgcacaaaaaaaatgtccatcttttactctttttagttgtaatataggagatataaccttacttgattctagctaccaattctatctacaatctagtgacgatcatgcaggtacagaatttgtcattatataaccttacttgattttagctaccaattctatctacaacaaaacaaaagatttggtattgaacctatttccattctaaggttgtattggcattggtatccaattcaatacctccagcccaatatctacatccaaacagagcctgatatctatgttatcgatttcgcctcaccttaattttttcccgtcctcgttgcctctaccagatcccctggtcccaattacccagtcaccccaaaaccctgaatcacaggagatcccagaaatcttcagccccgggtcagattcgagttggcttactcgaggtagttgtcgttgtagaggtcctccccctcctcgtcctcgtcgggggccactgcggcggcggggtcgtcgtcattggcggagcacagcagtggcgccgcggctggtggtggtgttgggcgggcggcagcctgtcggtgctgaacccgggggaccccagcgtcgagggtgcgttgttctccgactcatcctgcacgatgagaacgccgcgcaaacgtagcaagaggagatcagatgttgcagcgccgcaggcgcgggaggaggacgaggccgggggctcgtgcgcttaccattccgccggcgaaggagaagctctgggcggctcagaggaggctggggtggggcgggcgcggctagagttcagggagcgcagggcagagcggagcgcccggggtttgggggtagaaaaagagccccttgactgccaaaagacgtcagaaaagcccaaaccccaggcgtggcccgtattctctcttcccccacaaggcgcgatgccccctagatcggatcacgccggcggcagcgccgccgccgcggcggccacgcatgccgacttcgactccatcgatcccctcttccacgtcctccgcgtgctccccttctccttcctccggccgccgcgcacccgcctgaggctgccgtcgaacctggcgctcccgtcgcccatgaccgtcttctccctcatcctactcacctacttcgccgtcgtctccggcctcgtctacgacgtcatcgtcgagccccccggcatcggcagcgcccaggaccccggcaccggcgccgtccgccccgtcgtcttcctcccgggccgcgtcaacggtcagtacatcatcgaggggctctcctccgggttcatgttcctccttggcggcgtcggcatcatcctcctcgacctcgccgtcgaccgcaccaggccccgcagcctccgcgtctcgtttggaagcgccggcgcggtcgccgtcgtcatcgcctacgccatggccatgctctttctccgcatcaagatccccggctacctttggtgaggctgataaaatcttgcctgttaattaactagaccagatccgctgcaagatctcgctacatctaaatagatctgcgtgctgtggagtgtggactagcggactcctcttttaattttgtcaattgatgttgcatcgcacaatgttgtatgatatcaactcagaattgcttggtgaggattctcattttgcagtggtactattatcaacctgttccatggaatgcgtgcaatcccactatttatatcaacctgttgtagttgattgagtcagtataatttgttattgtttactaagagcctatttggatacacatggctagttactcgttggggctaaaaatcagcccaattttgtggaggttgtagttggctaacaaataatcaaagactcatctcaaaaattagcccatctattagccctcttgtttggatgcactagggctaattttagctacctaagaattagccctggtatccaaacaggccctaagtagcatataccacttatcttcattgtccattggatcgtcttcgacacagtggtgttattggaagaatgtggggatgtagctccagaatgtctgaatgagagataccttttgttagaatgtagattttaggtttgtttaccaacaagggtattagatcctatagtattcttttacaaatttctttttgaacattacactgttttcatgatatggtgataacatcaataacttcaagctctccttgatttgcataatatgttgtaatgttgtaagttcagtatatcctatcgctggattttctacatgtatttgcgttttcttgctaattgattgatttagtgctcctataatcaaatctgtggtgattataaagtaatttttgcttgaaaattgttcccattataacacaaatgggtcccagatgttctcttgcggttgtgcctggctattagaata

SEQ ID NO: 1472 - DNA, 590 bp, Triticum aestivum
cgtattctctcttcccccacaaggcgcgatgccccctagatcggatcacgccggcggcagcgccgccgccgcggcggccacgcatgccgacttcgactccatcgatcccctcttccacgtcctccgcgtgctccccttctccttcctccggccgccgcgcacccgcctgaggctgccgtcgaacctggcgctcccgtcgcccatgaccgtcttctccctcatcctactcacctacttcgccgtcgtctccggcctcgtctacgacgtcatcgtcgagccccccggcatcggcagcgcccaggaccccggcaccggcgccgtccgccccgtcgtcttcctcccgggccgcgtcaacggtcagtacatcatcgaggggctctcctccgggttcatgttcctccttggcggcgtcggcatcatcctcctcgacctcgccgtcgaccgcaccaggccccgcagcctccgcgtctcgtttggaagcgccggcgcggtcgccgtcgtcatcgcctacgccatggccatgctctttctccgcatcaagatccccggctacctttggtgaggctgataaaatcttgcctgttaattaa

SEQ ID NO: 1473 - DNA, 892 bp, Saccharum officinarum
gcaccagcccaggcgtggcccgtattctctcttcccactccacgcgcgatgccccctagatcggatcacgccggccgcagcgccgccgctgcggcggccacgcatgccgacttcgactccatcgatcccctcttccacgtcctccgcgtgctccccttctccttcctccggccgccgcgcacccgcctgaggctgccgtcgaacctggcgctcccctcgcccatgaccgtcttctccctcatcctactcacctacttcgcggtcgtctcgggcctcgtctacgacgtcatcgtagagccccccggcatcggcagcgcccaggaccccggcaccggcgccgtccgccccgtcgtcttcctcccggggcgcgtcaacggccagtacatcatcgaggggctctcctccgggttcatgttcctccttggcggcgtcggcatcatcctcctcgacctcgccgtcgaccgtaccaggccccggagcctccgcgtctcgtttggaagcgccggcgcggtcgccgtcgtcatcgcctacgccatggccatgctctttctccgcatcaagatccccggctacctttggtgagcctgataaaatcttgcctgttaactagaccagatccgttgcaagatctcgctacatcttaatagacctgcgtgctgtggagtgtggactagcggactccctcttttaattatgtcagttaatgttacatcacacaatgttgtattatatcaactcagaattgctgggtgaggattatcattttgcaatgctactaaacaaggcttttcttagtattgagtttcagggattgcgagcaatcccactatttatatcaacctgttgtatttatgtgaatcagtataatatgttattctttacttagtagcgt

SEQ ID NO: 1474 - DNA, 1068 bp, Zea mays
aaaaaaggccaaacccaagcgtaccccgtattttctcccttccccactcaaaggcgcgatggcccctagatcggatcacgccggcggcagcgccgccgctccggtggccacgcaggcccacttcgactccatggatcccctcttccacgtcctccgcgtgctaccattctccttccttcggccgccgcgcacccgcctgaggctgccgtcgaacctggcgcttccctcacccatgaccgtcttctccctcatcctactcacctacttcgcggtcgtctccggcctcgtctacgacgtcatcgttgagccccccggcatcggcagcgcccaggaccccggcaccggcgccgtccgcccagtcgtcttcctcccagggcgcgtcaacggccagtacatcatcgaggggctctcctccgggttcatgttcgtccttggcggcgttggcatcatcctcctcgaccttgcggtcgaccgcaccaggccccggagcctccgcgcctcgtttggaagcgccggcgcagtcgccgttctcatcgcctacgccatggccatgctcttcctccgcatcaagatccccggctacctttggtgaggctgataaaatcttgcctgttaactagaccagatccgttgcaagatctcgctacatctaaatagatctgcgtgctgtggagcgtggactagcttactcctcttttagttatgtcaattaatgttacatcgcaccatgtgctgtataatatctactcagagttgctaggcgaggatatcattatgcaatggtagtagacaaagttcttagtattgagtttcatggcttgtgtggaaccacactatttatatcaacatggtgtagttgattatatcaatataatttgtcattttgtactccctccgttcttttttatttctcgtgttttagttcaaaaatgaactagcgggcgacaaatatttgagaacggaggtagtattaagtaacattccctgtatctccattggccattggattttcttggacatattggtgtgattggaagaatgtcgggatgtagttccagattgtctgaa

SEQ ID NO: 1475 - DNA, 970 bp, Setaria italica
aggtcccgaaaagccccagcactcccaaaccccaggctcgtctttcctctccctgctcgacgcgcgcgatgcctcccagatcggaccacgccgccggcagcgccgccgccgccgcggcggccgcggccgcccagacccacggatccgacttcgactccatcgaccccctgttccacctcctccgagtgctgcccttctccttcctcaggccgccgcgcacccgcctcaggctgccgtccaacctggcgctcccctcccccatgaccgtcttctccctcatcctcctcacctacttcgccgtcgtctccggcctcgtatacgacgtcatcgtcgagccccccggcatcggcagcgcccaggaccccgccaccggcgccgtccgccccgtcgtcttcctcccggggcgcgtcaacggacagtacatcatcgaggggctctcctccgggttcatgttcctcctcggcggcataggcatcatcctcctcgacctcgccgccgatcgcaccagaccccggagcctccgcgtctccttcggcggctctggcgcagtagccgtcgtcatcgcctacgccatggccatgctcttcctccgcatcaagatccccggctacctatggtgaggctgatagatcttactggtttaattagaccagatccgttgcaagatctcgctacatctaaatagatctgcgtgatgtgtttgatggaactagcgaaccccttttttaattatgttaatgttacatcatagtatattgtatgatatcatcatcaactctgaattgttggatgccaattaccatttcgcaatgttactaaacggggcagtattgtgattcagtgctttcgttagattccaattgctactaagtggatcaatttgttgtagttggtgactactgtttttttactaagtactttgtatcacttgttttccttaactttcttggacattgaactctgaattgtt

SEQ ID NO: 1476 - DNA, 1000 bp, Setaria italica
gcgctgccggcggcgtggtccgatctgggaggcccagcactcccaaaccccaggctcgtctttcctctccctgctcgacgcgcgcgatgcctcccagatcggaccacgccgccggcagcgccgccgccgccgcggcggccgcggccgcccagacccacggatccgacttcgactccatcgaccccctgttccacctcctccgagtgctgcccttctccttcctcaggccgccgcgcacccgcctcaggctgccgtccaacctggcgctcccctcccccatgaccgtcttctccctcatcctcctcacctacttcgccgtcgtctccggcctcgtatacgacgtcatcgtcgagccccccggcatcggcagcgcccaggaccccgccaccggcgccgtccgccccgtcgtcttcctcccggggcgcgtcaacggacagtacatcatcgaggggctctcctccgggttcatgttcctcctcggcggcataggcatcatcctcctcgacctcgccgccgatcgcaccagaccccggagcctccgcgtctccttcggcggctctggcgcagtagccgtcgtcatcgcctacgccatggccatgctcttcctccgcatcaagatccccggctacctatggtgaggctgatagatcttactggtttaattagaccagatccgttgcaagatctcgctacatctaaatagatctgcgtgatgtgtttgatggaactagcgaaccccttttttaattatgttaatgttacatcatagtatattgtatgatatcatcatcaactctgaattgttggatgccaattaccatttcgcaatgttactaaacggggcagtattgtgattcagtgctttcgttagattccaattgctactaagtggatcaatttgttgtagttggtgactactgtttttttactaagtactttgtatcacttgttttccttaactttcttggacattgaactctgaattgttggaagaatgcgg

SEQ ID NO: 1477 - DNA, 956 bp, Panicum virgatum
cacgccccccctgctcgccgcgacgcgtgatggcccccagatcggaccacgccggcggcggcgccgccgcggcagtggccgcccagacccacggatccgacttcgactccatcgaccccctcttccacgtcctccgagtgctgcccttctccttcctccggccgccgcgcacccgcctgaggctgccgtccaacctggcgctcccctcccccatgaccgtcttctccctcatcctcctcacctacttcgccgtcgtctccggcctcgtgtacgacgtcatcgtcgagccccccggcatcggcagcgtccaggaccccgccaccggcgccgtccgccccgtcgtcttcctcccgggccgcgtcaacggccagtacatcatcgagggactctcctccggattcatgttcctccttggcggcgtcggcatcatcctcctcgacctcgccgtcgaccgcaccaggccccggagcctccgcgtctccttcggcggcgccggcgcagtagccgtcgtcatcgcctacgccatggccatgctcttcctccgcatcaagatccccggctacctatggtgaggctgataaatattaccggtttaattagaccagatccgttgcaagatctcgctacatctaaatagatctgcctgatgtgtctgatggatcttttaattatgttaatgtcacattatattatgttgtatgatatcatcaactctgaattgttggatgaggatgatcacaacctcaaagtcttggtaactgacatgctctgcaccttgatccctgtttatggcaaggttgtaaagaggtcagatcattaattttagtttatcataaagtgaaatgatagtgtgcaacacgaattggtcattgtgtgctgtaatcagcagggatatttatttaaaaactggagtagtagcaactacaatatggtcttaatacagaatggtttattcc

SEQ ID NO: 1478 - DNA, 806 bp, Pennisetum glaucum
tgctcgactctcgacgcacgatgcctcccagatcggaccacgccggcggcagcgccgcggcggcgtcgtcgtcggcggccgcggccacacagacccacggatccgacttgaactccatcgaccctcttttccacatcctccgagtgttgcccttttccttcctccggccaccgcgcacccgcctcaggctgccgtccaaccttgccctcccctctcccatgaccgtcttctctctcatccttctcacctacttcgccgtcgtctccggcctggtatacgacgtcatcgtcgagcccccaggcatcggcagcgctcaggaccccgccaccggtgccgtccgccccgtcgtcttcctcccggggcgcgtcaacggccagtacatcatcgaggggctctcctccgggttcatgttcctcctcggcggcattggcatcatcctcctcgacctcgccgccgatcgcaccagaccccggagcctccgcgtctccttcggcggctctggtgcggtagccatcgtcatcgcctacgccatggccatgctcttcctccgcatcaagatccccggctacctatggtgaggctgataaatttaccggtttaattaaaccagatcccttgcgagatcttgctacatctaaatagatctgtgatgtgtctgatggaactagcgaaccccttttttcattatgttaatgttacatcatagtgtgttgtatgatatcatcaactctgaattgttggatgacaattatcatttcgcaatggtactaaacttggcttttcccagtattgtgattcagtaattg

SEQ ID NO: 1479 - DNA, 844 bp, Avena sativa
tcctaatccaaataaggcgtgaggaggagttcccccacttcacctcccctacccgagtgcccggcccaagtcgaattaaccagccacacagaaaccggagaaatccccaaatctcccaaagccaagccccggcccgacgcggatggctcccagatcagagcacgccgccggcagcgccgccgcggcgtcagcagcagctcaggccgagttcgactccatggaccccctcttccacgtcctgcgcgtggtccccttctcctttctccagccgccgcgcacccgcctgaagctgccgtccaacctggcgctcccctctcccatgaccgtgtacgccctcatcctgctcacctacttcgcggtcgtctccggcctcgtctacgacgtcatcgtcgagcccccgggcatcggcagcacccaggatccggccaccggcgccgtccgccccgtcgtcttcctccctggccgcgtcaacggccagtacatcatcgagggactctcctccggcttcatgttcctcctcggaggcgtcgggatcatactcctcgacctggcggtcgaccgcaccaggcctcgaaccttgcgcatctccttcggtggcaccggcgtcgccgccatcgtcatcgcatacgcaatggccatgctcttccttcgcatcaagatacccggctacttatggtgaggctgaaaaatcttcccactcgagtatgtcagatccgtcaccagatctatcccccctctcactctctacctctagatctacaagctgttgttgatgactctagtgtacaattttgaactatgttaccacaagatgttggatggtctcaatttaagttactgatcc

SEQ ID NO: 1480 - DNA, 874 bp, Avena sativa
tcctaatccaaataaggcgtgaggaggagttcccccacttcacctcccctacccgagtgcccggcccaagtcgaattaaccagccacacagaaaccggagaaatccccaaatctcccgaagccaagccccggcccgacgcggatggctcccagatcagagcacgccgccggcagcgccgccgcggcgtcagcagcagctcaggccgagttcgactccatggaccccctcttccacgtcctgcgcgtggtccccttctcctttctccagccgccgcgcacccgcctgaagctgccgtccaacctggcgctcccctctcccatgaccgtgtacgccctcatcctgctcacctacttcgcggtcgtctccggcctcgtctacgacgtcatcgtcgagcccccgggcatcggcagcacccaggatccggccaccggcgccgtccgccccgtcgtcttcctccctggccgcgtcaacggccagtacatcatcgagggactctcctccggcttcatgttcctcctcggaggcgtcgggatcatactcctcgacctggcggtcgaccgcaccaggcctcgaaccttgcgcatctccttcggtggcaccggcgtcgccgccatcgtcatcgcatacgcaatggccatgctcttccttcgcatcaagatacccggctacttatggtgaggctgaaaaatcttcccactcgagtatgtcagatccgtcaccagatctatcccccctctcactctctacctctagatctacaagctgttgttgatgactctagtgtacaattttgaactatgttaccacaagatgttggatggtctcaatttaagttactgatccgaggattatctatttcaactgttttccttt

SEQ ID NO: 1481 - DNA, 999 bp, Oryza sativa
gcactacccgtgcccgtcgcacccgattgccatccctacaagcgaggtaacgcaagaatcccccatcaccaaaacccagagacttctctcctcttgctcctcctcgacgccatggcccccagatcggacagcgccaccggcggcgcggccgccgcccaggcccacggatccgacttcgactccatagatcccctcttccacgtcctccgcgtgctccccttctccttcctccggccgccgcgcacccgcctgaggctgccctccaacctggcgctcccctcccccatgaccgtcttcgccctcatcctcctcacctacttcgccgtcgtctccggcctcgtctacgacgtcatcgtcgagccccccggcatcggcagcgtccaggaccccgccaccggcgccgtccgccccgtcgtcttcctccccggccgcgtcaacggccagtacatcatcgaggggctctcctccggcatcatgttcgtcatcggcggcatcgggatcatcctcctcgacctcgccgtcgaccgcaacaggccccggagccttcgcgtctccttcggtggctccggcgtcgccgccatcgtcatcgcgtacgctatggccatgctcttcctccgcatcaagatcccgggctacctatggtgaggaacaagcttctttactttgatcgttagatcagatctgtaacaagattctctacctctagatctgtttgctgttgctgaggaactattgcgcttcctaatgatgttattgtaaaattctggatgattttgagtttaaattagttatctgaagattatcgttttgaaatagaaataaacacggccttacatggaaatgtgactgcataaaaatgctgctatctctatctagttctgctttctgcttttgattggagcagtgtagtttgggataattgctagatgtctagcaacgagtttttaactaactgtatcttagactgcttatctcgattggatattttttggagatagg

SEQ ID NO: 1482 - DNA, 837 bp, Oryza sativa
gcactacccgtgcccgtcgcacccgattgccatccctacaagcgaggtaacgcaagaatcccccatcaccaaaacccagagacttctctcctcttgctcctcctcgacgccatggcccccagatcggacagcgccaccggcggcgcggccgccgcccaggcccacggatccgacttcgactccatagatcccctcttccacgtcctccgcgtgctccccttctccttcctccggccgccgcgcacccgcctgaggctgccctccaacctggcgctcccctcccccatgaccgtcttcgccctcatcctcctcacctacttcgccgtcgtctccggcctcgtctacgacgtcatcgtcgagccccccggcatcggcagcgtccaggaccccgccaccggcgccgtccgccccgtcgtcttcctccccggccgcgtcaacggccagtacatcatcgaggggctctcctccggcatcatgttcgtcatcggcggcatcgggatcatcctcctcgacctcgccgtcgaccgcaacaggccccggagccttcgcgtctccttcggtggctccggcgtcgccgccatcgtcatcgcgtacgctatggccatgctcttcctccgcatcaagatcccgggctacctatggtgaggaacaagcttctttactttgatcgttagatcagatctgtaacaagattctctacctctagatctgtttgctgttgctgaggaactattgcgcttcctaatgatgttattgtaaaattctggatgattttgagtttaaattagttatctgaagattatcgttttgaaatagaaataaacacggccttacatg

SEQ ID NO: 1483 - DNA, 805 bp, Brachypodium distachyon
ggtgcggccaggcccgagaaagagaactccacagaatccccaaatctcccaaaccccggcgagacgccatggcccccagatcggagcacgccgccggcagcgcggccgcgcaggtccacggatccgagttcgaatccatggatcccctcttccacgtcctccgcgtggtccccttctccttcctccagccgccacgcacccgcctcaaggtgccgtccaacctcgcgctcccttcccccatgaccgtgttctccctcatcctgctcacctactttgccgtcgtctcgggcctcgtctacgacgtcatcgtcgaaccccccggcatcgggagctcccaggaccccgccaccggcgccgtccgcccagtcgtcttcctccccggccgcgtcaacggccagtacatcatcgagggcctctcctccggcttcatgttcctcctcggaggcgtcgggatcatcctcctcgacctcgccgtcgaccgcaccaggcctcggagcctccgaatctcgttcgccggctccggtatcgctgccgtcgtcatcgcatacgccatggccatgctcttcctccgcatcaagatacccggctacctctggtgaggccgaaaaaatcttaccaacttcttcatcatgtcagatccccaagatatctcgctctacctctagatctatatgcagttgtgttgatggctctggtgtacaatttagatttatgttgtcataggattctggatgatcttaaattttaaaattatatggtctgaggattatctacttcaaatgacactgaactgttttctttgttc

SEQ ID NO: 1484 - DNA, 985 bp, Brachypodium distachyon
cagcgcagcaagtcttggtcagctggtgcggccaggcccgagaaagagaactccacagaatccccaaatctcccaaaccccggcgagacgccatggcccccagatcggagcacgccgccggcagcgcggccgcgcaggtccacggatccgagttcgaatccatggatcccctcttccacgtcctccgcgtggtccccttctccttcctccagccgccacgcacccgcctcaaggtgccgtccaacctcgcgctcccttcccccatgaccgtgttctccctcatcctgctcacctactttgccgtcgtctcgggcctcgtctacgacgtcatcgtcgaaccccccggcatcgggagctcccaggaccccgccaccggcgccgtccgcccagtcgtcttcctccccggccgcgtcaacggccagtacatcatcgagggcctctcctccggcttcatgttcctcctcggaggcgtcgggatcatcctcctcgacctcgccgtcgaccgcaccaggcctcggagcctccgaatctcgttcgccggctccggtatcgctgccgtcgtcatcgcatacgccatggccatgctcttcctccgcatcaagatacccggctacctctggtgaggccgaaaaaatcttaccaacttcttcatcatgtcagatccccaagatatctcgctctacctctagatctatatgcagttgtgttgatggctctggtgtacaatttagatttatgttgtcataggattctggatgatcttaaattttaaaattatatggtctgaggattatctacttcaaatgacactgaactgttttctttgttctgtatttgggattgcgtgatactgcttctatctagatatattttctgtgatctactgtattagactagtcatagtgcaagtaacttaggtagttacatatgtgctaactaggcatttttgtgacatggcatggtaataaatgaagaaagagaggga

SEQ ID NO: 1485 - DNA, 1108 bp, Secale cereale
cacacaccagacccaaatcccccaagtctccatggctcccagatcggagcacgccggcgggagcgcctcggcggcggcggcggcggcggcggcccagagccacggatccgggttcgactccatggaccccttcttccacgcggtccgcgtggtccccttcgccttcctccagccgccgcgcacccgcctgaagctgccgtccaacctggcgctcccgtccccgatggtcgtcttctcgctcatcctgctcacctacttcgccgtcgtctccggcctcgtctacgacgtcatcgtcgagccccccggcatcggcagctcgcaggacccggccaccggcgccgtccgccccgtcgtcttcctccccggccgcgtcaacggccagtacatcatcgagggcctctcctccggcttcatgttcctcctcggcggcgtcgggatcatcctcctcgacctggcggtcgaccgcaccaggccccgcagcctccgcgtctccttcggcggcgccggcgtcgccgccatcgtcatcgcctacgccatggccatgctcttcctccgcatcaagatacccgggtacctatggtgaggccgaaaattcgtctcccccacttcgttatgcccagatccgtcttcagatctgaggatgctaagctgttgctgatgactctagtgtacaatttaagttatgttaccataggatgttgggttgcactcggatttcaggttgctgatctgaggattatctatttcgagtgatagtaaactgttatgtgttccttttttctgaaattgtgaattgcgtgataatgcagctctgaagatccaatttctgtttagtgtatctttgcagtttcagagaatctttaataactagttttgtgatatgtggcaatcttaatctagggaccaatgctgtttatttgttttctcatctcattctcaagcttcatattcaattgaaaacctaggtggctttttctcatcatgccaatacttcactggaaaatatattttacacagtctactaatttgtatctgtcacttgagtttgcatgttgttgtatctgctgctgggagaatatatataagtttgttgaatgccaaaaaagtc

SEQ ID NO: 1486 - DNA, 908 bp, Hordeum vulgare
gcccccgcacacagcagacccaaatcccccaagtctccatggctcccagatcggagcacgccggcgggagcgcctcggcggcagcggcagcggcggcggcagctgcccagagccacggatccggcttcgactccatggaccccttcttccacgccctccgcgtggtccccttcgccttcctccagccgccgcgcacccgcctgaagctgccgtccaacctggcgctgccgtccccgatggtcgtcttctccctcatcctgctcacctacttcgccgtcgtttccggcctcgtctacgacgtcatcgtcgagcccccgggcatcggcagctcccaggacccggccacgggcgccgtccgccccgtcgtcttcctccccggccgcgtcaacggccagtacatcatcgagggcctctcctccggcttcatgttcctcctcgggggcgtcgggatcatcctcctcgacctggcggtcgaccgcaccaggccccgcagcctgcgcgtctccttcggcggcgccggcgtcgccgccatcgtcatcgcctacgccatggccatgctcttcctccgcatcaagatacccggatacctatggtgaggccgcaaaatcatctccccagttcattatgcccagatccgtcatcagatctgaggatgctaaagctgctgctgatgaccctagtgtacaatttaagttatgttaccataggatgttttgttgcactcgaatttcagttggtggtctgaggattatctatttccaatgatactaaaatagttatgttcctttttttctgaaatggtgactgcgtgacaatgctgctgtggagatcaattttccgtttgctgtatttgtgcaatctcagagaatctctaataactagtttgtgatatgtggtaatcttaatct

SEQ ID NO: 1487 - DNA, 1028 bp, Triticum aestivum
caccagacccaaatcccccaagtctccatggctcccagatcggagcacgccggcgggagcgcctcggcggcagcggcggcggcggcggcggccgcccagagccacggatccgggttcgactccatggaccccttcttccacgcgctccgcgtggtccccttcgccttcctccagccgccgcgcacccgcctgaagctgccgtccaacctggcgctcccgtccccgatggtcgtcttctcgctcatcctgctcacctacttcgccgtcgtctccggcctcgtctacgacgtcatcgtcgagccccccggcatcggcagctcccaggacccggccaccggcgccgtccgccccgtcgtcttcctccccggccgcgtcaacggccagtacatcatcgagggcctctcctccggcttcatgttcctcctcgggggcgtcggggtcatcctcctcgacctggcggtcgaccgcaccaggccccgcagcctgcgcgtctccttcggcggcgccggcgtcgccgccatcgtcatcgcctacgccatggccatgctcttcctccgcatcaagatacccggatacctatggtgaggccgaaaaatcatctccccacttcgttatgccagatccgtcatcagatctgaggatactaagctgttgctgatgactctagtgtacaatttaagttatgttaccataggatgttgggttgcactcaaatttcagttggtgatctgaggattatctatttcaaatgatagtaaactgttgtgtgttcctttttcctgaaattgtgattgcgtgataatgctgctgtcaagatccattttctatttagtgtatctgtgcagtttcagagaatctttcttgttttgcgttgtgtggtaagatatttctcataaatcagttatagatgcgaccatacaagtgtaagaatagtgtactaggtccgtccttccgtagtaataagccaaatgacaagtgtgtaatgcagatgatttctgtctaatattttcctgaaatacagtctgttc

SEQ ID NO: 1488 - DNA, 849 bp, Triticum aestivum
acacaccagacccaaatcccccaagtgtccatggctcccagatcggagcacgccggcgggagcgcctcggcggcagcggcggcggcggcgccggccgcccagagccacggatccgggttcgactccatggaccccttcttccacgcgctccgcgtggtccccttcgccttcctccagccgccgcgcacccgcctgaagctgccgtccaacctggcgctcccgtccccgatggtcgtcttctcgctcatcctgctcacctacttcgccgtcgtctccggcctcgtctacgacgtcatcgtcgagccccccggcatcggcagctcccaggacccggccaccggcgccgtccgccccgtcgtcttcctccccggccgcgtcaacggccagtacatcatcgagggcctctcctccggcttcatgttcctcctcgggggcgtcggggtcatcctcctcgacctggcggtcgaccgcaccaggccccgcagcctgcgcgtctccttcggcggcgccggcgtcgccgccatcgtcatcgcctacgccatggccatgctcttcctccgcatcaagatacccggatacctatggtgaggcctagaaatcatctccctacttcattatgccagatccgccatcagatctgaggatactactaagctgttgctcatgactctagtagtgtacaatttaagttatgttaccttaggatgttgggtcgcactcaaatttcagtcggtgatcagaggattatctatttcaaatgatagtaaactgttgtgtgttccttttttctgaaatggtgattgcatgataatgctgttatgaagatccattttctgtttaaaaaaaaaa

SEQ ID NO: 1489 - DNA, 1836 bp, Setaria italica
ataaaaactccattgacgaaagctcgtcggtgtcgtcctgcccacggcgcgcgcggttgttagagtggagtagagtgagagcgcccgcccgcccggccaagcccgaggcagagctggacctgctggacccctgtcgctggctgccccccgcgcgcgttatatctgtgctccacagggggagagtcccattccgtcagtgatagccagctgctccgctccgccgctatcgggctcgacacccagatcccaatgcgcgccgccgcgtcgctctaggccgagaagctgtgctggtgtgaccgagacgcccggagggtcgcgcgcgcggacgtgcagccatggtgaagctcctggccgtgctggcgctcgttgccgccgccgcgccgttcctccgcgccgccggtcagggcggcgacgaggccgggccgctgccgttcgcggtgggcgcggcgccggcggggtgcgacgtcgggcgcggggagtgggtgcgcgacgaggcggcgcggccgtggtaccaggagtgggagtgcccctacatccagccgcagctgacgtgccaggcgcacggccgccccgacaagggataccagaactggcggtggcagccgcgcgggtgctcgctgcccagcttcaatgcgacgatgatgctggagatgctgcgggggaagcggatgctgttcgtgggcgactcgctgaaccgggggcagtacgtgtccctgctgtgcctcctccaccgcgccatccccgacagcgccaagtcgttcgagaccctggactcgctgagcatcttcagggccaaggactacgacgccaccatcgagttctactgggcgcccatgctcgccgagtccaactccgacgacgccgtcgtgcaccgcgtcgacgaccgcgtcatccgcggcgcgcccatggacaagcacttccggttctggcagggcgcacacatcctcgtcttcaactcctacctctggtggacggccgaggacaagatcaagatcctgaggggcgccgacaatgatctgagcaaggacatcgtggagatgaaggcgtccgaggcctaccggctggtgctgcaccaggtggtccggtggctggagcgcaacgccgaccccaagaactcgagggccttcttcgtcaccgcgtcgccgacccacacagatagcacggcgtggggcgaggatgtcgagggcggcaactgctacaaccagacgacgccaatcggcgacgcgtcctactggggcagcacgagccgggagatgctgcgggtgacggaggaggtgctggcgacgtcgcgggtgcccgtcggggtggtgaacatcacgcagctgtccgagtaccgccgggacgcgcacacgcagacgtacaagaagcagtggatggagccgacgccggagcagcgcgccgaccccaggagctacgccgactgcacgcactggtgcctccccggcgtgcccgacacctggaacgagctgctctactggaagctcttcttccccagcaacgaccaggccctctgatcgatctgatcggtggtgcgtacatacacttggaaaaggattgttggaaggggctagcccatgtaatgtaacatcgatcgcgcggcacgtgcatcgtcgagaggaattaagaagtgtagattaagaaattgaacgtcgtgtgcgatatgattagttgatgttcatggagcagaaaccttgggtggtggccgatggtgtaatcctttttttgttttttttccttttctttttcgatcagtgcaatgacgctcttttgttgaatgaaggaacgaagaaacaattcatagaaaaacatatccttgcacgtgtgaatatgattgcg

SEQ ID NO: 1490 - DNA, 1508 bp, Setaria italica
gcggcggcgacgtaagtgagctaagctcggccgagcaccgcgcggccgcagcgcagctgccgttcgcggtgggcgcggcgccggcggggtgcgacgtcgggagtgggtgcgcgacgaggcggcgcggccgtggtaccaggagtgggagtgcccctacatccagccgcagctgacgtgccaggcgcacggccgccccgacaagggataccagaactggcggtggcagccgcgcgggtgctcgctgcccagcttcaatgcgacgatgatgctggagatgctgcgggggaagcggatgctgttcgtgggcgactcgctgaaccgggggcagtacgtgtccctgctgtgcctcctccaccgcgccatccccgacagcgccaagtcgttcgagaccctggactcgctgagcatcttcagggccaaggactacgacgccaccatcgagttctactgggcgcccatgctcgccgagtccaactccgacgacgccgtcgtgcaccgcgtcgacgaccgcgtcatccgcggcgcgcccatggacaagcacttccggttctggcagggcgcacacatcctcgtcttcaactcctacctctggtggacggccgaggacaagatcaagatcctgaggggcgccgacaatgatctgagcaaggacatcgtggagatgaaggcgtccgaggcctaccggctggtgctgcaccaggtggtccggtggctggagcgcaacgccgaccccaagaactcgagggccttcttcgtcaccgcgtcgccgacccacacagatagcacggcgtggggcgaggatgtcgagggcggcaactgctacaaccagacgacgccaatcggcgacgcgtcctactggggcagcacgagccgggagatgctgcgggtgacggaggaggtgctggcgacgtcgcgggtgcccgtcggggtggtgaacatcacgcagctgtccgagtaccgccgggacgcgcacacgcagacgtacaagaagcagtggatggagccgacgccggagcagcgcgccgaccccaggagctacgccgactgcacgcactggtgcctccccggcgtgcccgacacctggaacgagctgctctactggaagctcttcttccccagcaacgaccaggccctctgatcgatctgatcggtggtgcgtacatacacttggaaaaggattgttggaaggggctagcccatgtaatgtaacatcgatcgcgcggcacgtgcatcgtcgagaggaattaagaagtgtagattaagaaattgaacgtcgtgtgcgatatgattagttgatgttcatggagcagaaaccttgggtggtggccgatggtgtaatcctttttttgttttttttccttttctttttcgatcagtgcaatgacgctcttttgttgaatgaaggaacgaagaaacaattcatagaaaaacatatccttgcacgtgtgaatatgattgcggccttgctcgtaagatctgatccagcacgagttaaagctggcaaactg

SEQ ID NO: 1491 - DNA, 978 bp, Sorghum bicolor
atgcctagatcccgtataaatggaaatttcattgataagacctcctcgattgtagccaatattttattgcaaataattccgacaacctccggggaaaaaagggcatttacttattatagagatggtatgttggctcaatccgaaggaaattatgcggaagctttgcagaattattatgaagctacgcgactagaaattgatccctatgatcgaagttatatactatataacataggccttatacacacaagcaatggagagcatacaaaggctttggaatattatttccgggcgctagaacgaaaccccttcttaccgcaagcttttaataatatggccgtgatctgtcattaccgaggagaacaggccattctacagggcgattcggaaattgcggaagcttggtttgatcaagctgctgagtattggaaacaagctatagcgcttactccaggaaattatattgaagcacagaactggttaaagattacgaagcgctttgaatttgaataagaccactctccattttcataaaaagggtggaagatcaaatcaagaatttcattatatccctttcttctaccttcaattttatatcatatttcataaggataaacaatagggataggctctggaacagaagtaataaagtacataaaagtcggcaatctaaatattcctacctaatatatcaggacggtcttattaataattctaatgagttatcttggaatttggaatcgaatcaaaaaatctatattatgctcactcaaggaaagtagatgtagatagggacttataccctcagaaaaaaaatacactagcttcttaaattaaaacgtaaaaaaagatttttttgttatgtcgggaaataatttcccagaataaccaatgtccgttaggcacctaatccttatgtcataatagatccgaacacttgccttggattgacttcaatatataattgctccagtgaat

SEQ ID NO: 1492 - DNA, 516 bp, Brachypodium distachyon
atgcctagatcccgtgtaaatggaaatttcattgataagacctcctcaattgtagccaatattttattgcgaataattccaacaacctcaggggaaaaaagggcatttacttattatagagatgggatgttggctcaatccgaaggaaattatgcggaagctttgcaaaattattatgaagctacgcgactagaaatcgatccctacgatcgaagttatatactctataacataggccttatacacacaagcaatggagagcatacaaaggctttggaatattatttccgggcactagagcgaaaccccttcttaccgcaagcttttaataatatggccgtgatctgtcattaccgaggagaacaggccattctacagggtgattcagaaattgcagaagcttggtttgatcaagctgctgagtattggaaacaagctatagcgcttactccgggaaattatattgaagcacagaactggttgaagattacgaagcgctttgaatttgaataagac

SEQ ID NO: 1493 - DNA, 573 bp, Brachypodium distachyon
aatgggttgggaattatgcctagatcccgtgtaaatggaaatttcattgataagacctcctcaattgtagccaatattttattgcgaataattccaacaacctcaggggaaaaaagggcatttacttattatagagatgattttttgaatagaatgaacgaccgtaacggatgttggctcaatccgaaggaaattatgcggaagctttgcaaaattattatgaagctacgcgactagaaatcgatccctacgatcgaagttatatactctataacataggccttatacacacaagcaatggagagcatacaaaggctttggaatattatttccgggcactagagcgaaaccccttcttaccgcaagcttttaataatatggccgtgatctgtcattaccgaggagaacaggccattctacagggtgattcagaaattgcagaagcttggtttgatcaagctgctgagtattggaaacaagctatagcgcttactccgggaaattatattgaagcacagaactggttgaagattacgaagcgctttgaatttgaataagaccacgttccttttt

SEQ ID NO: 1494 - DNA, 548 bp, Brachypodium distachyon
aatgggttgggaattatgcctagatcccgtgtaaatggaaatttcattgataagacctcctcaattgtagccaatattttattgcgaataattccaacaacctcaggggaaaaaagggcatttacttattatagagatgattttttgaatagaatgaacgaccgtaacggatgttggctcaatccgaaggaaattatgcggaagctttgcaaaattattatgaagctacgcgactagaaatcgatccctacgatcgaagttatatactctataacataggccttatacacacaagcaatggagagcatacaaaggctttggaatattatttccgggcactagagcgaaaccccttcttaccgcaagcttttaataatatggctgtgatctgtcattacgccattctacagggtgattcagaaattgcagaagcttggtttgatcaagctgctgagtattggaaacaagctatagcgcttactccgggaaattatattgaagcacagaactggttgaagattacgaagcgctttgaatttgaataagac

SEQ ID NO: 1495 - DNA, 553 bp, Amborella trichopoda
gtttccccgaggggaaatgagaataattataaagtaaagtggattgctaaatatgcctagatctcggataaatggcaattttatcgataagacctcttcaattgtagccaatatcttattacggatcattccgacgacttcaggagaaaaagaggcatttacctattacagagatgctcaatctgaaggaaattatgcggaagctttacagaattattatgaagctacgcgaccagaaattgatccctatgatcgaagttatatactctataatataggacttatccacacaagcaacggagaacatacgaaggctttggaatattattttcgggcactagaacgaaatccattcttaccacaagcttctaataatatggccgtgatctgtcattacgccattcgacagggagattctgaaatcgcagagacttggtccgatcaagcagctgagtattggaaacaagctatagcgcttactccaggtaattatattgaagcacagaattggttgaagatcacgaggcgcttcgaataagaacactctcttttt

SEQ ID NO: 1496 - DNA, 455 bp, Sorghum bicolor
atagaatgggttgggaattatgcctagatcccgtataaatggaaatttcattgataagacctcctcgattgtagccaatattttattgcaaataattccgacaacctccggggaaaaaagggcatttacttattatagagatgggatgttggctcaatccgaaggaaattatgcggaagctttgcagaattattatgaagctacgcgactagaaattgatccctatgatcgaagttatatactatataacataggccttatacacacaagcaatggagagcatacaaaggctttggaatattatttccgggcgctagaacgaaaccccttcttaccgcaagcttttaataatatggccgtgatctgtcattacggagaacaggccattctacagggcgattcggaaattgcggaagcttggtttgatcaagctgctgagtattggaaacaagcta

SEQ ID NO: 1497 - DNA, 1466 bp, Sorghum bicolor
caccgctcccgctgactcctgggccaggggagcggacctgaccctttctaggtccacgcgtcattgacccacccatgtggacgtggatgcggtggacgacggctggacgcccgccttttccaccgaaaaccagcccggccgcccggcggtgaggggaggaatcccccccccccctcctcacgcacgctcctctactcgccatctttagcctgggccccacctcccgtgccgtggccattaaagcgggaccgaccgggcgctccctgcctcctcgtcgttccgttccgttccgttccaccgaccagatccacccgcccagccatgccggcgccgacgcttccaacgccgccgccttcgccgctgctgccgccggcgggggagccgttccgcgtgttcgtggggtacgacccgcgtgagcacgaggcgtacgaggtgtgccgccgcagcctgctccgccgctcgtcgatcccgctggacgtgcgcccgatccggcaggcggacctccgcgccgcggggctctacacccgggcgcgcggccccaccgagagcaccgagttctccttcacgcgcttcctcaccccgtacctcgcgggctaccgcggctgggcgctcttcgtcgactgcgacttcctctacctcgccgacatcgccgagctcctcgccgccgccgtcccgcccgccgacgccgccgaccgcatcgccgtcgcctgcgtcaagcacgagtaccagcccgctgaggccaccaagatggacggcgccatccagacggtgtacccgcgcaagaactggtcctccatggtgctctacaactgcgcccaccccaagaacgtggccgtgctcaccccggacgccgtcagcacccagaccggcgccttcctccaccgcttcgcttggctcgacgacgacgagatcggggaggtgccattcgcctggaacttcctcgtcggccacaaccgggtcgaccccgccgacccggccacgcgccccaaggccatccactacacctccggcgggccgtggttcgagcgctacagggactgcgagttcgccgacctctggctcaaggaggccgacgagctcagggccgagaaggacaagctcaagctcctcaaggacaaggacgacgccggcgtcaagcaagaggaggcggcggcgcaggagaaggtgaagtgatgatcatcgtcatcgatcggtgatactgcattggatggattggttcgttctgtgctatgctccagagatttcatttctcgtggacaatgtattcattcatctgacgccaccaatgtagtattgcatcgatctgttactgctgatgtctcagagattagattgatggtaggcttgtatggatcagttggattaataatgtaagataagaagaaaattggcagctgtaatcggtgtcggtgggtctgtggattctgaatgctcatcgtttaaggaataccaaccgtatattcttc

SEQ ID NO: 1498 - DNA, 4400 bp, Sorghum bicolor
ttctctttttggataaaaacaaatcttgattgatgaggagtacatcttacatcaagtaagatcatgtgtaacggatcgttgcctcgcccatgctttagcgagcttgcctaactgcgtgcgcctcaccatcatttgccacatctgctcaaacacctccaggtcctccatgacccaggcttcggcgtccccaaggccaaagacatgcatgcatatatctacataactttccacatatttttctgactttttattcgtttgtcatctggtttgaggcatgctttgcacggtttgatagaaacaacaaacacggctgcaatgactcatgcgtagtagtgatcggagttaagcatgcacgacaaaaaggaaacatgctcttaattctttcttgaaacaaaaagagtcaaaatggctaatgaattggacctaaaaaaattgaaaaagcaaaagaaaaagactgaagtatttgtaactctgagtctagaagaaatcttggtttaggaggagtcttacatcttatatcatgtaagatcacgggtgacggatggcttatatagtacgacgtttagatcgaacggttattagagagggagatcccctttaaaaaatctcgctcttttatagtgtgatatatatctaatagtggggaatgatgtggacaccttgcatgaagatatagaacatttagcgggtcacttagtggggaatgatatggacaccttgcatgaagaaaagaattcatctagtggagtttagctttataagagtatatgatgagaaattgtaagccttacttttgtctcaacaaatgtgcatgcatatttcatgagtaaagagtgacctagctattgagtcctaccgtaacacaaaaagagtggataatacaaatgaactatttacacctgctaaagaccaactttttctataaaggtgtgtctcctcatctgatgactattggttagcttaaccctcaattgtcttcgaactcccgccatgatctctcatccttgcgtctctcctcccttgcgcaatcgtcttcttcctcctcgcgcctcctcgtccttgcggcccagctcgcctgcctcgctggcgcccctcctctgcctcgtcctcgcccacgttgttgtccaccgccccaccgtggaagggctatggttgtgctggagctccgcagctgccgtgaccgcctctttcttctccttccccgcatcaacttgggctgaccatggagctctgcccatgggactccgatgacctagcccaacatggccatatagctttggccatggagctctctcgccctgttctagcccagtcgcctccaaccgccgccagggcccataactacctagccgaattgcctcccccgagccccttcttctaagcccgtcggagttggcgaggggggaggggggtgggagtgggcgtgagcatgggtgtgggtggagctccactggagaggagttgtcggagatgagagagagggcatgagcgaaagtgtgggggagaggatgactaacggaaatatgccttatcaggtgactatatctgagtatttctatttctataaatggttaagttatcaacaaaaagaacggaaaaggtttggagaacatctgagccaaaagtaacgcatacgacagttgtcgtgtccatagcttccttagccttagagacaactcattaataacaacgacaaaacaagtacaacgaaagcagacaccatcgcttgattattccagaagtctgaatataccctttggattgattttccgtttatagtgaaaaatgacgtagcgaagatacgtacatgcactaacttttataaaatgaccatattaccctttacgtggcaatgcatagagctcaaatgatctatctagagcttcttaaaccactctaacttgacactcacaaattggtcaccgatttacacacatcatgtgagtttcttaaaccgctctaactgcattaagatgtgttgaattcctaatacgagtatacgacccatggtgtcttattaacgcctaagaaaacccatgctaagggcatccacaatggtgttcaaatcgctagctatttgatcctaggaagaatgttattggctctcaatggtaatttgcaaatagctagcttaagaagtcgctagctattagaaagtcactagctattgtggagagtattgtgagagagttatttctagaagattgtgctagattagcaatttatgagtcgctagctattaggaagtcgctagctatttgatctctctcctcgatagccaatgaaagtgctacttttttattatttttatacatcatctcgttagctatttgtaaagtgctattgaaagccaatagaatttctcctaactaactatttgataaccattgcggatgacctaaccttgcagcagataatatagcttgctgtctaattacaaattctttacagaaacatgtttacccaaggagggcctgcttgctacattcgacacgaatggacattgtacacgaatttatccggccttttaagttttataaaacccgaggccttaacttaaaaattctcaagatgacctcaaccagcggcgaccggcgactaggaccgtccgacggcagcgtgcccgacccgagggcggaggcacataccccgatacccgtccaggtccggccgcaggcccgcaacgcgccacccgctaactgccacgcggcggtctgcgtccggccacgtgcagtccgcaggcgctgcatctgtcgccggtctcgggtttccggtgggtgatgcccacggcgcccgccgctccgagcaccgacatccccgcagcaggactgcgtccgctcccgctgactcctgggccaggggagcggacctgaccctttctaggtccacgcgtcattgacccacccatgtggacgtggatgcggtggacgacggctggacgcccgccttttccaccgaaaaccagcccggccgcccggcggtgaggggaggaatcccccccccccctcctcacgcacgctcctctactcgccatctttagcctgggccccacctcccgtgccgtggccattaaagcgggaccgaccgggcgctccctgcctcctcgtcgttccgttccgttccgttccaccgaccagatccacccgcccagccatgccggcgccgacgcttccaacgccgccgccttcgccgctgctgccgccggcgggggagccgttccgcgtgttcgtggggtacgacccgcgtgagcacgaggcgtacgaggtgtgccgccgcagcctgctccgccgctcgtcgatcccgctggacgtgcgcccgatccggcaggcggacctccgcgccgcggggctctacacccgggcgcgcggccccaccgagagcaccgagttctccttcacgcgcttcctcaccccgtacctcgcgggctaccgcggctgggcgctcttcgtcgactgcgacttcctctacctcgccgacatcgccgagctcctcgccgccgccgtcccgcccgccgacgccgccgaccgcatcgccgtcgcctgcgtcaagcacgagtaccagcccgctgaggccaccaagatggacggcgccatccagacggtgtacccgcgcaagaactggtcctccatggtgctctacaactgcgcccaccccaagaacgtggccgtgctcaccccggacgccgtcagcacccagaccggcgccttcctccaccgcttcgcttggctcgacgacgacgagatcggggaggtgccattcgcctggaacttcctcgtcggccacaaccgggtcgaccccgccgacccggccacgcgccccaaggccatccactacacctccggcgggccgtggttcgagcgctacagggactgcgagttcgccgacctctggctcaaggaggccgacgagctcagggccgagaaggacaagctcaagctcctcaaggacaaggacgacgccggcgtcaagcaagaggaggcggcggcgcaggagaaggtgaagtgatgatcatcgtcatcgatcggtgatactgcattggatggattggttcgttctgtgctatgctccagagatttcatttctcgtggacaatgtattcattcatctgacgccaccaatgtagtattgcatcgatctgttactgctgatgtctcagagattagattgatggtaggcttgtatggatcagttggattaataatgtaagataagaagaaaattggcagctgtaatcggtgtcggtgggtctgtggattctgaatgctcatcgtttaaggaataccaaccgtatattcttcagcattgctccggtgaggtttctcatcacatcgccccatccttggcctgaaatagacaccacccgtggcgtgtctgtaatccagccgtgcagagaatgcgac

SEQ ID NO: 1499 - DNA, 1203 bp, Saccharum officinarum
cgccgcccaaaatctccgcgtccccctcgcccaccatggcctccttcttcggagacgacggcgccgacgacctcccgcgcaccacctcccaccccttcgactccgacgacttcggcgccgccgcggccgacggcgacggcgccggcgggtacgcctccttcgccgaggggggcgtcgaggaggtggacgaggagatcaccgtcgagtccgacggggtcccgatccgccacgtctccgggggttactcgccctcgccgttctccccagagctcgagcccaacggcggcgacggcccgatcctgccgccgcccaccgagatgcgggaggagggcatcctcctccgcgagtggcggaggaaaaatgctattgaacttgagaaaaaggaacagaaggagaaggagctacgtgcccaaataattgctgaagctgaagaattcaagaaagctttttttgagaagaggatacagaactgtgcgtcaaatatggtcaacaacagagagagggagaagatttttgtagccagccaggagaagttccatgccaacgcagacaagcagtactggaagtcgatttcagatctcatcccacatgaaatagccaccattgagaagcggggaaagaaagacaaggacaagaagccatccatcacagttattcagggccccaagcctggcaagcccaccgacctctcccggttgcgtcatatcttagtgaagctgaagcatgctccgccgccacatatgttgcaacctccaccaccagcacctgctgctaaagagggtgcaaaggatggtgccaaagaaggtgcaaaggatggtgccaaggaagctgcggcagccccagcaaacggcgccaagcagcctgcagagagccaagaaaaccccgccaatggcccatccgaggctgagaaagagcagcctgcagcgtcggagtgaccggaaagggtagctttacagaaacacaagagccttactatcagtagatggaagcgtgttctatttctgatgatttccagacctgtttgtcccgtactgatcttttgtagagatctgcatcaggatgtcgttatatcagcgcagaacattcataattagtatcaccacagcagttgtatttttactgttttcctcttgtccaagtgtgtcttcactgagatgcctgtgatctgaaactgttactgagagttcaactgaatactctatt

SEQ ID NO: 1500 - DNA, 1955 bp, Sorghum bicolor
aaaacgcattattgatcaggctggcggagcaagccacggaaagcaaagcaaagcaaagcgcacccatccagatacacacgagcacgcgcccgcgcccgcgcccgcacccgcatagcaccaccagtccaccaccaggccggcgccgcccaaaatctccgcgtccctctcgcccaccatggcctccttcttcggcgacgacggcgccgacgagctcccgcgcaccacctcccaccccttcgactccgacgacttcggcgccgccgcggccgacggcgacggcgccggcgggtacggcgggtacgcctccttcgccgaggggggcgtcgaggatgtggacgaggagatcaccgtcgagtccgacggggtcccgatccgccacgtctccgggggttactcgccctcgccgttctcccccgagctcgagcccaacggcggcgacggcccgatcctgccgccgcccaccgagatgcgggaggagggcatcctcctccgcgagtggcggaggaaaaatgctattgaacttgagaaaaaggaacagaaggagaaggagctacgtgcccaaataattgcagaagctgaagaattcaagaaagctttttttgagaagaggatacagaattgtgcgtcaaatatggtcaacaacagagaaagggagaagatttttgtagccagccaggagaaattccatgccaacgcagacaagcagtactggaaatcgatttcagatctcatcccacatgaaatagccaccattgagaagcggggaaagaaagacaaggacaagaagccatccatcacagttattcagggccccaagcctggcaagcccaccgacctctcccggatgcgccatatcttagtgaagctgaagcatgctccaccgccacatatgttgcaacctccaccagcacctgctgctaaagagggcgcaaaggatggtgccaaagaaggcgcaaaggatggcgccaaagaaggcgcggcagccccagcaaacggcgccaagcagccagcagagagccaagaaacccccgccaatggcccctctgaggccgagaaagagcagcctgcagcgtcagagtgaccggaaagggtagcactacagaaacacaagagccttgactgtcagtagatggaagcgtgttttatttcttgatgatttccagacccgtttgtcccgtactgatcttttgtagagatctgcatcaggatgtctttatatcagcgcagaacattcataattagtatcaccacagcagttgtatctttactgttttcctcttgtccaagcgtgtctttcactgagatgcctgtgatctcaagttcagatctgaaactgttaccgagagaactgaatactctatgatatgctacagcactaatatgataataatctcaagctgtgcaataagcagcaatcttgcattgctctggcatgaattcactaatctatatgtacaagatctagttgccgcatttgcaggaggaaacaacaccacacacattgcactcactctcttataccgtcagatcggtagctctacatagtcgccagttcacaagcaaggaattactcaatcacatttacatctgcctggtgttgcttcacctggggctcatctcagtcaccgttggtggcacaaccgtgctgaacatgttggaatcctcggacgccgagttcttgaacctgtagttgctggaaacggtggccctggacccggggctcctcctgctgctctcgtggaggtaacctggcgccgtcagctcgctgtcgttgatcctgatgggcttggacagcatggtcacgacctggggcatcgtcggccggcgagcggcggccgcctgtaagcagaagagggccaccttgatgtacctgatgacttcttcctcagggtaatctacaagggttggatccaccagttccttaaggctctttgcttcatatagctcccatgtct

(The sequence listing continues in the following parts.)

What is claimed is:

1. A method of increasing nitrogen use efficiency, yield, biomass, growth rate, and/or abiotic stress tolerance of a plant as compared to a wild type plant of the same species which is grown under the same growth conditions, comprising expressing within the plant an exogenous polynucleotide comprising a nucleic acid sequence encoding the polypeptide set forth by SEQ ID NO: 672, thereby increasing the nitrogen use efficiency, yield, biomass, growth rate, and/or abiotic stress tolerance of the plant as compared to the wild type plant of the same species which is grown under the same growth conditions.

2. The method of claim 1, wherein said exogenous polynucleotide comprises the nucleic acid sequence selected from the group consisting of SEQ ID NOs: 457, 203, and 253.

3. The method of claim 1, further comprising growing the plant expressing said exogenous polynucleotide under nitrogen-limiting conditions.

4. A method of growing a crop, comprising: seeding seeds and/or planting plantlets of a plant transformed with a nucleic acid construct comprising an exogenous polynucleotide which comprises a nucleic acid sequence encoding the polypeptide set forth by SEQ ID NO: 672, and a promoter for directing transcription of said nucleic acid sequence in a plant cell, wherein the plant is derived from plants selected for at least one trait selected from the group consisting of: increased nitrogen use efficiency, increased abiotic stress tolerance, increased biomass, increased growth rate, and increased yield as compared to a non-transformed plant, thereby growing the crop.

5. The method of claim 4, wherein said abiotic stress is nitrogen deficiency.

* * * * *